United States Patent 10,233,495 (METHODS AND COMPOSITIONS FOR SCREENING AND TREATING DEVELOPMENTAL DISORDERS) - sequence listing, part 198

SEQ ID NO: 1382 - DNA, 515716 bp, Homo sapiens
aactattttataatatctataataaatgcaaagaaatcaatacaaacaaaacttggctttagcaaactgtacatacataaatatctttttttttttactataacattcaacttttttcacataaagccttccatgatcttatttattacatctagtttttctttatacctctaaaaaaaagtgccttttagatttacagcttgtgcttctaaagcaaaggttaaaacatcatgccccaaaggaaaacaaggtaaaaaggaagctgccatataagctcttaaaaattgtatgttacaaggttctaaaatctcttcagcactggttggttggtagattgtacgacactgacatggtgcttgggagggtcatttatctgatggttggagcagcaccatgggaaagctgcccagatggtctactgaagtccttggctgtgcacagaatgggccaagggcccagaattcatgagtccggggaactttggaggtccttactcaatctccttagtgctaaggttcagagtctcaaaccagatttcttccaaaccttcttgttgtctgtttgttcccccgtcactgtttatcttccacctctgaagccataatttgcacacatgtgatctggaggagggctaaagctgccacaccgagggctttcgccaagatcaaggtcctcttgttggtagtttgggattgcttatgacccgatcctccttatgctaccagcacttctgcagatggcatctgcttagttcagagtggaggagggccattcgtgtatctgagcatggggtggaatgaccgggcaaagttgttggagagggcacagctgtagtcttcctctgacattggtacaaggcaggcaagcccgatgaggaggagcaggagaagctgaaggggaagagctgctcggaggactctgaacaggaagccgcggccggaccgacctggccctggctcagaaagggaggaatcggagccaccttttgtggacctgagagaagaatggacataaattactcagataactccagtgtcggagggacgctgctttttgcctctgcaccttcctggaagctaaagggccatgccaagcacaccccagcctggcgatcagctgccagccttccacagtgtgcccaggtcaccccccaccatcaaatgaggttgttggaaactgcactgacaagaaataaacatttagtcagtcaactaaacgtaagtaattaggttcaaattctactccttttaccccttaatgtggtgaaacattttctatcaacgaaaataactgctctatacacattctactagcatgaattaagtagatccagaataattaaaatgtagatatttgatgcagcatatttttgttttaagaatatcatgaacattgttaagcaaaattagttgctgtcagaatcataccaagtatcccatctagccatcctggatatgccaaaatccatgcagcaaaaataaaaacagtctttgtcattttgcacagacccataaaagcttcattaatcatagagcataccctggtttcatcttgcactgaatcagcatcaggccctgacattagcgggttccaaagctgtacgaacaaggaatagcagtggagtctgtctacagaacactggtgttgtatgatgtagatgctaggctgatcctatcactgacgtcattactttggaaaatggacaccattttctgaggaggatggactgtcatcctacagccccttctacactcaaagtgacaagtttttctatttcacttttatcttccttttaaacagtgcattagagattgagtacaggtttcagaactcttaagaaggactgcctggaaaatacagaatctggaagtagattctgagttgggtgctactgttttctttttgtgaacagccattacctttttttggttactagcagaaaagatgaagaaagaaatgttgtttacgacaggcatttggtgtacactcagacccatacaacattgaatgaacaaaaataaaagatgtagccaaaagaaacactccctcacaactagtataaattccttaagagttttaatatcaccaaggataaggacattgtatgtgaggctactgaaataatatgagcgtgtgaaagctgtattggtaactgtaggtttggtccagaagaaagcactatgtttgtagctcacctattacctattaatttctgaagacagactaccctaatatcggtgggggatgcggagtgacacctaagaaaataaatgttaaaaacagatagaatccccttagaagggaacagagggagtattcaaaactcttttattaaaccatcaaagaaaaatgggagagggctgggcacagtggctcccgcctgtaatcccagcgctttgggaggctgaggttggcggatcacttgaggccaggagttcaagccagcctggccaacatggtaaaaatacaaaaattagtcaggcctggtggcgtgtgcctgtagtcccagtcacttgggaggctgaggcaggagaatcgcttgaacccgggaggcggaggctgcagtgagccatgatcggaacaccactgcactccatcctgggcaacagagcgagactctatctcaaaaacagatattggttctgcagaaaccccaagaaacaggcagcacgcagtgtttctatacacttcttgtggtgtaaggaaaaatcaaatcactggtttaaattggaagcatgttcttttctgaaatccacacaagtaacggcagggtaatgtaaccttgaacaactcacttcatctctaggtgtcaacctcttcactaacctcttcaaattagcatagatggtcttctaactttaaagtttactgttcgatgtttttgtcttctactgatttgtcagtataaataatctcccaagaagccacaagagctcaatcaccatctagtggtcaaactgattaactgcccttgtgctaagaccaatgagttattcctaataagctgagggaaaaaaaaagtatattttgtgaaaatatagtagaacataaaagaagtatgtcatataccttattaatggaaaaggaaaatagaaacttcttgagttacctgagcataaaatattcatgttgagacagggccttagagagcatccagttcatctcctaattttgtaggggagtagctaaggacagttcatgtttactcttctaattgctaggcagcactctgagcatttatgttgggttctgtcatttaatccccacagcagtcctctgcggtgtgtacttattaacttcattttacagatgatgtgaaagaaagctcagggaagtgaaataactggctcaagctcacacagccagtggcagaagatttcaaccctgtgattttaactaccagaacctggagactctagacaggctgaatgacttgcttcagattctacagttaaaggaagaggcctagcagggactcaggcttccaaaatccctgcccaccgcactctctgctgtgaaatgttttgctggttggtgataggaataatggtaatggtaattcaggtcgtattcatttcacaggtatctcacatgtagaagcaaagaagagaatcctgaacttgcatcctaaaatatttggaaacaagtggtttcctcgtgtctaaagcctctggtcataaggcctcacagtatcctgcagatcatcaaatccgtgtgtggacgtggggacattttgttttgaggcagttacatgaccatgggcaagtaaattagtctctctggccttcagttttctcatttgcaatgattcaatggtttgccttaaagtgtcttaagaaggataggatagctacccacaaactttggatcaaattttcttcaaaacatccttcccctgactttaaaatatgccctggcaaccaacactcaacacctgtagctagatgagttataacagagtgactgaagagagctcccacaattcctagttattaaatacctgactaattttcattaggagacatttaagaactttagtgatgggaagatttacatatataattgatagtacaatctgacagagctgaatagctcctgtttgtcaactgttaaattctttgtgcaattaggtcaaagatcaagatcaaaacaagggctgcccattgacctgttcactcctgagaaaaatggcaaaccattgaatcataaatcatgacagccaaaataattttaggatattaatgcacccctcatctttgcaaatgagaaaactgaaggccagagagactaatttacttgcccatttttgataaaaatgtcaccatttacagaatgtggactcctatgttggagtctgttgaaggacatggcacatttaacagcatcagagcattttttattaaaatttaatttgtgcatgacttctaatgctgaagaacgccaagctaggaagaagtcatgggctgagatggggacagagagaacacacaatattcagtgactgtccgtgcagctggctgcccttgaaaatatccgaactatccactgggaaaatgcctgtccccttggggtaattaccagagtttcaacatgcccaaagctgcctcatcttcagggggaacttgttctagcgattttagtatcaagaagctaatggtcccagggaaagggttatttttaatatttagctactgtgctaaaaatcacctaagtttctagagtcttgggaaatttcataagggaaagaacaaaggcaacttgttgactacccactggtcattctcctctggtcttattacatacatggatgccagtttagattgtgtttatataggaaaaattaaatgtgtgagcctccttaaggaacatcatcaatacagatatatcagatagttctgtccagcaaaaaacgtgcttatttgctacaagtaaatttttatttatttttctcacttccctcactccttcaaatttccaggtaaatagctgcccaggagttgcttcatctctgtcccaaaatacctagacaattgcgggataaggagaatggcagggagggagtagtggctaaaatcacacccttcaaaagaaagtgtgtaggacacacaattgtgagaagtctgaatgccatgcacatagggtatgactcactttgaaaattgtttataatcaaggaaatgaaaatgagttaatttcgtgcatgcatcatttaaagccaaatgagaagaaacttctaatttattttgttacttttcggctaacactggcagtatgtaacagatttattttgcagaaacatctagattgtccgtgatcttgatcctgcccttatgtgtcttgtctttgaaacccagtgtttcctggatatatggttcaggagacaagtttccagaatcaagttaggacccaggtcttctttttttccaaaccaaacattcttgctaatcctaaactacctgaggcagcctgtggtggcctcagctctaaaaccattgtttaaaggcttctacccatcaatggcccttcagcagagtggtacggttaacggggtagggtctggagtcaggggagacctgggttcaaatcctacatctttacacctctaatccccagtgtccttgtctataaattgggaatatagccatgtcatgggattcttgtgagggttaaatgaggtaaaacacatacaatgcttagcatgtatacaattaagcactaaataattgaaacacattaagtactaaatgaatgtcagcagcttatcactattatctgtataatgataccaagggtgtgccgactcatacccttaggggttggctggattcggccttttctctcgggaaaacatacctgatttattaatagtgctttcaagcatgtgataaatttctcaaactgcctgtcttgttccctagaaacaccaggaaggcctacctcaaatagcaacagagaaacctatcggagccttaccctacagctttccttggggcacgggtgagcaatctgccttagaggggagaggctctgtgctgaggctctttgaatgctttgaataaatagatccccagataatgaaaagacttcaaaacaaattctacaagaaactgagtagtgtttatagtgaggccctagtgtacatgcaaaaaacccccactgcccttgcttaaatgtatctgattaacttgaatacatttttaaatgagggcttttttccctctttcagtgtttcggccagtcatttgccacttctcattccatcttagttctctgtaaagaaggtgccagagacctaaggtgcccaaggcaattttgcattttacaattctaagctttagaatgaagtcatcaatttgctacatccggactacagtgcaattattcctttgccttgctggaaattggagtgaaatctttctagctgtcaatttcaactcagttgcagtagtgttttgaagaattaatggcgataaggttagaaaattttaagtcaaacgtagggaaaaagtaccagctagaccatcataagcatttgctttgaaagcatgcttctaaagtgtgtttaacctcaaataacagtcacaaatatggttattatgaatgtatgcacagatttttatgtttctaattttaagaagttctagggagctccctgtaacgatttagggaatctctagattctgatatactgcaagtcttttaatggtaggaatcacattgaattaattttgtaggcccagggcctaaatttagtaggtgttcagtacctattggcatcaattcatatgtaggtttaaaatactgtatgaagatacagaatcaccaccatcaaatcaaattgaaatatgtaacaggctagtataatattaacatctgactttaaacaacaacaaagaaaccaaatgagtaactcctcccttcaaactaatagtcagtttcttccaactcagtctctttctcctctcaggaagaatgcgtatctaaaaatttcccattgcagactgctggaaacaacattctaaactatttatgcttctgcaataacctttccaatttgctggaccagtgcaagattaaacacgagatatctcaagtctcaatgtaaaggaacaccacgacagcctggactgtgggtgaagttcattcttccccagcagactctgcctttcattctcggggttgggtgtgccccaaacagaggtaccgacggtaacgaagcccaagaatgttcaaccacaacctgtctgtgaaggtgttggatgacgtttgccattcaggtgaagattatttatgttccagtcccacctgagtagcaaagtgaacactgtgctgaatgctcagaaagatgttaatgaaccgtgctggacagagcagagctgaaaggcgccttgcgagtgtcgtagtgagaatgtggctgtcccagctgcaaagccctgttaggaggcatgaggaagcacttgctgccctaagaaacgatgccttcgacattttcaaaagatctatgtggctgtctgaaacaatgcggagagcagatagacgcaatatttgggaaccaaagagtgactgctgttggcgttgcatcataacataagcgctttcccccttctcgtcactatcatttgtatcaaccaaagaactgatctctggtatcctcgaaggaatgctgtggggatattcttcatctctgttcatggtacatcagcaatttgtggggaaaagatggactatataacacaatgatctgcctaaaagaaactgtctctacttatagggggctgagcaaaccttagagcatctgcggatgctcgtcattatcttcaaaagtccccaagagtttttctccatactttattattgctattttgtttaggctagaaaaaaaaaaactcataaaattgtcttcaaaccaaaccaaaggaaatgaaaagaaaaaaaaaaacagtacagggaggtctaaaaccagagaacatatgaaaatacgttctgcctgacttcagccgagtgggaaggaccaaatgaaatagccagtcccttatgtacagctggaaaactaaaattattactcaagggttgtttacagttctacatttcctcatccccaccctccttccaggaattcagattcctgctcagtggtgataagtttccagagggacaagctactttaacagtgaattgctagggactggaatgaaaacaggctccgaggacagtgttttcattttttagaaagctgtctggggaaacttgaactgatcagtggaggagcagaggagcacagacaccacaccgacaacaaagaaggcaaagcactgctaactgcgggagtgaggggctgctggaggccaggcaggaagcgcggagtggcagctgtgagtcggctctcgggaggtgactgggcaggggcactggctgctgcgggttccagagtgagcttgccaagtgcccggaaagtgagtggctgggtgtgctggatgaagggaagttttaggataagcagaagagagaaggtacttataaatttccaatgaacaccaaattaggacttgccattttgagactccaaaacccacaatctggataaaacatgaaaataaaataaaaagttggggatgttagtatattttattcagatatgcgggttttgtgaatggtaaaagaattcactgatcgattacctgtcttattgtaaactctagaaataaagaggatgataaaagtctgccatgaatcaaatggcagtggtgccaccaattgtaatcaaatccttattgacaatttgatgaaaagtaccagatgggctatgttgagacaaacagaattttcacggagtccaaatattttatgctctgaaatttacttgaacatttcattcagaaacttctcttccaatgtatgaggaaagggtgtggactgaaatgagtaatttcccaactaccctgaggcagaccagatataggtcaacctaagtcatggacaattttcatcatcctcttggggttctagaacagtgtggaaaccaggagaaggaggtacctgctatgtggactgctgacagagggtccaggctgtgagagactacacttgcctcgtggctgtttgcaatgaacagggggtaaagaaagaagaatgttcagtccaggcaaataaagacaagctactaatgaaaattaaactaaaagtgcagcaaaggaaaaataaatcaaatgaaatgatcagtacccatgaattaaggaaactggcttttcttttgttgaagaagtaaaataaatttatatctatgtgattagccactgataaaacattaagttgggattctggagtccatactatggtgggcataattctcatggcttttcatggtagaaacacatgtgtatatttacatacaataaatgtaaaatgcactatgccatatcacatatttcaaagacacttaatatattttttttcatcttttagaatagtaaaacagtgttaaaattcttggcccataagaaataacaatggcaatatgagattggtctttgtagtgatgaagcccaacttaaatattcaacttaaagaaaggttaaaatttgacttgaaaagccagtattccttcacattcttaaactaggatctataggaaactagtgaatgtagtaaaaaaaaaaaaaaaatcctaaaaaagataatacatttatcagcatagaacataaatgtttataacaaaaaagtcaaatgaaatcaaaacttctaaaaactaaggaaaaatggaatgaatataatcataaagctggacaaaaaatatataacaaaacaaaaaacaagcttctaattacacagagaaatcaaggcatagagggtagcaggggccgaatttgtcctttcatcctctttgtgttcagtgaggcagcccccgccaaggcctgtgggtgagttgttgccattttaggggtggcacaactgccgcaaaccttcaggaccaccacccagaagcggcttagcttgagagtcaacagaacctccacttgccttaacgagtcaatggctcacaggcgttcacggttctgtgcacctccagccgaggcgccccgcaagtggaggcctaccttttaagatagtcgtggcagccatggcttgaagaaaggagccaccaaagggacaaatgggcaccattctggaaattttcttatttgagcaagaaaaataaatgttctccctgcataccagccacacgttgagtcctgattcttttgaaaaccagaatcgctcttttccattcctgagcgcgtgctgggaggggatgtggcagggctgaggaagcgcgctaccctgtgtgacagccctcctctggaggggacgcctgcctgtgaaccctgtggtgggtgcaaatactgtcacttcccagtgttcactcccatgggccaactgaaaacgaccagtggaaagttaccgttttctgtctgtttggggtgctccttcctgatgtgggactcacagaccctgaggtgtccagttcatcagcagaagaccaggaagacaaatcctatgtgggagaaagattcttttaacaactccatgtcccagacccatgggggccctctgttgcaccacgttatctcccactccatctccatccacccccatgtctccaccataaaaatcaaaccattccttggggaaaatggaaccagacaggtacaagaatagggccaaattcttctagtgtgttgggatttcctagctgtccgtttggccgttctggaaaatatagctatgattttgttattgctatgtttcacttatagctttattatttcttggagacatggatatgaatgaattgatattggcttgggaggggaagacacctgctgtagagcctgctggtcactcaggctgaacagaagtcaatacattccagttggaaacaaaagatagtcatctaggagtctgcctttttgcattagaggactttactatttcagacactgctgctattcagagtagattgttcttttgcatgcttacagcagggcaaagcatgtgttcatggcaggatttcacagcagaatggttgaaatcttaccaggcatcaccacatctcacctgcaaatgcatttctcaaaaccaataataccacaatggagttgattgtagaaaaaaaaatataaaaaattaaatgagcagaggactgttttttaatttttttttttttttctgtatacataatggagaattcatgcctgagagtggttaaatacaaaactcagatacaacaattggtttgctctaccatggctgtgtaattaaagtgtgtaaattcttaaacagggtgaaataaaatgccacagcagttgtggtaatagcattagtagcaacaacaagagagcttttggatttaacagaatcaaaagcagtgtcctgttgtaaaagtttatgtggctgcttttttattttgagacaggacttgtaagagcagtggctgaaaggagacactccattctgacaagtactatatttaaagtctttctaaaatgcatgaagatgatgcttctttggtctccagtaagaaatgctacacgatgatgtctgtttattgcttacctgctgactacttgacacgtctaataacttctccagttccttgatatgacgactgacctccttcaagagaagtttgagccgatttccaataacatggactttttctttggcttctaaacagtctgttccttcagcattcaccagtagttggcaagacatgtcttgcaaagaggctactctgagttgggattccaacagctcatgctttatttgctatgcatacaaaaacaaattaatttttctaagcatttttgataattggcaaaagctccaaaagtgcagaatgcaatcaacttaacttggtgggaaattatacctgagcatcaaacgtggagctcacacactaaaggatgcagcagctcacggcctgagttctaatcctgcctctgccaaaaatattctataagacccctgaccgtctctgatctcagtttgatttgatgcctggtccacagtattattggaaggttcaaattagttaatgtatatatgacagtaattaaaatatagattagtatgcaagtgagatgtaagataatcttttaaacagaaaagcacaacattaaatatagcgaagcagaagtatgtctaggtatcctctgatatctagtcaagatttgaaaaaaaaaaggggtgattcgtcattcacagcttgatgccagaggtcaaagtgaagtaaaaatgcagttccacagctatttcctctaggtttctaagactattatggtactgaattaaaaggtaccaattctgtagtttaggtgagtgttaaatgttaagacataacattttaaaaatacagagagctacaaagtgcataatattttcttctaatggaactcaaatatgcttccttatcttctataaagtcacttaaatatactgtacattatattgtccaaagatccttgtataagagtctaccagttaatttcctcttgaatttagtgctagaaaaagtttctccttccttgagaagtggtatgttttgtttttgccagataatgaaagtaagtttactccttgtttcccattttgtcttggctttcagaaaacttgatgctcaggttcatgtttaatctgatgtatttaattcctctttgaaagactcggctgggtgtggtggctcatgcctgtaatcccagcactttgggaggctgaggcaggtggatcacctgcggccaggagttcgagaccagcctggccaacatggtgaaaccctgtctctactaaaaatacaaacattagtgaggcgtggtggcttacacctgtagtcccacctactcgggagggtgaggcaggagaattggcaggagaattgctcgaatcccggaggcggagattgcagtgagccgagatcgcaccactgcactccaccctgggcaacagagtgagactctgtctcaaaaaacaacgacaacaaaaacaaacaaaagacttaattgtctcattctattctaatattttaatgaccttttactacaagccaccaaatatacttttgggccatagatgtaacatgaagtttaaattaagctgccttaataaacaacacaagctaattaagattgcttgagaacactaagatttttacaactgagcaacaactttagaatcagattctaaagctagcagatatcatcttctatgcacatgtttgctttacaaagattggaaaccacagggagttaaaaaagtgtaaagtagagactataatgcaaaaagttaaaaaaaaagaaacaacacttaccacttatattcattttctgtaaatgaaatgcaaccctgctaaaaataactggaggctgccagagttcacacatcttaccataagctgtttgtgatggtcctgaagtatctctgcatcaaggttagaatcaatagggacaatttcatttttccttctgtcaatgttctccagcataagaagcaaaccatggctcatttcatggaaaccctacagaaaacagtttaaagtaactgtaaataaaatatttttatttctctcaaaacttaaatgtctttcaactgccaccattagcaaacatacttggttttaagaacatacatgcaactcctttctgaggaaggcactggtgctgttgtaatgacctgatcgtgagttcacgttcttaccaaaagcatctaatttattacttggaggacaatttagacgaaaggaaaactggcatcaacatacgttatttctgaaaaaagggtagtgctattatacagtttggaaggaagcaactctgctgccctctcttctctgtgtagtcaaatctttccatattttaaggcccacctaggctgaatctcatatccccttcattcattcatttattcactcattcattcatccatttatttattcaacatacagttactaaagatctcctacagataaggcactgtactaggagtgggtgcagaggtgaaacagcagtttaggtacccgctttcaaggaactattatattactcttggggcacatataaacctggagagcaggcttcaactccttccagggctttccatggcgctcagaatatgatccaatctcctggcctggacctacaaagccatctggttcctgaccacctcctcagtctttcttctcactccctggctcagctcaccgactacactctggtcacaatggcctgttttctgttcctaaagacactaagtcctttcctgcttctgggactttccatttattatattaccttcatagcaacatccttccaatgttagctcaaagagccaaataaattccctgactaccctctcaaagtggcttttctcagttacttttatcatccacgtctgcaagtatctggtttaactatttgcttgcattttattgatcttgtcttccccaacaaaagcagaggccatgctgtattcaatgttttagcaccacgtctgccatatggtggacgcccagcaagtaattacagtatgaatggaaaaacaaatatttgcaatgctcactttgatgttcaagaagggtctgcctacttgcccagtaaatatctgttgaataaataaaggaaataaatgaatgagtcatagaaggagcgttgcgacggagataaacatgaggaatagtctcttcttatctggacagaagataggacctagagattttgaacatgatcatgaacatgtagaaatgctccagtaaaatgaaaagtttgggcacaaggttatctcactgaaatactgactttggggagcaactgcgtccctctagaaaccatgatacatcaagtcacacactcagctaaattgctaatgtctctctctgagtcacctcctgcccaaagctctacagacctggcactgcatcagggcatcctgcagcaggccccgccactcctccagcagagagcacactcggtcccagcgcccattcatctgcgacaagcgatcctgcaggtcccggctctccttgctgtcagcctgggtgaactcagggctgcagagattgatggagaggatgatggctttgcggtggtccacagctttctggagctcctgaaaagaacaaaaaagacaatcaaacaaggacaataatgacaaagatattttcccttgaaaatgtttcacatgaatgaaaagatccattaatttaaactggccttaacaggatggctaggtaaaagacagagggtgcgtaccactgagaactgtatggcagttggaagaaatgaattagatgagtacttaacaacatggatgaatcttaagaaaacagggtgtagagtgaaaacgtcagaaacagaatgttacatggaacacaacagcctcaatacattcacacacacaaatccacatttttaaagaatatatctgaacaaagaaggtctgccacatatttcagaatagctaccattttgaaaatcaaatgggaacttagagttcagccagggtagggggtgcaggggggaggaataaagaggagtcttgtaggaggcaacaataacgctaggcaatgacctcattaaggagtatgattgagtccacactctgtacagaggttcaaccacaacaaaattcaaatttgtgggcctaaaaatgaagcaaagaaaacagatgccagggccctgggatccagatgtactgagtctgcaggctcagtggcccacaggctgagaatactgcctgtgccacactgatgtgaaggtagagagaatgaattgggtatttcatgagctaaccagttaggtttgatttcacaaaaaccaggtgactgatttttggctttgtgcatttccaaaacacccagtgctcaattccaagaacttgagcacaggagtctgtattagtaattgagtatctaggtactgtttaaaatcccccaatccagttagggtgagagatcctggaagtcacattgacctaggctgcattttgaaatcatttctcactagccctgcaatgttcccaatctgtcttgattttgcacttttcaataggttcttaacatactgtagaatagattcaaccacacagacaacatgggtttaagagacactgtggaaaatacttgattattccacagatttattcagagaaaatacagacaggaagcatcaggagaaagtacaaaggaggatgtcttttttcttgtcatgccggatgactttcaaggtcttatttccctaccctaatctctctgaggtctcagaccctggccagcatttgcttcatcaactttttaaggaatctggttataatgcaacatggccttactagagtaatttagggactctagataaaaatgcatttcataatgcagccattgtaaatctctctcacgtggtactttgtcctgaaattcatggggtagtgtagaggcctttctatagggatgcaccttttggatcacctggaggggagattcatttctcttgtttgaagttttctgtttgaaaatttaaaacagaccaggcgcaatggctcatgcttgtaatcccagcaatttgggaggccgaggcgggcggatcacttgaggtcaggaattcgagaccagcctggccaacatggcaaaaccctgtctctactaaaaatacaataaatagccgggcatggtggtgcatgcctgtagtcccagctactcaggaggccgaggcaggagaaacgcttgaacacaggagacggaggttacagtgagccaagatcgcaccactgcactctagcctgggtgatagagtgagactctgtctcaaaaataaataaataaataaataaataaataaataaataaataaataaaataaaacaaaatcacacaatcactaaaagcaagccaaaaaacatcaaccccaaataaaaagcatatactaaaaccacagaaacacaaaagcagcacacacttcattccttatcctgaccccggagagcctaggtggccacattttgaggaggagcacatcttaatactgtccaaacaggaaaaaacaagcactgatgggttttaaaaagaaactgagctctcagttcatgagatgctcacaatagtctccatatattaaagcattttagtgtctgggttaaggaggattttaagatctagagctggagttaaggtgtactatatccatgcgggccaagccaaaatcaaacgcaaatgccaggtgtttcaccacaattactctatagttttatttattacagcaaaaattgcttctaccactactgtaatcaatttcagaagtttcacttacttgaggtcaaataacttcattatgtcccccacaaattcatgcagatacaattttggagaggatttctctccagctctagatataggcctgtaggagccaggtcattctgtatttcccttacaaagagttcttgtaggtcccagaagtacctggatgcttcatgaaattttaattggacatttcttaaaatatcaattcattaaatcgtgtgtgcttatttacatggtgtatagttctacaatatggtccccttttctgcccttgaaaaccatctttgtggccgggcacggtggctcatgcctgtaatcccaacactttgggaggctgaggtgggtggatcacctggggttaggagttcgagaccagcctgggcaacacggcaaaaccccatctctactaaaaatacaaaaactagccaggcatggtggtgcgtgcctgtaatcccagctactagtggggctgaggcaggaggatggcttaaacctgggaggcagaggttgcactgagctgagatcatgccactgcactccagcctgggcaacggagtgagactccatcaaaaaaaaaaaaaagaaaggaaggaaggaagggagggaggggggagagaggaaggaaggaaggaaagaaggagaaagaaagaaaaaaaagaaggaaggaaggaatgagagagaaagaaagaaaaagaaagagaaaaagaaaagaaagaaaaagaaagaaagaaagaaagaaagaaagaaagaaaagaaaaaaaagaaaaccatctttgtggaatacaggaatttgggatggctggaggtgaggagagcattctcactcatttttgttagatcccttttctgctgctgtgtaagagcagctcgaactagaggtgccatctgcacggtcgttcacgcggtggctctctgtttgtccgccgtgggaaaggcaaggggcagctaccttgagctttttgatctggagctcgatggtctggatgtcagtgctgagttccagacgctggagctgttccaactcctcctccgtgtcccccagccaggcccagatgctgttcaagtctgagttaaactgctgccacttctggaggttctgcttcatcctcaactccttgctcaatgcctgggcctggagaagctcccatcggtcaatcacacctggcaagacatgcatagaacagtgaggttattttcctctacatgtgatgtttatgaaatgctttaaacataggttggcagccaattttaaatagcaacagaaagaaaagtaattccactgggcattttcgttgttgtcatctggaaataacagttacatgggtacaatggctgtgttttttctatttgtatttctaataataatgaagcaaaaaagttagttacatgggcattcacactgtaaagagctttacgaagtaataagcagtcatgagcacgaacgatcgttcaattcttggatcctgtctacaatagggctctgagcacacacatataaaatgcctgattagatatgtgagaaacagtgcattaaaataattggaacatgagagctggggtggtagtgcgcgcctgtaatcccagctactcgaggggaggcgggaggattacttgagcccaggagttggagtctagtttgggcaacacagcgagacttcatctcaatattaaaaataataataataaatgaaacatgggcaaacactaccatgatggcatgcatcatcccctcactgtcaaaggagactgttggccaggtgtggtggctcacgcctgtaatcccagcactttgggaggccgaggcgggtggatcacgaggtcaggagatggagaccatcctggctaacacggtgaaaccccacctctactaaaaatacaaaaaaatttagctgggcgtggtggcgggcgcctgtagtcccagctactcgggaggctgaggcgggagaatgccatgaacctgggaggcggaacttgcagtgagccgagatagcgccactgcactccagcctgggcgacagagcgccactccgcctcaaaaaacaaacaaacaacaaaaaaggagactgttataacttggaaggaagttctcaggatagaacggtgtagaagaaggccaagccccctaagtggaatttcgctgttaacaaagtgcttcaggatcttctatttcattcactcttgaactggatgctacgcactcaccagccgtttgggtttcggtactatgcaggttaacaaagccaggaaggctctcctcttcctccttcagtttgtgctccagtctcttcacggagtctatactgctactgcattcgcccagcagtttcatctgtttagacataaacaaccggcccctgtcacccaaatcttcatgagtgcaaaagcttccggggaaaatctctttgtaatttctcagcaagagaagtgtctgtgtttggctcctctgtgccaccctgctaaaaataagccaagatggccgagtgtggtgtctcaggcctgtgatcccagcactttgggaggccgaggaagatggattgtttgaactcaggagtttgagaccaggctggggaacatggcaaaactctgtctctacaaaatatacaagaaatttagctgggcatggtggcatgcatctgtagtctcagctacctgggaggctgaggtggatcacctgagctcagagggtggaggctacagtgaaccataattgtgttactgcactccagcctatgcgacagagtgagacccagtctcaaaaaaaagaaaaaagaaaaaataagcagaggtaggctgggcacggtggctcctgcctctaatcccagcactttgggggccgaggtgggaggatcagttgagcctaggagtttgagaccagcctgggcaacatagcaagaccctgtctctataaaatattttaaaaatgagccaggcgtggtggtgagcacctgtagtctcagctgttcagggcactaaggtgagaaggttgcttgagcccaggaattcagctgcatgcagcgagctaagaccatgacaccgcactcaagcctgggtgacagagtgtgagaccctgtctcttaaaaaaaaaaaattaaataagcaaagttcaaaaacatgccttttaaacaggtgatacattcacatatacaaaaaacaatgccttaaagatatactttgcatacatgattttgcacgagaagtccttcaagtttctttacgattcatgactcaaaacagattaaaccaatctgcaatttaaaactcggagccctcagctggcaatgcagtatataatttttggcaagctgctccctctttctctttcttaaattgaaatgtgggaacgttaatgttacgacaaatctcatgggaactttcttgcattaaataattaaaatacttaaaattatagagcaatattaaagccagctgttttataaaaaaaatgtaagcaatgtttaataggcatcaagggactaaattctaaagtcaaagaaaagcttccaaattcatttttaatatcacatacagtattcaaagattaaaagaacaaatcatttcaagatactcctgctgtgcttaccataaatcctttaacaaatcacaatgccagtaggactgttattctgattacttttgattgaggttaagtgtaatcccagtgatgtcagtatgattaccataaaactatatcataggtatttttaaaaagtggtttcactataatagaagttggtataataggccaaactgaacaggaaacaaactcataattgaccgctcttctgtaattataaggataataaaatcaacatatatagctagaacagttttctttcctaatttcaaagagtagaacatgtgagttgtgaccagacttggggaaattcatttttctttccttgtactaaccagtcttttggatatgaaagaagacgtgaggcagagaagagactggctttaaaattctcttccttaagtacgcgtaggaaagcaggtagttctctagggaaaattaactggtcagtaactcgagtagggcaaataaccctctgctagactttatcatacatagccaatagccgcatagatagaactggtagtatatccaatgccttgctatcttttccccaaatccctcttgctagaactgttttcttcagaatgagcacactaaaaaacagaagagaaaaacattcccaaggtcattcggtgaacccaggaaaagaactaccaaaaaaactgcatgttagtaatctattagctaaaatctgctgctccaaggataaccttggtccaaaaattattagttgaatttggaaaaatgcctaatgacttttgggagccaaagtattttgttgctctcaatgaaaaggatctccctaagtgctcagtgtaaaggaacaggtttgtcattacaacagttttgtgggcctaaaaacagacaagttctactcaaatggtaacttaataacagggcttggctttgcacatccaggttcacgagttcaagggcagcatggtattcagagaccacataaagccctgatgctgcagacgaactgttctttgacacagaactgtggtttcgcacaggtcggaatcaggatggccaggatacttacgtagcctttgtagctggtgtctagctccggccccgtgggagttttgctgcgaatgatattttcggtttgctgtatctgaaaacggctatcatccagggctttgcccagttgtcggatctgtgactctagggcactgtggtcccctgcggtggcaaccataagaatctttactggacaaactatttgacttatttaaagcttgatattcaaggagaagtttcagaaatgatttcagttacagcagcatagaaatggcaggtgtgggtaattacaaagcaaatttagtaccatcgtgccggtgggttagacattaaaatggccaaaccaatgaaggtgcttgactgagagccctagcagatcggacgtcgcaaaacggctctccagtccgttttgaacagcttcgtgcacctgaccctcttccagctgaacccctgatcatctgaatgttgtcagtgtggaaggcctttctaaaaatctgcaatggtgtctactgcatctcagtaaggagaaagctgttctttttctcatgttctttctgctatcgcttagtgagcaggggaagatcctccctctgatttttcttcatgcacctcaggggaagatagtgtcacggaaggctcaggttgctgcatcatttactgaaggcataaattcattaatcaagaaaagagtgcctcagaatagatatatacagagatatcaaactagcaacgacttgctttttatctaagatctgaaacaaaaccaggagaaagctaagattttaacatttccatctaggcaggttcttactcatagcctagaattctggctcattctcctctcaaagttgtaacatttctttgtaaaattactgagagtgtgtgtgtgtgtgtgtgtgtgtgtcaaagtcttcgaactacacaggaacatttgatcatcagtgaagctagcatggggtgaaagcagaacaaatattagtaagctttattaaatgtttttatttgtttctaaaaaaggccttctagatacacctaggagaggtccctccctgggaatcaccctctcagtaatgttactttgctttctgtccttttgattttcttcaaaaactgaagcgtaaactagtaactccgtgattcaatatcatatcactgcgttcaaactctattccccgccgacatcccacatcactgatcctgaactcctgcactacagtttgtctaacacaacactaagcaaaactagttccatttttctttctttaattcttcttgtttcaggaatagttctgttcttatctatggctcagcataccgtgaaatacatttttcatttcaaattatcttttacgacctcttaaattaaaattacatatattttttagagctgaaatctgatctcaccccttgtctcatacgggattcttgagatgaggaggataaagtggtggatgggccaaaggtcactcatgcaggctggcggacttgggaccagagcctgcaccctgagtctccagccacaggtaggtctgcatgcagtgaagctgaaattaccacaccacgtagaacactagggcgcagaggctgatgactgggttttccttctcatattttctgcagttaatggacatgagaggtctatacctaatgagaccaatcaccatttaacaagttgagaagttactttatttcgctcaattagtgaaatcttattcttggtgtggatttaaccagctgttttttctagtacagcagtaagagaggaaggctgtgccttaacatgctagagccacaaagctgggagagagacagcagatgtgctaagagaggaggattgctatacaggggagggagggaggctggctccggcttgttgtgcctaccggaggtatttttgattgcattttctgtgagttttacataggcctcagggctttcggggatcattacatctgcaaaaaaagcacagtctaagttgacagctaagttctggaaaccctgaatcccttgtgcaggaaaataactttcctaggggaaaaaaaggaagtcagttattctagacacatagctcctgagcgcacagaggagcgtgcaggctcaccaaagctttcctgaaatgaatcataagaattcacagtgggtggggcatggtggctcacgcctgtaatcccagcactttgggaggccaaggcgggtggatcacctgaggtcaggaattcgagaccagcctggccgacatggtggaaccccatctctactaaaaatacaaaaattagccaggtgtggtgacaggtacctgtaatcccagctacatgggagtctgaggcaggaggatcgcttgaacccgggaggtggaggttgcagtgagccgagattgtgccactgcactccagcctgggcaacagaactagacttcgtctcaaaaaaaaaaaaaaaaaaaaaaaaaagaactcacagtgactgagagtgtttttatgagccaggctctggtctgagcacaaatttatcacatagaaaccctatagggtacctgggaatgttattcccattttatagatgagaaaactgaggcacagaggaattaggttccttatctaagtttaaacagaaagtacatggcagaactgagatttcagcccagactccagagcagcgctgtcccatatatttctatgtgaactatatatgtaatcttaaaggtttcatagccacattagaaatgtaaaaagaaacttataaaattaattttaacactacattagacagggattataacatgtaatcaatataattattaatattttattttctttcttgtactaagtctttgaaattcatgtaagcatgttttccacgcacaacccatctcaatttgcacagtcccatctcagagctcaacagtcccaactggccagtggctggttttggacagctctgcttcagatgccatatgcctgactaataggccttactgtaaagacaaaatagaaatgagagaaatcattttctttttagaacagtgtcatcccttgggaatctgatgtgaaccaccagaaccaaacagaaattccccagatgtcctttgacagaatgtatgagatacatttccaagtgccacaaatcagcctccaactctttattctatttttattcaccttccttacagagtttctgtttctctgtccatcccttcactgcatgtgtggcttgggtggtggtccttcttgttttccttcacacactcttcctgtgggagctcctccgttcactccaggaccattgccatttacatgtgaatacctacccaatctgcatttctggcttctgcacttcacaccgtgcatctacgactggacttttgcatttggatattctgcaggtatctcaagatcaggatgcacacaagcaaactcatcccctccctgctctcacagccccacctcccttgcccacctgcacccacagtgctccttccctcttgtggtcctcagggcctaggaccacctgcatctttcaccaagatgcccagcccagaaaatcgcctccatcccagttcaatggactgagagttctggaggagtcttctctgtgtgatttctcacatcattcccattctccccattcccaattctgcttcccctagttcaggccaccaccctacttctgtctgaggttgtaaaaggtttcatttggactctctccgctgaatatgcccttctccctgtggtatccagaaagatacaatatgaaaatctgcacatccctgaggagggaggatcccagcacctccctccgcagatcctgctgtggctccacgaccttcaggataggagccacagctcttttccatggtgaacaggctgcttcacagccaggctcttctccactttgtccattccatgcctgtcattccagacaaactgccaatgatcaaaagcaccaggccaatcacaaagcagggaggcttcccctcctttcttcctctaagcacttccgagcccacctgaccaactgcgattcaccctctggactctgctccatggtttctttcccgaagtctctcccaggactccggctttgtcgcccctgcttgtgtgtcctgccaccacactgccatctgagccccaaacacttcatacagtggtttctcactgtgtcccacactagagtggaagctctgggagaagaagaggaactgtgtatccctagaacctggcaaagcgcttgtcacctactaccacaaatctacgtggaataaatcaacggccacaccaaattttgcattttataatcacattcatatctaagtgttcacttaggtacaatttccccgcatgaaagaaggaagcaaatgattctggatagctgtcatgtttccagggcaatattaattccctctgactttcctttaagctggcaaactggagaggctctttcctacctgataagccaacagctccccggaggtagaaatctttgtcatcctgaccttcttcatcctcagagggcagagctctggacattgcagactccaggtcccgactgaggtcatagtcgtgatcccactccagggggatggagtccacactagccggggtgtctcgtcctgaccgctcgctccggaggggctgagcgagcgagagggagagattggaggaaggctgtggagaaagcaggctgtctgcagagcggtcgtgccagtgcaggtccgacagagctgcagagtcttccagctccagctccctgtctgagaggtcgtgctcatcgtctgggagctagaagggaagtcaaggcaaccctgtcactgtagtggtcagactagcttcttatctgggccacctgcctaccatgtggggacaatttttaacttcttatgagcaaataaataagaatcttctgatcacagaaatacaggggacagtgctgctctagagtttgactgtctgggttgaaatctcagttacgctgtgtgcttcctgtttaagcttggataaggaacttaattcctctgggcctcagttttctcatctataaaatgggaataacagtcccaggcatcccacagggttttttttttttgagtgggaaaaaattaaaaagtcttataaattatcctacataagcctcagtttcattgttggtaaaatgggaataacattaaaacatacttcaaataattaatataagattaaataaatattataaagaaaggcaatctactaccatgcccaccacacaacacctacacactggcaaggatcggaaataagagcaaattactaagaccttagcttgtccttatagcccagatataaaataggtttgatcgtagaagattccaaatactctaataacatctctataagtaagatgtgattatggtagcaattaggaaaatggaagaatgaaaattcacctaaacctaacctcatcaattaagaagctgttcactttgcttccttttattgtatttcttctagaggcttctcttatttcttctagaggcttctctagagcagtgctgccccatgtttctgcgatcaaaagattcttatttatcttccatagaagatatgagccaaatgttcttctaaactctttgtatacattaactcatctaatgctcaaaacaatcctttgtacagggtagttactgctactaaaccactttcacttttgaggaagctgaggcaagaagggtgaagtgagtagcttgccgaaggtgacagcgacaatgtaggacaaagctaggacttgaactcaggtgctccagctccagagtctgagctctcacccactatcaatacaacccaatcccacacgacttattctctttagatttaatgacaactaagaaaatcaatgttacatacaggcaggcggatcagtttcttatggtatctttccacacgcccgaagacctcctggcagtaccgtcggagctcatctagttcctcctcgatgatcgctgcatccaagggctcactcttttctatcagctgttctccttgggcaattatctgctcaatcttattgtggttcagtgaaatttcctgctggaaggcctagggagtacaaatctcatgtgattttgctattgttgttgcttacattgatataaaagaatcataatagatgtatttctcattacattaaaaaagacatgtaggggctatttaattgaccatatacaatcacaagacaagagtctattaccttctaaagtaaaacatatgcattttcagccagaacaggagtcataaatagaaacattcgaattccatgatcagaaaagcgcttttggctaataaaatttaccatcacaggtagtgtgggtagagaataacaggggaaaatattcaaacccaccgtaagttgacagcactggttatccctaatgaaagcaatggcagtcaatatactgtcactgaaataaatgtagcattttaaagaaatatcccgatcattttaatttcagatatcctcatcctatgtcaaacatgactaagagaagccatccaatgccacgccttcttctcaggtgattcttttattatttcagaacataggcaggtaaagttatgatttgaaaaacaaggaattccaggaggattatttagactcattctatgtgttgcaaaagatttaaatcactgggtatgtttcagtgttcacttttaattcaatacaataataaattgtggaagagctgaattgtccaatggtgaaaaagactcccaggagagaagagagggtagtaataatttccatcatcctgccagggtcccaagggacaagattcaattacacttggcagaaactttctgtggaaggatgtaaatgttgattcgcctgtgagatgacaggagagaggaatcaggggagagggtgaggcagaatagcagggtttactgtttcttccatcctgagaatccatgtctacgggcaagttccttgttttatcataacaacccaaaggttatgggcgtcatgaccattctttaaaaaaatccatctatcttgggaggaaaatttcataagcttccttggaaaacactcaatttgttaaatactcccacttttaggaaatccttacatctaatgtatatccctcctattcgaatttctagctagccactgtgtttgaattatatagtgaaaaatacaaaatgtgtttaaaattaacttggcatctaagaatgcagactatgaggaatgaaatcccgacataggaaagttgtattgctttgcaacatggaggttaaaggaaccatgtgaaggtgctacaaacacattagaaaaaataaacgaaaacaacaacaacaaggccaggaagggtggctcacacctgtaatcccagcactttgggaggccaaagcagctggatcacttgaggttaggagttcgagaccagcctggccagcatagtgaaaccccatctttactaaaaaaatacaaaaatacaaaaatttgccggacttggtggtatgtgcctgtaatctcagctccttggcaggctgaggcaggagaattgcttgaaccagggaagtggaggttgcagtgagccaagattgcgccactgcacttcagcctgggcgacagagtgagactctctctaaaaaaaaaaaaaacaaaacaacaacagcagaacatccctaacaccctggcaatcaagctgattgaaaatcaatcaagctgttgaaaaatatcaacaacaatatcgatatcaaataagataagagcactacccagatataagcaatagtggttatttctgggtagtgctctttatctgattttttatatattttacattttctgaatttttttgcagtccagaactaatttttcaaaagaaaagttatttgctatgttcttcacaaaagagccacaaatcctttcattttcaggctttcttcactttggtaacttgaaaaataatctattaccttgagttgctttattttagcttgaacatcacactcagaaaaatgttcaatattagtgagctgcagatccatctctgtgagccagaccagaatgctgtcccgcgcagtctcaaactcctcacgctggccaataaaatgctggaaggcaagaggaaagtagtaacaattatttttattaaaagtccttctaaacatatggagatggcacagcgaattccagtgttctgtaaagtcattttctcagcaagcaatgagaagcctgcaatcctttgctatatcactccccggtttactcctcctgccatcccattcttacaaaatcactgagactgtgtctcaagactgcattcaaatggcccagtcccatcctctggcctctaaattacagatgaggcatagcaaaaaccttgagtctgcgcaagatggaggtgacacgcttttgcaggttgtcccatctctggttgccttcgtgaaccatctgtttgaggctacatgctgaatcagtgcggttctccctggccaggcggcggtactgcttgttgatcagttccagctgcgtcaggcactcgtggacctgtcgctggaaagcctaaggccacagagaagcatatcagtgtgagaaatcagcgaaggactctcagtagtggctcctggttttcttattgtagcgtctgggagaatgggaagttacactatcacagagggaaagaatgatgtctaataacggtacacttccccttgttaatgcaaagtcatctagtcagcgtaacttaaaggaaagggagaatctatcaaaaaatatgaaaatggggagtagtaatgaataaacacacacgcatccaacacacatatatagacacacacacatacatacacacacatatacacgtagctttaaaaataattaatgtcctggaaacaaatattcccacaaagcaaaccactataaaaaatatacacgtgtgtgtggaaatgtgagtttgaaatgttgacaacttctgctgtcaatatggagaaaaagatatctataatggaactgtttatttgtaaaatatgtacttttctaaaaatctagaaattacctcaattctgctgtccattaggaaaaaacttaaaactaccttttgcaaaaggtcttccaaaaaatcaagctattataagcttttaagaaaagtaatttagtaaaatacaagtaactttatattttaaaaaatttggaacatgctctgtttcttttttgttgttcctgtgatttaattagtttttataaaacatgttagagctagtgtaccacccacacagtagcatcaatttacttttgaggctatcccagggtcagtttagagattctgaaggtaaaatattcttttctgccttttccctccaatgtagaagagccctatagcataagagtcatttggccaaaataaaatgaagctttaaaaaaaatcatttgtatgatttatgactgatttttatcttggcattagaccaaaatgaaaactataattaataaattgaaccgcactcatcaaatccccaaattctgttttccttggctcatcacactgtttacatgtgaccacatttctgtctcttaaattgctttccttgtgagagctgctttcagagccttcatcctaggaaatcctagcttccagtctaaaaaccttaagttatttctccagcaaagggagtggtaaggaaagttcagctctggccatgactggaagtcccagtacatgtttgcccactggggtaaggttggagtacccccaggcagataccccagcacacccatgtccatcccaaacgttcatgcgattggaccagctaaagactgcccccaagcacaacttcgtttctgcaattcatttctgtctcttaagaaaattaactacaaaattcatgataaataataaaatcaatcattatagaagctaactataaggctaacttttgctttaaaatctgagagtctaaaatagcatcaaaaagaatcttatataatctgctttgcagtataagccaattataaaaggttttaacctttatgaagggagtgtgtaagatgcagttgagcagctctccactagcattcattcacatcgagatgacctggaatctactgcagagtttactgtgctttttactagtagttttctaagggagtatcttttatataggaataaaagtgttgtttattttaatttagtggtatagttacatatgaattcattcaccattcagacatcagagtaattcatccatttcaaagtatttgaacatttttctagattcatatagctgtccatgtacaaccctgagattttaaactccataagaataaaaaagcgaacttcttatttcccatcataggcctcagaaaatgcctggttacctgatgttgcaaggtaaaaatgaatgcagctacatttcattacattttcagtcttatttctaaacatctcgaggaacttgggggcataattagcaatggtcagaatgcttctgaactctttgctgttaacatacctgagtacacaactgcctattagtgggaactgaagggaaaaacaccttcaaatttaaaaatggtcaattttgggctaggtcaggtcttccatgaaaatgaaaggcagctgagaagtcagagcttcattgtacaacagtgatagagtggactcgagattgtgcaagcaggcaaggtattggaatcaattcttggataacttctttctttatgaatatgattacactacagctattttcatctcagtgtaattgaaaagttttggtgactcaagaccagtactactcttcactgtgtaattagaaatgaattataatgaaaatgttttattccattctagagtcaactcttttatcaaatacacacacacacacacacacacacacacacacacacacactgcgattaggtaaagaaaatacaaaaatgtatgtggaaggtagatttttatggtttaaaaaaatcatattttaatcttagaaaagatggttgactgtggaataattctgaaataaaaatcatgccaagatcttttgggaggaatcacgattcttcttttctaatagaatctctcttcattactacagtatttatgcttcttgataatcttaaaataaaaacctctttttcccccttcatacgtatgactacgtatgaggtcataataaagatggctgcaaagtcctcacgcagcaatttgagcagataacatgtggtgaacagctagtttaggtcttggaactccaactaccagctggctactttaatagcaaaataaggattaaaaatttggaattatagattacctcaaatttctttagttcttccttggcaactgtatagatcaccccagaagagctgggaaaagcagctgtcctttctgaagacttcagccaatcttcaaaacgtgaatagtcatccagaaatttctgccacaatcgccacgtctcttcgattctggggcggaaaatgaaagaacagattcagattattggagactgttttcgctccagaacccggtctgctgcctgcgactggattaagggtgcccacagaggcaactgttgtgccaaacgataaccattcctcgagccaaatttgaccagagagcaagagagacaactgcttgagctaaaataaaacggctgttttatttttttaaaaacacgtcctgcaactctggattttgaattagtcaaattgaaaattacaagcacatcacacgagctgccttgaatgtgtgcaccaagtttagaaaagcaacaccaggtttacagtgtgcactcaggccagtgtcttacggaaataaagacgaggtcggaaaatccatttaagtccaacattcaactcacactgacaaaagttaatctatgacagcaggacaaatattaagctttcaacagtttaccagagagcacagccatgatgatcactttgtaacacagcacgattttctgccaccttgaatttcaaagggcttaaagataaatctgcttttattatttaatttttaataaaagaatgttactgttctcacagccacacattctgtaatgttatgcttgtttgacaagggtgtatttttatgtttccgtattatatttcaactgttaggtcagacataacttggcttgttatatttatatattacctttatacctacttattttcccaactaaatgtagacaatagtaagtttgggaagccacagctatttttggacattgtaacgaacaggaaagagtgaacagtggatactctgggtgatttttattttctttttggtctttcctcttccctatctgtttcagcatcccagctcacttcagcctcctttccatggacatagcacaaatgtttctccaccgccggtccaggtttctcgtagcctgctgtatagagtcacactcggcatcagtggcacaggcgtcacagtcgtgcagcaggacttcacacaggttgaggacagatgcaacacctgtactgtgcttctctatgtctctctgaagctcctgcaggggaacgtaacaggctttattcaacaattacatgtatacagatgagagaaactgaagcaacctatgttggtaaatggctaggctacaccttgacaaatatttaatttccttgaatgtatgacatttattgagcctcatttatgaaatccagcaagctcaaaagtactagaaaatggatgtagaaatattttggctatgcgagcaatgccaaaatataaactgaacaaatgaaatggtctacactaagagtaaaactaacttctttaatcaataaaaaatgaatcttgccccagactctacttcacgaatacatcactttcattccaatcaatcaatcatcatctcttagtatctgtcaggggattggttccagaccttccctcggacaccaaaacccatggatgcttaagtccttgatattgaatgctgtagtatttgcatacctcctacacacatccttccatacactttaaatcatcttgagattacttataatacctaatacaatgtaaatgctatagaaattgttcttatactgtattgtttagggaatcatgacaagaataaaaagtctgtatgtattcaatacagatgcaaattgttttccaaatacttttgatctacggttggtggaatccaccagtgtagaaccgtagataccaagggcctgtatatatgcatgtgctagacctggcactcaagaactgggctttaagatccaaagatttacttttttttttttgggatggagtctcactctgtcacccaggctggagagcaatggcacaatatcagctcatggaaacttctgcctcccgagttcaagtgattttcctgcctcagcctcccaagtagctgggattacaggtacccgccatcatgcctggctggtttttgtatttttgtagagacagggttttaccatgttggccaggctggtcttgaactcctgacctcaggtgatccacccacctaggccttccaaagtgctgggattacaagtgtgagccaccacgcccagctgatttgcattcttttttaaacagttaattccaccatcattaaaaggtaacatggttatcaatggacgaacaaataaagaaaaagtggcatatatatacacaatggaatattattcggtcataaaaaaatgaaattatgttgtttgcagcaacatggatggaaccggaggtcactatgttaagtgaaataagccaggtacaaaaacacaaatatcacacattctcacttgtatgtgggagctaaaaaagttgatctcatggaggtagagagtagaacgccagatagcagaggctgggaagagtgtttgggggcaatgaagtgaggtgtcaatagacacaaacatacagttagagggaataagtcttaatgttcgatagagtagaatgactatagttaacaacaatgtactgcatatttcaaaatagctagaagagagaaattgaaacattcccaacacatagaaataataaataccagaggtgacggacaccccaaataccctgacttgatcattacacagtttatgcatgtaacaaaatatcatatgtgccccacaaagatgtagaaagactatttaagggacctaggttctatatcatgcatgacatcagcagtttcctcagagaacaaattctttttttttttttttttagatggagtctcactctgtcgcccaggctggagtgcagtggcatgatctcagatcactgcaacctcctgcctgattctcctcctcattctcctgcctcagcctcctgagtagctgggattacaggcgcccaccaccatgcctggctaatttttgtgtttttagtagagacggggtttccccatgttggacaggctggtctggaactcctgaccaggtgatccgcccacctcggcctcccaaagtgctggaattacaggtgtgagccactgcgcctggcatagagcaacttttaatgtagggcagaagtaaaatgttttatgataaaaacaaagcattggatttccctggagtcccacaatgtgaaatcttcattttaactgtataaaatgtaaattcaaattgtatgttgttttctctattgaacttttaactccatttactccaagtaagtattccattattaaaagtaagctctaccagtatcattttttgtttactatattcatcaatgtccttaatgtgttttccttttcttttatcaggaagttcttgaatttgcttattttttctcttgctctaaaaattcctcaatttacgcagatacccgggatttatattcttgtgttgctcttcctcttatttttttccttgatgccatgttccaacatctatgcaaacactagctattgtcaaatgtcatagtgcctttaattaattttggagattttataaactagacactagacgataaattttactaaaatatttatatttgtataaacagtcctttcaaatctctgacataacctccttcacttacatgaaacaatatgtcacaggaattgctgttctaaaaaatataaaatgaagtaatataaaaattaaacttagtatttgcttaaagataaatataaagacaaataattctgtaaatgagattaccaagtacatttgaggtcttaaactacattttgtgcaagcatatacatttggaagaagtgttaggcccctggacataaaccatgcatttaagaaagttagcatttttatttcattttccctaaatactcaaaagtttttgttaaaatcaatatatgaaatagcaaccctaagatttgaggggatttataatcatacataagtgccctaagacaaagttttaggctcagcttcaactttttttcttttttttgagacggagtctcgctctgtctgcagactggagtgcagtggcacaatctcggctcactgcaacctccgcctcccaggttcaagcgattctcctgcctcagcctcctgagtagctgggactacaggcgcgcaccaccatgcccagctaattttcgtatttttagtagggacagaatcattcttaaaaattttccacaagggaaactgtggtaactgtgacatgattaaaataaaatgtatcaagccctgactttgtgttaggtaggcactgtgctcagtgcttcttcttagtaatttgtataatcacactgtgtggtgtggactctgatgattggcgttctataaatcagggctctaagggttcaaatagttatggctttgtcccagatcacatgggaatgtagtgaggccaagatctgaacccagaaagtttacttttaaccactggtgtacaggactttttaaagtcttaatttaaaatttaattaaaaagctatatgtgcatatttaatgtagtaaaaagtaaaaaacgactagcaggttctgaagaaagcagcatgttttccaccccggagttcacctgttcaggagcaaccatttccatctcttgcagctctttcttctggtattacttctaccctttttaattttttgagacagggtcttgctctgtcacccaggctggagtgcaggggtgtgattatggctcactgcagcctcaaattcctggcctcaagtgatccttctgccttggcctctcgaagtattaggattacaggggtgagccgccacattcaacctatttctatatttctcagtaatatataacttctctatttctaagtaacatagctactgcttgatttgtccatactttatgaattcttgtatagtagagaagaaataaacttctacatggctgactgaactctaatgactgttacagtacaacttagagctagggtaataatcactgttctcatgattatggttatttaatatttttcacatttgaggaacaaaatatactatggttatgtttcttttctttttttttagacagagtctcagtctgtcgccaagctagagtacagtggcgcgatctccgctcactgcaacctccgactccctggttcaagcgattctcctgcctcagcctcccgagtagctgggattacaggcaagcaccaccatgcccagctaaatttttgtatttttagtagagacggggtttcaccatgttggccaggatggtctcgatctcctgataactcattttcctggattttacaatcctctctctctctctaatttataatgcttgcttctattatctctcttattgaactaataaaactccttccggagtggttaagcccatcagataatctagcccctcctggctcctcctggaaacatccctcctagagcacccagagcccctgctcccatctggacaggtgctggcttggctgcagtacagctgtcatcagggactttcctgcaccttcactctgggaattccctttttctttctcctgagttgaatagcatttcccctcttgctttagtgcgtgtagcatatgcagcatatatagcatagtagtacgtagcctgtgtagcaagtatgaagtgtattttcctctcactttcatgtatgcagcatacctttcattagcttcctgaaaatgggtacataggaggtaaaatttgtagatattaagtggcagggtataaaattctaaattataaagaatttttctccgctttctgaagttagagccattgtcttccagctcccagtattgttttggagaagccagagtttatttcatcctggaaacctttaggatctccttatcccttgtgttttgcagttttacagtgtggctttgctttgttttacattttcctgggcactcatacagcccttatcatctgcaaatgcatgtttttcattttagatatatatatgaatatatatacacacacatatgtgtaatgtgtgtacacatatacgtgtaatcttccacaaagtaaacaaaaagataaatatatgaaaaataggagagaaatatagacataaacataataaaattaacaataatgcgagagtttcaaaatccaattcagttattttataaaagtccccccaaaaaagaataaagaaaatggagaggagaaaattaacatcgtagtaatgtaacaaaaatataaatatatatttaataataaatatataaaatatatttttacattactacattatttatttcataataaacatatattatttaataataaatatatatattacattactactatggtaattttctcctctctattttctttatttttttttagcaggggacttttacaaaataactgaattggattttgaaactctggcattattgttaattttattatgtttatgtctatatttctctcctatttttcatatatttatctttttgttttactctgtggaagatagtctccattctgaatgctttttttaaagaaaaatggcatcctatcattttatgaatgcaaaacctctcatttctgtgagtttgtttgttttgttttgtttacattttctttctctacaatgtgtttcctctgattgttcctttctttatttccctctatttatttttttttcttaatggtagaagctttcttaagtggtgaggattcttgcctacccacacatattcaagaatgagtcagctatagaagctgtgtatgcacctaaagtatgtcaactgggaggcttccctgtggagagttaggcaggggtctggccttttctgggttaccttaagtatcactaattgaaggtactttttgcttgtctgatcagttctccagaaaggatgctccaatctcctggctagggtgtaagcctgggtactgacatagtgggagccaagctggggaagcgggctgggagccctagcatttggtattgagccagtcacatcatctccccatttttaacatagtgactctagcctccacggtgtcctgatccccaaacccagagtccctctggtttgctttctccagagagtaatcatctgatcttctacctgagtaaaggaagcagagttccctggctggctgggcttaggaggaatctgccagtctcagcacaccttattcagattttcaagtaatcttccattttacagctcaataggcaactcaactttcagcttcacctgatctccactttctgagccttcttcgaactctgtggcatgaatcaactttctccaccctccattctgttaacaacatcactgatctatccactttctatcttgcaaaattatgttggatgtctgtcatctctaccattttctctcctgttctctttgccattgtggttttaacctttttccctctctaccatcattttattggggttttagtagtaggtggggctataaatacatatgatcaatttgccatatttaactagatattttgttgattttcatacacttgtgaaattacgatacccgccatttgcatttcaactcatcactatagacatcattaccatgttctctggaagaatctgggaagccggatgccaaccaggatccctacaattcaatcatcagaatctcaaacatcaccacccatcagaaaactttaatttcataaaaattgaaaaacgtcttgctaacagtttttttaaagcaatggaatatagtgtatgtttcaagatagctagaagagaagattttgagtattgtaagaaatgataaatgtttaaagtgatagatatggtaatcaaattacctcagtttgtttgattattacactatgaaaatatgcattgaagcaccacgttgtaccccacacatatgtacaattactatatattcattagaaagaaaaaaattttaatgataattttaatattaaaaaaacctcaacacccaaaactgtattttgacacctatttcattggcttaaatagtctgtaaaatgaagtaagtacataaactataagattttaaaaataggaggtatttacattttatagcattttaaaattaagcaactttgctgcaatggcctaaatgtaatggagagaaccagagtgtggatagaatattcaaagcaacctaaatgcatggagtaacaatacctctagcgggggatttacagtgtttgctattggcaactggagtccgatatacttagcaaggataaatgagggggcctggcacagtggctcacgcctgtaatcccagcactttgtgaggccgagggtgggcagatcacttgaggtcaggagtttgagaccagcttggccatcatggcgaaactccgtctctattaacaatacaaaaattagccaggcatggtggtgcatgcctgtaatctcagctacttgggaggctgaggcaggagaatcgcttaaacctgggaagtggaggttgcagtgagctgagatcgcactactacactccagcctgggcaacagagtgagactctgtctcaggaaaaaaaaaaaaaaaaagaaagaataaatgagggagggaatgggaggtgaaaatttcttctgtatacattttccaggatcatccctttttgctttgttgggttgtacgccgccagtgagatattctgtctttgctacacacatgaaagtggaattactgtgtgcgatctgcaggtcatgcaatcctttttgcaaaacaaaattttttcaacttgaaaaattctaagtatgccttgtaatctttccccaaacactatacacaggaaaaaaagtcgggggcaggggggctcctttcagtcctgtctaagtgtatggtagtgggctagggctagtgactctcaaataaataaaccaatctgttagcactgttttagatacgtaattgcaactccaccttacctaccatcttagaaggcttcttggtggatggatgacactaactgtacaatggcacaaccatctttgtaaggctgaactctgcagtgacatggaacctgttggcctcaatcgcctgcctaggcaaagcccccttcctcaccagtcctgcctagctccctgctgaccttccatctccaggcaccatctcatgcccaccccatcatcctggccaggaggacagatattccatggcttattaattccatttccattttaagtcttacctgctgctcattaagctttctctgtatttcttccgagttacaggaatcgtagactattggcttggccagctctgactcgatgtgagcgagccaggtcctcaggctgctcatgttcttatcaagctgctgcacggctaccagggtctccttcagcttcttcaccctgtgggcagagaagggggaatgtcccacttcagcgagaggcccactcatgtttctctagcgtgcagaggagaacactgggctttaacaatctttttaggcagagttagaaactcatgtggaagaagccaaagacagaagacaaaggaggatagaaattagagatgaatacagacaaaggagcaaggatgcagaggaggcaggggtccagggcacaggagcagagatagataaattagttttgaacacagttttcccagtgtgagcaaggtgtgatcagaagtttgggaagaaccacaggtagtatttctcaactccattactacctacttacagcaaaaatcaattattgactccctgttaagagcctgacatggctgagtgtacacagattgctctaaagagaaaggtcatggtgataataagcatatgatcaatgatctattagtgcccttatttaaaaattgctgctacctttagactatgagtctcgccttttggttcaggaaatatggccacctaattggcactgctcataacagaggtaaacagcagatgagcaaaatacttcaagctgctagggtgtcatcttggctcaactgaagaggtatctatcttcttgaaaatatgtcaagagcaacatgacttgtaagactctaggtttgtgatacatttaaaggcagggatctgcaatagaatgttctcaaagattgacaacttatacacttagagtcatcagatattcgcgccccctcccccacccccacattacttccaggcatttaaagaagtgattctcaagctgggattgtcacacagtcagtggagggtgctttcaaaccacaggtgccaactaccagccaccaccgccaggtggttctgatacgtttctctgatcaagacacactgttccgaagaaaatgtctcataatcaaagtattttgaacatttgatttatttttagttgcttaaaattgttatcatcacttctgttccagtttcaataaatcaatgtgtctctctcaagtgaaaatgtagtcatttgacaacatgatcgcttttcctttttgtcatttttcctcaaagcactgtcatataaatgctcttaaaggattttcactatggtcagctgttaataatatctatattttaataattgtaattaataattcttctatttgaataacattttcagtttgtaaaaaccctcaggaacattaccttttattgttttaaaaaatgtgtatttaaaaaattatgttcatatttcacaatatattcttttggtagaaaatgaaaatatgttacaatgtttattgtgacttacaattccactcgagataagatttccccaattagctttataaatacaaattgtaccctgtcccccagacacttcaaggcattggccttgaacactatttccaagaacttttacatacaactcactcacatttctctcatggctaagacaaaattcatctgggcatcagtcagtgaatgacagttttattatggctactgggtacaaagctcatggagtgcatttgatcgaccacagcatggacatggaattttacatggctctggccatagtgccccagactgaaagaagagtttaccatcaataaacccactggaagaggcctgaagaatggcacacagcacagagaggtccgtcctgcttttacatctgtaggaatgtcttctcagcagcctctcctgcatgacttcagatttcgtaggatctgaacacttactaggcttggggatggtaatgtcatcagggttttactagaggttggagtgcttgttttctcccttccttattttagttccctggtattattcatgcattaattggtctcctccatggtaacttccttggaaagctggaaatgtgaatttctatatttggctatttccctaccccggccatgctaaactcagtgctttgcactaaactgggtactgtttaagtggttgctaaacattaataatgaatattctaagcgaattgtgtttatttaattaacatgttttcattttaaaatttttatttgatattaagtgtgtattaagttttacttctagattcaacatttgccagtgctctatttgtcaagtactaaaattcattcgtttttttggttcaaaactcacaaatatgatcaaaagatccaaagcacaaaaggatgcaagtaaacactgttccataggaccgtctacattagaaaaataaattacaggatagcttttgtaatatcgaatgagttccaagtcagagtggttagtatgcaatatgtcaagggcatcatgacatggaaatgtgtgttcatatagtccattagggacaagttcctctttcaagcaaatgtgtaaatttagtaaagtcgacgggggtgaacatttaagcagttctttttcatttttttaaaaattgtgtttttactacaaatagcaaaatacagtgtgcatgtgtgctgggggagcagaggtgagcctgtagggcatgggtagtaggattaataagccttggcttattaaacttgacatttatttgcaggacagggatcattcttttttttaggagaaatgtcccatgtttctttccattatttctttaaagataatttttgggtgaagcgtcacagtatttttatttatctatcatcgtgagaagtctgagcaacattacttttggtaagcatccaggattatcattcaaattagatacttgcagacgtcacatgtctgggtaagtttagcagcttgataaatctgtaagtccctgcagcttatggttctttcacagtccagtgtgtatcacaggcacttgacctttcttgaaaaggattctactatgaaatccaaatgtccagcttcttaacactgaaacacgtatatacaaacacacataaatatgtatatacgtacttacacatatatgcttatatatctatatatattgtatctatatttcaccactttccttcaaagtaatttagtatatccataacccaaaacaaaacaaaaagtccaaattctaaatataatagaacaaaaattaccattgggtaaatcctattcatttgtagaaatttatctgagggatgatacagtaaagaaaaacatattaaaaaaattcctgtcatatttttattctaactgaaaaaaatcatgaactaaacatttgcataatgcactaaattactattttagacattaatttgtacactttgcacatatattttataagcttcatattagggactaaaacttactgacaagcacaaacaaaagcaactttctcaaacacacagcattttctagagccctgaaatagttttatttcatgaaaggaaagctttcaactacaaagctgtgaaccagctaaggctaaatttcagtttcatcagaagcccatcctttaaatagcagatgatggactaactgagtctttttctggatcgctttcctgtgtctcagcctctctactctagccatactccttgtatgacgcatacggtccagagacaactggaatacagagtcataataaagtccattaacctttttgtccagctctgcatgcccagtagaggtactagaaaacaaaccaacgaataactcttgggagtccacatggccagctatctcccaacaccaatcctcttcatgtaacattggcaaaaacagttctggattaaggcttccagcgtctatcctacaaaccccacgtaacatgaaagctatgtacaatggaagaaactcaagaagatgcctgccttgtgacatcgcagttacaatctgggagatctgcatccacacagctgtcctctgccatcctcagggcactcaggtcctccgccaccaccatgaagcttccacttgcaaaagttagactctgcagagcaaaaagctatatcctgcgtggggatgaaagtttccccttgtctgtgtatagaagtatgaaaatgctcactgtagacaaatgttggtagtctctgcccgataacatgacactgggcagtgacaagtggtcatgtttctaaataaaacctacattcattaacatgtgccaggcttgatctcctggaatgtaggccacgagtgtaagaaggggaaaaagctcagtgtaatctgtaaggaggaggaagctacaggtctaaagaaaggacagcaaaaacaacatcggctgcacacactctgctgttctgtaaggacagtcaacttttcttgcgggcagtttgttatgctgggaaagctatttaaagaaaacaaatcatcccactgcaaacaaacaaaatgtccacaaacacagcaaatggtagtagcaaaaggagtaacttccttcttttttgggttcagtatgccagctcggtagtgtatgcaagagttttaggggttgtttgcgaaggtgggaaagtacatgctctttatctttgagtagactatttggggaggaaaaataaggaagaaatattattctcccttacatatgcaaaacttttgtcctttaaaaataatcatgtagatgacaaaaataacattttcattttaagacaattaaaaaaataactatattcatttgctcagggggtcttcaggtaactctttttcttttgtgaatttcaagagtttccaaactttctgcactaagcagatgataatttaataatttatacttttaaagaaaataagtccccaaattattaattcctataattcaataaaatatgattaatgctggatgctttacatcctttaggggattaaaaactacacacaaataaataataaatattaaataaataatgaaaatttgctaagttctttccaaaaaggactacatgatgatttgtaactaaaataaaacaaagcatctggttctggtcatgtgagttgactgtttttaaaacagaacactacaggaaacacattttcttaataaaagaaatacattggtggctcacgcctgtaatcccagcactttgggaggctgaggttggtggatcacaaggtcaggagatcaagaccatcctggctaacactgtgaaaccctgtctctactaaaaatacaaaaaattagctgggcgtggtggcgggcacctgtagtcccagctactcgggaggctgaggcaggagaatggcgtgaacctgggaggcagagcttgcagtgagctgagatggcgccactgcactccagcctgggtgacagagcgagactccatctcaaaaaaaaaaaaaaaaaaaaaggaaatacacctgccagcctgggttacaaagtgacacctcatctcaaaaaaaaaaaaaaaaaaaaatcaaaagattatccaggcacagtggcatgcatctgtagtcccaggtaatgaagtgggaggaagactgcttgagcccaggaggctgaggctgcagtgagccattactgcaccagtgcactacagcctgggtgacagcgcaaacccaatctcaaaaaaaaaaataaaaaattaaagaaaactgcattttatataagaaataaattctagaaaacatagtacttaaagatattgtactgtgaattcttttataaaacaatcattcttcttatattaatgtatttttagtaatcagaaatgaaaatattttaaactttgattaaagaaatatattggttatgaatctaccactataggcaactttgtttttttcttgattatgactaacattttaaaaaacctgaagtcttcaaaacattttattgtcataatttccttagtttaatttcttttaccttatttagtttacctcatggagttaaaaaatttgaaatttttttcatgcttattattgttagcataatatatgtattccaatgaactaaatatgagacaaggcaaagctctaaagatacaattattcaaagagcaaaaatggcaatgttcattgatacagaaaatcctagataagttgtggtatatttatactatggaatactctgcaggtttctaaaagaatgagactggcatagacattgttttatagtaaacacagtcctttcccttgcattttctcattggagatgtggcagttagtttcattaacactttgaaaatgagcaacttgaggctcagagaagttactcagtaagacctgggccacacagcaggaaccaggtggactaaactcaggcctcttgattagttctgtgctgtttctgtgctcatcgcatcaatgcattcctgatccttaccaggcaccttccgactcaaacacccttaggtaataccagccgtgaattccaagaatttcatttcctttgacctccaacgtgggtagaacaccctttaaactgaaagtcctcctgagggcagctgctaggaacttcacaaagccttgcttgcactgcatatgtgttttacctccacagcctttgaactccctctgggatgagagctgacctctattgaacatattctatgcttagcggttgatatggtttagctgtgtcactacccaaatctcatcttgacttgtagctcccacaattcctatgcgttgtggaagggacccgatgggagataattgagtcatgggggtggtttcccccagactgttcttgtggtagcgaataaatctcatgagatctgatgattttataaggggtttccccttttgcctggctttcattctctcctgtctgccaccatgtaagatgtgcctttcgccttccaccataattgtgaggcctccccagccatgtggaactgtgagtccattaaacatgtttttctttataaatcacccagtctcgagttgtctttatcagcagcatgaaaatggactaatacagtggtaaaccactaatcattcttctgagctagctactattatgattctcattttatacatgtggtaaccgaggtgctgagaagataagcaagttggtgaagcagaatcacgctatgactcaggcagctgaagcccgaagccaatgctttgctttgtgtatgctttcatttgtgtgcgtacgttttccaccctatggtttagatttgagaaactcagcaaatacgggagtgactgctatgtgcaaagaacaaggtcaggggctgggactactatggtgatcaaggttagatacacttacattttagcagagaaaacaggcttaaaatgactgatcacacaagatttcacatagttcagggaaatgctatgaaggagaagcctactgagcccgtaagaagaatctgatctaatctggagagaaggaaaaacaggaagaaccaatcaggagctggccaggccaggggcaggcaggagaatgcccaggaagagagaatagaaaggaagaggccctgcagtgaggaacgcttgtgtacttgcattatgacacttatttggttagggaccattttctttctcatctttatatccctagagcaggccacctgttttggtaaacaaaattttgtgggagcactgccatggttttctatttacagatttttctatggctgctttcactctataataacacgctaatagcaacagagactatttggcccacaaaactaaaaatatttactatctggtcctctacagaaaacatttgccaacctctgccctatagcaagaagcatagtacttcatatatagtaggcgttcaatcattttaaaaaattacttgtttttactctacttctacaaaatgttgaggcaattataataaatatagagattaaaaacaaccagtcacaaaaggccacatattatatgacctatgtatatgaactattcagaacaggtaaacatgtagaaacagaaagtagattagtagtttcccagggctgggagaagtggggaaggaagaggagggaagaaaagagtgacggctaatgggtaactgtttttatttgggactgacgaaagtgttttaaaattgattggagtaatagatgcatagctttataaatatactaaaatcactgaattacatgctttagatagatgagttatacggcatgtggattatatccccaaaaaagctgctattgagaaaaacaaaaagataacagccaaataactaaaggatgcttttgccttggtgatggggatttaggtttagccgagagaaaaagaattttctctattagaaggtccagttacccacttccctgcccccaaatcatcacaacagagtgcgcaagttgaatttgaccttcctagatgctaagatgagaaatgttactaattcgttgtctgtgataagaaacattgaagaattaatactaaaaagacagatttccttttagtcctgagctctagagaaattgctatgtggattttctgcactggattcattgacaaaacgagagccagtattcttaaaggcagttttacagaaattagagtgatgcgtcaccaatgacagcttcttatgttgacttttaaaaaaagccaagggctcagaggtactttaattatctaggccactgctgaacaacagaactttctgagatgataaaaatgttctgcattgtacagggtccaataaggtagccactagcctcatggggttattgaccacttaaaatgtggccagtgcaactgaccataattaaaattaaggagtaatttaattttattccatttcagttaatttaaatattctgtaatttaaatagccatccgtagctagtgactgctgtattacatacagcagatctagaaagtatggaaaggacactagaacattattcactgagtcctaaaagtaactgagcaacttttgttgccctaaaaaattgacaatgcttgacaacacaatttaaaaactcaatgcaaagcacatctattttgtactcagagtaatctaaactaatctgatggtgatgtcaagttgactctaaattatgcgttctatttttatgtatgtaatagatttgttatcagtaaatctttttcttttcttttttgttgcttctgtgattgaatattaaagacacagttcatgtttctattagctgagatgttcacctaaaaatactatcatcttcaaaaataacctctccattcccacaagagcaccaatacaggacagaaatgtcgaaaggcatacactgggttatattttgctttagtgcatcagcgctggaagaggcaagagtggtgaatggactgaatcatagaaacctaatacttcagctggcagttcacagttgaggatgggtgtgggaaacatgcatccaatctgtgcactaacgaagcaccaataaacaaggaaatgcaatgcagatgtgacagccgggtgtctttcaggagaagctgcaagggtgactgtgactctaacatggtgttaaactccaggatggctcaatgatcagtgcctaatctagtctaatttggaaggaggcaattagaaacaggcaacatatatacaaaaatctcctgtggaattttatctgggtattctgaggctttatgtaagaggaaacaaaaattagtattgtataagtgactatagtgagaagcatgtgtaccttataaacatgtaattgattcaagtttattaatatgtcttttggcaaagtaaacaattaatatctagaaaactctccactgaacagccagacaaaatatgttataaataaatgtgaattcaaggagacagcagcaaactcatttgctgtaatattggctcatagttgggcatacactaagttagctgcttatgactagattacattaaatctgatttaaaatatctttgacatagtgcatccttactctccacatcactgagtcactaaaagtaggaaaataatattaactagtttaactggattacgtggaaatgtcaatcaatctatgagtcaaatttgaccaaaaaactccccgggggatgtttaccaaacaggcagtttccctaagaaggatatttatagcttgaaggacttcaattcctccttctgaaacaggattttgttatcattttagtgagggagaagtgggactgaacacagcactgggattttaaaatatacatttgttgaaactccgagaccagtttaagctaaaatattatttccatctctttatagtgccttttccagagctcctatttatctcattgttttactccattcccatcctgaacttctcaaaggagaagttctccttcagttctgtcattttatcttgactctcacagtcactgtcacattgtaagtactttacaaagaactgagaaattagattgtcgagatcaaaaacagaacttatcttccatttaactgtcttctctctaacagggaaaaggaagtcacaaacttgagaggcaggagggcacagcactccaggacacgcgctttggagtctgagcacaggctgtgccacacaatgtgtgcgtgatgatggacaagcctcaaccttagcccctgtatctgtaaaatgggcataatgataaggccacctcaaaggacattatgaacaatacacaaaaagatgcctatgaaacccgtagcatggtcattggaatcagcaaagtgttcaataaatgttagctatatcagtgctatggttaaacatttaaaaagctgaggctgggtgcggtggctcacacctgtaaccccagcacttcgggaggccgaggcgggtggctcacctgaggtcaggagtttgagactagcctggcaaacatggtgaaaccccatctctactaaaaatacaaaaattagccaggtgtggtagtgtatgcctgtagtcccagggattgggaggctgaggcaggagaattgcttgaacctgggaggcagaggttgcagagctgagattgtgccactgtactccagcctgggcaacagagcaagactccatctcaaatataaataaataaatataaataaataaaaagttgatatacatttattccattttgtttcattgtcactaaaagataatctcactttcttgagttagatactttttgataactctcttatagaaaagaaatatatccaatgttttcaaaatcagcatacagggttgtggtgcccacatgcggttttgatgagcacatggtacgcagaggacattgtttcacgtccacttttatgcagcacggctaaggaaagaaacccagattttaaaagcgtattgtgggatggaccccaaatggcaccatttgtaacattccaactctcctaattgccatgaagaacatttactcaaatattcaaatattcatttatgcactgaagtattcattgagtccgtatttaggcactgttcttagtgcttgtgatatgtagtgaatacaatggagaaagtttcctgacctcagggtgcctaagttccaacatgaagccaaattcacctaaaataagacatctcctttttatattaatagcatagaacatttttataacatagtgcatcattcatattagacttttatattgctagtaaataccctcatatatttttctttttgactttcatctctcttacccaaccctacccttctgcaacagaaagtgaatgtaatattcttcttaggtatgaggcaaacacttatagttagcactaaagctcaacacaaaattactataatgcagcagctgatttttacaactgagcagagtggcaataatcagatttatttctataccttgctaactaaaaatatggcagagatttagtaattttttttttttttttttgctactgcagacaaaaacactctccacaaatactggtcagcagtttcttcctgataggagtttgaatacccatgaagccctaaaataaagaattttctcttgggaattagttttgtttggatatgactctctctctctttctcgcagctacatacaaacaacatgagatttataaagtaagaggagaattttcaaggtaactaaagtgccacttatgagaggagcatgaacagttttgaaaatggtgagataacccaggaagagagactgatttattggattatctttggctgatgaaaggcagactgaaaggctttaaaatactgcccacacgtgccctattgactcaggtcctctttacctggctgcaatgaggtccaggagatgctgccaccggtcgttgacctttcccagcttgtattcaatctcagatgctttgctttcatggctggctttagcaagtcgttctcccatttgttggagctgtattttgttctcttgagcaatagcaatttcctcttgataatcctgtgtaataaatagcaatcacagaggtcagaaagcatattcttaatacatccagcccagctctactagaaacatgatgattactgctttctactgcttggaagtagtttgagcataggaataccatgtggatatcagcccatgtgcacaagtattagtagtgcctattatttttggtatgtatgcagagttgggattaaatttttatatagaggttctcgaaataaataggatgctgcttcctatttacttgaaatacatattaaaaaacaataaaagatagatataaaaaataaaacttaaaagattttaatattggaaaattatagtttatttctctcatcactaacctgatgttatacttagaataaattctcagacaaatagttgctgagagacttataaaatgcacacacacatatatatatgcaattgatatataggtatatatataaatgtgaatgtgtgtgtcaattatgttatttgtgaggaatattttaaaagagttccttcattttaaagagataatcctctatacaatgtcaatattttgcagtaaataaatcaatgataaattaactttcaataataataactattaactatagagaatcgacaggcctcaaaccttcttaatttactcactttctgtgctagcttctcttagattgtttgagttaaagaggacagactccatatggactatttgcaagagataagcacgaaatggtgtgatttaactgacgatgaaaggacaatcccctccccctgactgccactgctatccccaatgaccctcttactctcttgccacagtgacaggatccagtctttaggatcaacttttttatttttggcttaagctcctgttacgtaataaatagtttctcagcaaaataatatatgaagacgggtattatatgagtgtgaacattttaaccttctcttggtctaaagttagtgtggtaacagagctatcctcccaagtcatttacctaagccaaagggccccaggggaatggtagggaccaacaaaactttattccattccagggctgactgctgtcctcatacctgcagccccacccaccctcctttttatgttatttcaacacaatgggattcaaagaccaatacgttgaatgtatttattaacattataatatttcagcaaacatttgagatgattttattgagaagtgtttctttcaagggaattactttaagacttaaaaagtatttataataaaataatcctcttggattgtctttaaaatcaaactgtttttgagtgttaataccaacagacactaatatcttggcttcaattttttttatgaatggcctttttctttttccttcatcttattagcacttcccagttgacaactgcctttttctatgttgccaaaattaccaaaccttgatgttattttcctttacaaaagagacgccacaaagaggaaaactcaaaagccctttaaaaaaaaacccatgagttattaatatacgaggtagtatagttaacattttaaataatattcctaacattgtgccaaacaatgtaataaaattatctatatgaaaagctgaaatttttctaaattttaagttctggttatagattgttcaagagatggtttttttccccacactctcacaatatacatcctaaatttagtaaaaaaaaagcaatgagaatagagacaaacttaatcaaaatttattctatagcaaattttactctactacctatagtgcatgaatcacgcactgacagcattctctgacacccagcaacttagcaaagggcaaccgtgagcagatgctaaaatgaaatctgtatcatctcagccaagagttttaagttttacaatatcaagtaaacaaatgcttatccatttggatttatccaatggataagcaaattggatacataaaggcttatctaatggcaaatccattagatttgtaacatcattaatagtacatgttggctttggatgttttaattttctatgtgtgcatatggatagaaataatttttcctaataaccatttatatttcttttcagaataaatgcagtaaatactggctgagtgcttatgagaagttaggcactgtttcaggtgcaggggatatagcaataaacaaaattagacaaagcccatgctcctggaaagctgacagatcagtggggtctccatttggacaatgaataagtaaatacaaaaaatacattgtacattagatggtgatatgtactaatgagaagcacaaattaaaataacattaaaatcactgattgttcacaagcactgtggaaacaacactgaaatcacccaattctttttttttttttttttttttgagacagagtgtcactctgtcacccaggctggagtgcagtggcacaatctcggctcactgcaacctccatctcctgggttcaagtgattctcttgcctcggcctcctgagtagccaggactacaggcatgtgccaccatgcctggctaatattttgtatttttagtagagatggggtttcactgtgttggccaggctggtctcaaaatcctggcctctggtgatctgcctgtctcacttcccaaagtgctgggattacaggcgtgagccaccgcacccggccgaaatcatcaaaaattttaaaatgctagcaaatttgatcagctttatatagacatcagaaatgttttggatccaaatgaatatgtaaaataatttgataagatatacatacctttaaaataatatgaagccaaaattatcaggaaactcttaattcctatctgtggtctataaatcatattttagagagaaaatgtcaattcaatttatcttaagaatgttttctttcagtttctctctagtggctttacctttttaaaacaaaaaaaaatacacaaaaaacaaaaaaaaaaggaaagaaaaataatacatataaagggttcctactgaacaggtaattaagacccccaaatactgaactgaatagtagatgctctatttcatcacaaattgcaagtattctatatattttatgtgtaaagcaggcctttttatgcaagtttattttatgctggatatccttttttttttttttttttttttttttttttgagacagagtctcgttctgtcaccaggctggagtgcagtggcacgatctcggctcactgcaatctccgccttctgggttcaagtgattcccctgcctcagcctctagagtagctggtactacaggcgcgcaccaccacgccaggctaatgttttgtattttagtagagacagggtttcaccatgttggccaggatggtcttgatctcctgacctcatgatctgcccacctcagcctcccaaagtgctgggattacaggcgtgagccactgcgcccagctgcaagtttattttatattaaaaagataaaatgtttaaaatatactgctcctttgacaggaaagtaattgtgagtaaagccaccttctgtacctgtgaaaagtacacataagccttatgaagaatgaaaacctaagtagccatgcattccataccttcttgagcttctctatcatttcttcaatgagaatgtctccattctgagaaactttgctttccatttgagtcaaccactcacagagttccttgttcttttcactgaagactgcccattcattcaatctttcacctatttgctgccgccttaaggagagctgaaaagtttaaaatgggagaataggcaaaatgattatcagagagaagaccacactccaaggaaaatagcaaataaactaggactaaaatgaatgatagtcatacatctttttagcccactgtttcctgaagtctaggatttgctattataaagtgggagacattgaatcctctagttctttcctgaagattcacatacacattagcttattaaaggttctggataatgcaacttcacacaattggttcaggatagataggatacatgaccagtgaatgtaaaaaagaaagaagaaatggaaaagagtagggaaagaagaaaggaaagaagggaagtaaaaggaaagagagatggtaaagaagggaggaaaaaaaaggaaagaaagaaaaaaggaatagaaagatgaaagaaaagagtaaaaatagggaaggaagaagaaaaggaagaaaagaagggatggaagaatgagcctcaggtatctagagagtgaggaagcgggcagcatccaagcgaagcggcctgaaatggaggcaggtgccccaaggctcagctccatactgacacgtggactccaggcaagttcctctacttctctgcagttttcatttttatttatttaattttgtttcttttccttctttttttttcgcatgacagatttattaagatgtatttcacatatgatacaatcacctgtttaaaaatgtacagttcagtgcttttgggtatattcacagcatttgtgaatcaccaccatcatcaattttaggatatttttatcattccaaaaaaaaaaaaaaagccaggtgcagtggctcacgtctgtaatcctaacactttgggaggccaaggcgggcagaatcctaacactttgggaggccaaggcggacagatcactagaggtcaggagttcgaaacctgcgtggccaacatggtgaaaccccatctctattaaaaatacaaaaattagccaggtatggtggcgcacacctgtaatcccagctacttgggaagttgaggcaggagagtcgcttgggcccaggaggcagaggttgcagtgagccgagattgtgtcactgtgttccagcctgggtgacagagcaagactccacctcaaacaacaatgaccaccaccacaacaatgaaaaccttgtagccatcagcagttactctactgctcctcctcacttacctcccagttctaatctcccttctgtccctgtggatttgcctattctggacatttcatatacatggaatcatacaatatgtagtcttctatgactggcttctttcacttagcatattttaaagattcacctatattgtagcatgtatcaatacttcattccctttattgctgactatattccattgtatgaatataccacattgcatttatcaactcatcttatttgggttgtttccatttttttgcctattctgaataatgctgttataaacatttgtgcacaagtgtttgtatgaacacatgttttcatttctcctaggtgtttatctaggagtagaatgtcttggtcatatggtaacactatagattgttttccaaagtggctgcccatttcacattcccaccagtagtaggattccaatttctctacatcttcaccaacacttgattacagccatcctaatggatgtgaagtggtatctgatgatggttttgatttgcatttccctaaaggctaacaatactgagactcttcatgtttcttagccatttgtatatctcctttggagaattatctactcaaatccgttgcctgctttttaattagattgcctttttattactgagttctgagagtttcttatacattatatatatacaatgggcttgttttcctatctctaggtctagaattatcctttccagaattctaaaattttctgatttcaaaatataatactcttgtgttcatagtgctggttgaaatactaaggaatgtttctagttgagttaaactacacgttggcaaaacataatatgatttggtaagaaggtctgaagacgttcttccacagtcttgttcataatgctagctattccactattcattccactgcattaaacatatccctattgattttattttacccccaacattttattacaaaacatttccgacacagaaaagctgaaggaattggatggtaagcactcattacatactccctgggctcaaactgttaacattttgctatattttgttttaagacattttccttccttaatacatttactttttatgtatttcaaacaaatttcctttttaaaatgaaaatgaaaatatttctaaggtattatacactttctagttatcaattctgtcttggatttgctctgttaatgattagacagataacacaaaactaaatatctgtgattctacatccttgtacactagtccaggagcccaggatacgtatcccaaggccagccttaggcatagtgagttgcctagagagtgagccccataacctaccataaattttgaaaggccaccatgagaaatttattcttttgattcaattatgatcttttaaagtaaaagtttttctgggttgggtgacactggtgaacctactaagtatttccccattagtataatttagtttctcattgaggtttttggaggcagaataatacagaacagtcaaagggcagtgaacttggggtagggcctactagaaatggaaaaagctaaggaaacagagatttaaaagttttggggacaaattttgtcactttacaccataccccaaatagcactgaagaacataatccttccaggaccccttacccctctagctctgagagccgcgtgcactctgatcttctgctgatctctcagattgagaactctctggtgaatacggccttttccctttcattcacagagcagcaagagtcaggagtctggctggtagttaaaatcccggttcaattgatggccaaactgaaactatactcttattatttggactgcccaaaataatcattgtctatgaatcgaagctgggcctggtggcacatgcctgtaatcccagcactttgggaggccgaggtgggcagagttcaagaccagccgggccaacatagtgaaaccccacctctactaaaaaaacaaaaattagccaggcgtggtggcagccatctgtaatctcagctactcgggaggctgaggcaggagaatcgcttgagcccgggaggcggaagatgcagtgagccaagatcacaccactgcactacagcctgggcaacagagtgagaagaaaaaaaaagaaaaagaatcgaaactcctgcccttcagactgaagatgaacaagtaactccttacactgcccccgaatcttggccataagccaagaatgaactctaggcctttactcaccaatatctgcagggaggatggtcccaaaatagaaaaatattacctattactttcataggtaagtattattatccccattccagagacaaggaatatgaaagttggacaaatttggggcacttgtttagaatcagtacaagataagaccagcaaagtttgagtctttgacatggggtgcaaatatgattaaatatccagaggcagctgatattcaaaaatagttcatccatcactgactaactgcatgatcaggacaaggtccctcattttctctacgacttactcctttcatttggaaattattcttatgtttgctccaaaaattcattaaacaaatgtttattgtctgtagtaaacaagtgtctctatgtgcccagcactgtcctatcaatatggtaatattagagaaataagagagtaatttaagaaattgactgatatggccaggcgcactggctcacgcctattatcccagcactttcggagactgaagcaggtggatcacttgaggtcaggagtttgagaccagcctggccaacatggtgaaaccacatcactattaaaagaatacaaaattagcagggcatggtggcaggtgcctgtaatcccagctacttgggaggctgaggcagtagaactgcttgaacccaggaggcacaggttgcagtgagccaagatcgcaccactgcactccagcctgggcaacaagggtgaaactctgtttcaaaaaaaaaaaaaaaaaaagaaagaaattgactgatatatattaaagacctgacaacagctggccattactatgctgttgctactagtactattatacatgactacagggcatcacttaagttttaaattttttttcctcccttgacactcatgtattccatatctccactaagcagctggattatacacatatatagatagatagatagatagatagatagatagatagatagatagataaaatatatattaaatcccttgtgtttatcacacaccatgaaaatgttgctttcattttcttaccacggagctacaccttaaaaaagacacagtgaggctacaagcactgggtgcaaacccaggccaaacgcttttcaaaagataagggcaatggcatcttccttctggtttgtacatctagtatttagtctatatactaagtaaacattaccatctctttctttggattcagatgaaccctcaaattatttatcagcttagcacctatttatgtttttgcaagggcacaaatacattgcattgccaacagctgagaagcaccagctaaaaccttcagagtgtgcagcagctcaacaggaaatacatccttttctggttgaaatatttttaccatgatgttttgacaaaacaacgagcaattacgatgatgacatatacttatatttcagctagaattacacacaaatctacaaaccaaaacagaataaaaacaagtataagctctggctgtacacaggcacaacaaaacatttgggctgtctacttgaaaacagatactttaatatattaactctgccctgcaatgtttactcacggcctctattccgcattctcatcgccagtcccaggtactccagactcctcatcaactgctttggtcagaataggaacagactacttgctccttagtagggataatgttatgttgaactcaagttttgacttttacaatgagacatgggcacaagctcatttccttttgtggtttcatacttgacagaaattcaccagaaacaactaactcaagaacgagaaactaatctatatcctccttagagttacatcctggcaccttgatcaaacccatgactaaactctcattggtttaaatattatttttcagactgaagtattaataacgtaagtacgctttagcttcaagcattaagacacttcaacatggaaagtttctaaaaacactatgtattccgtttgctgtttctttttaacgtcttagtctcctcacaggtgcaagttattaatctatttacagcatatcgcatgatcaacatcagcttttgaaatatattttcagatggctgtctagatatatctaagtctggagaacaattttacaacatatgaatgactactttagcaattaataatagcaataattccatggcatttttatacaacacttttcctaaatcaaaaagtattgcataaccataatcttcttaatcttcaaaatattcaaaatcttgtcattattttacactaagagaaacgtaagtatgaggaaatagaatcgatgccataatgtcttcattataaacaatacatcatgaacacttagctactctagacactgaagatgcaaagaaatggtctttgcatatcaaagtcctcatattcttggaatgaggtcacaaacattgaaaagaataataacacaatgccacataatggcacaaccaaaagagaaataagaattcagaggaccaagaacatactgagggctgagaatttcataagtgacatcacaggagttgtggaatgtaaaagaaaacaggttagaaaattagaagggaagaccgggcacggtggcttacgcctgtcatctcagcactttgggaggctgaggtgggcagatcacctggggtcgggagttggagaccagcctgaccaacatggagaaaccctgtctctactaaaaatacaaaatttacagggcgtggtggcacatgcctgtaatctcagttactcgggaggctgaggcaagagaatcacttgtacccaggaggtggagtctgcggtgagccgagatcacaccattgcactccagcctgggcaacaagagagcagctctgtgtcaaaaaaaaaaaaaaaaaaaaaaaaaaaaaaaaaaaaaaaagaagaagaagaaaattagaagggaagaaacagtgtcggcaggaagagtggcataatccaggtctttggggagggaagttcatggcatgtttgaagcaaacaggatccaatctctaaaatattatctctctgaaggcttcacaggcatcatttagctaaagcaatagatctggtctaattcaattcatcgaacatgctaaaaaatattaagagagcaggtagtgctagacttctcctaaaattaagaaaaacagatgaatgggctcacaaacgtaactgaaggttgctgtgataatttcccacaatttgtacccaccaaatatctttcattttgatacatcatgataaagtctttacattgcaaaattataggatgatttactgtataataaggtattgctttcagtttgaagaattcagaaatgaatcaagtgttgtgattagcattactaccctctatgcgtaaatccatgtaaattcctcattgtgttcactgagaaaatgaagctttgtgaaagtagccaaattcattttgaactcaaatcattaacatgttggtaaaagccatctcatacatgtatcccccgttttaaaaagtatatattcataggaaactgctcacacatctaccatgtgtgctccagagttttctgttggcccacggattgagaaaaacatgggttttcacctaaatatacagagagaaattttcctgaaaatacacttcttgttgatatcacatcaatcaagaggctctgagcctcttaaactctgtttaatggttcctgaagtatgaggataagcatctctaaagtcagagaaagggtggaggatgggagacaaaagagatcccagggcagcacaattggcagggacataagagtagggacataagagccccctctcaacagccccttcctcagtcttcccacaccagctttttccagccagttcctctgctccaactgccaccttgtcagagtgttcatttgcttcctcccatcaatcagtctcctccactccccttttcgaaactcaattcaaaatgtatccatctcaagaaacatttcctttattccttgccatccacactagccttagcttgcttaaatctttatacagtttgtgtgtgtgagagagagagagagagatggagttacgctcttgttgcccaggctggagtgcaatggtgtgatctcagctcactgcaacctccggctcctgggttcaagtgattttcctgcctcagcctcccaagtagctgggattacaggcacccgccaccatccgcggctaatttttgtatttttagtagagacagggtttcaccatgttggccaggctggtcttgaactcctgacctcaggtgatccacccgcctcagcctcccaaagtgctgggactacagtcataagccaccacacctgggtcctttagacagttttatacattgtttttacctgtttatgcctggttttcttcttaactgtacacattctcctagactgattttagtctcagatcaagtttaaacttgacgatagggacatttattacagtttgttaacatcacaattattaagatgactgatccatttaacagagatgtatcacagcctattatgtgccaggcagggcactcggggtatagaagtaacaaagacagggccctgcttcctggagaacataacctcaaggcatttgggtctgttcttcattatgagcctttgaatctgtttttcctctttgcctaggatgtcttctcgctgcctttccaccaatctttccctttcatttccaactcaaagtcaatctgggatatttttttaaaacgttgtgcacatagaaggtatttaataaatgaataaagtatgactaaaaataaatgaatataaattaccaggaaacaactacagtaaattaaaagtgataataaatattccctgaacaaaaccagctccacagtattagctaatgttgcaaatacaacagtagtttttcacgtttcaagtatatctacccagcaaaatcacatctgtgaaccataacattgtgctttctcttaaaaatattatgccagcggccaggcacggtggctcacgcctgcaatcccaacactttgggagggcgaggcggacaaatcacaaggtcaggagatcgagaccatcctggctaacacggtgaaaccccatccctactaaaaatacaaaaaattagctgggcatggtggcaggtgcctgtagtcccagctacttgggaggctgaggcaggagaatggcgtgaacctgggaggtggagcttgcagtgagccgagattgtgccactgcactccagcctgggcaaaagagtgagactctgtctcaaaaaaaaaaaaaaaaaaaaaaaaaaaatatatatatatatatatatatatatatatatataaaatgccagccagcaaaagtgaaagaaaaagaatccagtttaggtttttctaaaatgtggtaaaatataaatgtattgatctgaaatgttctggtagtaaccacagtgttcttcctttgtccgtactaagaattatgggccgggtccacatgtgggttaacccatctgacgttcaaattcatctcccaattttccatcatcaagataattccatttttagaacttatcttacctggtggcatagttcttcccactgcctttgcagaagctctacgcgttcattaagaatggagatatcatcagcactgatataggcagagagggtgtccttcagcaggctcaactgggtcaagtcatctgtccagctcccaactgcattttctaattcctaaataaaaaaacaaacttgaatacccacggacatctcctgccaatgatttctgaagtgtttttgaatcccctcttgatagaatttcctttgtatagccctcaatttaaatatctaacttgggatctagaggcacatcatggcaatattacagatttggttccagaccactgaaataaagtatatatcacaataaagtgagtcacaaattttttggtttctcagtgcatataaaagttatgtttacactatactattgtgtataaaatgtgcaatagcatatgtctaaaaaaaccaatgtacataccttaatttaaaaatactttattgtttaaaaatgctaatgatcatctgaggcctcagcaagtcataatcttcttgctggtggaaggtcttggctcaacgtgaaaggccattgactgatccagtggtgattgatgaaggctagggtggctctggcaatttcttaaaataagacaatgaagtttaagcagcactgatgactcttccttttacaaaagtttccttgtagcatgtgatgctgtttgagagcattgtactcacagaacttttttcaaaatttgagtcatcctctcaaaccctactgctactttatcaactaagtttatgtaatacttgaaatcctttgttgttacttcaacaatatccacagaatttttaccagaagtagattccatttcaagaagccactttcttgttgacggccataccaccctaaacatgcccaatcttgtctggtctcagaagaaaccactttttttattgatccataagaagcaactccttatccattcaagttttaacatgagattgcagaaactcaatcacatcttcaggctccatctctaactctagtcctcttgatgtttccacctcatctggagctactccctccaccactgaagtcttgaaccccctcaaagtcatccacgacagctggaatcaacttcttccaaacacatgttaatgttgacattttgacctcctcccatgaatcatgaatgttgcttttgtgaaaataaaatttatttttaatttttgtgggtacatagtaggtgtacatatatatggggtatatgagatattttaatagatgatagcaaagtaaatatggtattcatcacctgaagcatttatcctttgtgttacaaacaatccatttatacccttttatttatttaaaaatgtatgattaaactcttactgactacatttgccttgttgttctatcaaatacttttctattttttgtaaccattaaccatcctcatcacccctgcagcctccatgtaccctcccaagctctggtaaccatctttctactctctatctccatgagttcagctgttttaatttttaactcccacacataagtgaaaacatgttgaatgacagtggtgaaagtggacatccttgttgtgttccagatcttagaggaaaggctttcagtttttccttattcagtatgatgctacctgtggatctgccatatatggcttttattatgttgagctatgtttcttctatgctcagttttttgagggtttttatcaggaaaggttgaattttatcaaatgcttttcagcatcaatagaaatgatcatataacttttgtctttcattctgttgatctgatgtacacattgattaatttgagaatgttcaaccatcattgcatccctgggataaattccacttggtcatgatgaatgatctttttaatgcacagttaaattcagtttgctattattttaatgaatatttttacataaatgttcatcagagatattgttctataattttccttttttttttttttttgatgtgtctttgtctggttttgttagcagggtaatagtagccttgtagaatgagtttggaagtattccctcctcctctatttttcagaatagattgagtaggattggtattagttcttctttaaatgtttggtaaaattcagtagcgaagccatcaggtcctgggcttctttgctgggagactttttattatggcttcaatcttgttacttgctattggtctgcttttggatttcttcatggttcaatcttggcaggttgtatgtctctaggaaatcatccatttcttctaggtttcccaatttattggcatatagttgctcataaaagccgctaaagatcctttaaatttctgtggtattggttgtaatgtctcctttttcatttagatcttctctttttttcttagtctggctaatggtttgtcaatttatcttttcaaaaaataaacttttcattttgttgatcttttgtattgttttcttcatttccatttcatttatttctgctttaagctccattatttcttctactaactttgagtttggtttgctcttgcttttctaattctttaagatgcattgttaggttatttatttgaagtttttcttcttttttgatgtaggtgcttgtatctataaacttccatcttagtactgctttcactgtattacgtaggttttggtatgttgtgtttccattatcatttgtttcaagaaatttttctatttcctttttaacctcttcattgactcactggtcattcagaaacacatagtttaatttctatgtgtttgtatagtttccaaaattctttttactattgatttctagttttattccattatgatcagagaagatacttgataaaatttcacttttgtttgaatgttttaagacttgttttgtggcctaacatatagtctatccttgagaatgatccatatgctggggagaagaatgtgtattttgtagctgttggatgaatgttctgtaaatatctgttaggtccatttggtctgcagtgcagattaactccagtgtttttttgtttattttctgtctggatgatctctccaatgctaaaagtggggtgttgaagactgcagctattattgtatttgggtctaatgtctctctttagctccaataatatttgctttatatacctggatacatgagcatacataagtgacagaaaaccaaggaaaaaaattaaatgtatattattattattatttgagacagagtctcagtctgtcacctaggctggagtgcagtggtgtgatcttggctcactgtaacgtccaccacctgggttcaagtgattctcccacctcagcctctcaagtagctgggactacaggagcacatcaccatgtccgactaatttttttgtatttttagtagggactgggttttgccatgttgaccaggctgttctcaaacatataaatatatattatatatttatctgggtggtccagtgttgggtgtatatatatttacaaatgttataacttctgttatatcctctggctgaattaacccctttttcatcatataatgacattctttgtgtctttttatagtttttgtcttgaaacctattttgtctgatataagtatagctattcctgccctttttgctttccatttgcatagaatatcgttttccatccctttattttcagtgtatgtgtgtctttacagatgaagtgtgtttcttgtaggcaacagatcattgggtcttatgttttttaatccatttagtcactcaatgtcttctgagtttagttcatttatattaaatgttgttattgataagtaaggacttaatactgccattttattatttgtttttttctggttgtttatatggtcttctcccccttccttccttcctgtcttcttttcagtgaaggtgatttcactgttggtatgttttaatttgttgctttttattttttgtgtatccactgaatgttttcagacttgaggttaccatgatgttttcaaataatatcttaatacacattattttaaactgatgacaacttaatactgattgcataaatgagcaaactaacaaacaagcaaaaagaaaactagtaaaaactctacactttaactttgtcagctcactgcaatctttgcctcccagattcaagcaattctcatgcttcagcctcccgagtagcagggactacaggcacacgccaccccacctggttaatttttataattttgttagagacagggttttgccatgttgaccaggttggtctcaaactcctggcctcaagtgatccacccaccttggcctcctaaagtgctgggaatacaggtgtgagccaccatgcccagccatgttgtttcttatttatatcttatcatacttgtctatatattgaaaagttgtagttattatttttgatcagctcatcttttcatctttctacttaaggtatagtttatacaggccaggcgcggtagctcacgcctgtaatcccagcactctagggggccaaggtgggcagatcatgaggttaggagatcgaaaccatcctgactaacacggtgaaaccctgtctctactaaaaaaatacaaaaaattagccgggcgtggtggtgggtgcctgtagtcccagctactcaggaggctgaggcaggagaatggcatgaacccaggaggcagagcttgcagtgggccaagatcccgccactgcactccagcctgggcagcagagcaagactgtctcgaaaaaaaaaaaaaaaggtatagcttatacaacacaattgcaatgttataatattctatgtttttctgtgtatttactattaccagtgagttctgcaccttcacatgctttcttattgctcattaacattcttttctttcagattgaagaactccttttagtacttcttgtaggtcaggtctgatgttaatgaaatcccttagcttttgtttgtttgaaaaagtctatttttccttcatgattgaaagacgttttcactggttatactattctagggtaacaggtttttttcttcagcaccttaaaaatgtcacctcactttctcctgttcggtaaggtttccactgaagagtctgctgccagatgtactgaagctccattttatgttatttctttcttttctcttgctgcttttaggatcctttctttatttttgaccttcgggagtttaattattaaatgccttgaggtaatcttctttgggttaaatctacttggtgttctataaccttcttgtacttggatattgatatctttctctatgtttggcaagttctctgttatccctttgaataaactttctactcccatctctctttctacctccttttgaaggccaataagtcttagatttgccctcttgaggctattttctggatcctgtaggcatgtttcattgatttttattcctcttcatttgtctcctctgactgcgtagcttacttcaagctcacgaattctttcctctgcttgatcaattctgctattaagagactctgatgcattcttcagtatgtcaattacatttttcaacttcagaatgtctgattgattccttttagttatttcaatttctttaatttatctgatatgattctgaattcattctgtgttttcttacatttatttttttattttttatttttttgagacagagtcttgctctgtcacccaggctggagtgcagtggtgcaatcttagctcactgcaacctccacctcttgggttcaagcgattctcaggcctcagcctcctgagcagcttggattacacacatgtgccaccatgcctggctgatttttgtatttttagtagagacagggtttctccatgttggccaggctggtctcaaactcctgacctcaggtgatccacccacctcagcctcccagaattctgggattacaggtgtgagccactgcacccagctcaaaagagctattttgaattatctgtctgaaaggttgcatatatctgtctctccagaattggtccctggtgtcttatttattggtattttttgggttaggtcatgttttcctgaatggtcttgatgcttgcagatgtttgctggtgtcttcgtattgaagaattaggtatttattgtagttgtagtcgggacttgtttgtatttacccttcttaggaaggttttccaggtatttgaagggacctgggagttgtgacctaagtttttagtcactgcagtcaaatctgcatcatggggcaccccaagcccactaaaactgtggttcttgcagactgatagaggaaccaccttggtggtcttggataagatctggaagaattatctggattaccaggcagagattcttgttctctttccttattttctcccaaacaaacagcgtctctttctctgtgctgagttccctggtactggtggagaggagagttacaagtacccctgtggatcccccaccactactggaactgtactgggttaggcctgaagccagcacagcactggctctctcccaaggcccactgtaaccactacttggctactctctatgtttggtcaaggccctaggccatacaggcttgtgttcttctcttcagggcaatgagctccccctggccccaggtggtcgagagatgccagggcttggagttggaaaccttagaaatctacctggtgctctgttctactgcagataagctggtaccgaaaccataagaaaaagtcctttccactcttcccttccctgtcccaggctgaggagtcgctccccaggtccactgccacaacagaaccgtggggaatactgccaggccattgctgatgtttacattaggcccaagggctcttcaactcagcttgtggtaaatgctgccaggcctggaacttacccttcaggggagtgggctcccctctggcccaaggtagatccagaaatgccacccgagagccaagtcctggaattgagtacccctggagcctctttggtgctctttcctgttgttgctatgctggtacctaagttacaagacaaagtcccctttgttcttgcctctcttttttgtaagcagaagaggactctcttcatagccaccgcagctgtgaatgtgctaggtcacacttgaagccagcatgtctccgaatctgacccaaggcccacagtgtgtaatacctggttacactgctgactatccagggcctatgggctctttagtcagccggtgataggtcttaccaggactaggtccttcccttcaatgcagcaggttctcttctggccaagggtgtgtctagaaatgtctggaaactagggcatggaatgaaggcttcatgactgtgcccagtaccctatcttactgtaattgagttggtatccaagttgcaaaacaaagtcctctttactctttcctcttttctcaagcagaaggaaggggtgtcttttggagctgcaagctgtattgcctggggttgggggaggattggcacaacaactcctttagctgtcttcctggtgtgtcaccgggtcatgtacccccaagtccactggctccaagcccagtactgcactaggacccacctaggagtgtagtacttgtggcctagacagcctttcaaatttatgtaggaccccagagcattttagcccatggtagcaagtgcttgtcaaaactcagattctgttggctgggatgggagcttcccctttggctaggtcttgtgtaaatgctccctccgtgggcatcagctgagttctgcctggtattggcagcactgagctccaatgcaatgcagaccaactgctgggctctccttcctcgatatgcacagatgctctctccgtgccatgtggctgctgctggggcaccgaaaagaagaggtggtgtgggcaatccaaggttgtctttcctaccctcttcattgcctctttctgtactatgaagttgaaatcaggtaatgtgattgctcacctgattttttattcttatgaaggcgctttcttatgtagatagttgttacatttggtgttcctgcagggagaacagtcagtggagaattctactcagccatcttgttctgcttcctcaggtcaaatcgggaatgttcttactgccatctgcaatgacgaatcctttccacagggttttccatttactttgcccagatccatcataggaatcactatctatggcagctatagcctcacaaagtgtatttcttaaataataagacttggaagttgaaattattccttgatccatgggctacaggatagatattgtgctagaaggcatgaagacaacattagtcttgtacatctccatctccatcagatatctagggtgactacgtgcattatcaagaagtggtaatactttgaaagaaagccttttttttctgagcagtgggtctcaaaagtgggcttaaaatatcagtaaaactgtactgtaaacagatatggtgccatctgggttttgttgttctatttatagagcacaggtagagttagcataattcttaaaggccttaggatttccagaatgttaaatgaacactgactttaagtcaccagctccatttgcccctaacaagagagttagccttttctctgaagctttcgagccaggcattgacttcttttaagctattaaatttctcaatggcatcttcttccaacatagggctgtttgatctacctctagcctgggcaacaagagcaaaactctgtcaggaaggggagaggaggggaggggaggggagaaggaaggaaggttaaaaggaaagacggaaagaaagagggaaggaaggaaagaggaaggaagggagggagggagggtaaccacttccatcaatgatcttagctagatcttctgcataacttactgcagcttctacttcaacacttgctgcttcaccttgcacttttatgttatggagatggtttgtttccttaaaactcatgaaccaacctctgcctgcttccatcttttcttctgcagttacttctcctccctcagccttcacagaattaaagggagttacgaccttgctccagattaggctttggcttaaaggaatgttgtggctggttggatcttttattcagaccactcaaagtttctctgtatcagcaataaggatgttttgctttcttctcatccatgcattcactggagtattacttttaatttcctttcagaacttttcctttgcattcacaacctggctgtttgtggcacaagaggcctagcttttggcctgttccagcttttgacatgtcttcctcactaagcttaatcatttctagcttttgatttaaagtgagagacatgagatttttttcaattgaacactcagaggccactgtatgaattggcctaatttcaatattgttgtgtctcagcaaataaggaggccagaggagaaggagagagattgggaacattgttggtggagcaatcagaacacatgctacatttatgaattaagattgctgacttctatgggcacagtgtgtggtgccactaattacaatagcaccatcaaaggtcacactgactgtagatcactgtaacaaatataacagtaaagaaaaagtttggaatattgtgagaattaccaaaattatgcagacatataaagtgagcacatgctgttggaaaaatggtgctggtagacttgttctatgcagcaatgccacaatcttcaatttgtaaaaaaaaaaaaaaaaaccaaaaaacaaaaaacaaaacataggatctgtgaaacacactaaaacaagtgcaataaaatgaggtttgcccatatttcatttgcttccacataatttgataaattgctaagtccttctgataaagtatgattgcctgcagaatctttctgccatctactcatcattttattgatttaaaatttttttttcctaaattgaagtttaatcactgtattgatcttctttactttagactgacttcataaacctctaacttatcctttctttttgtcctgaattgctgatcacactgatgaaatatttttaaaaacagacacctaaatttaactttcattttcaagcactatagagttgctacattctgtgatctatacttataatgtaatagctgagaagatctgttgctgttactactcaatttaaaacaatgcactgaatacattttctgcaggatcagacatttctttaagttactaaaaaagattatgtaccctgtcttttaggggaatgatttaagaaaaaaaaattcatatagcaatatttgaatgagttgacattagtttttacaatattttgaccaattaccagttttgcaatttgtataaccagctgttgtttttagattccagctagttttgtgtataaatagagtatttcatgtgccgtttcccctccctttatgtgtctttacacggtagaaaggtttccaaaggcaatggcaattagcggtgctgtctgaggctaacttcccaagcaatttaggcaaacaagattttagcctgaattttccaggtaattgccttgttttgctgctaagggcagtttggggaagagtagcaggactagacgaaaatacattttttaaatctacacactcaatagcagcgtgtgtttgtaactgtcatgttttttgggagataaaaaatgacgccccatggcaacagtatttggctgaaagaccaaaccatctaggttaattaaatatgcaacatttcttctaatacttctaaacatattcaattgttataccactggaaagattttccacttttcacaccgatttctacccccccaactcgagcatcagatttgtatatggatttaacaaaagtacataataacaccaccaccaaaaaccaactgtttcagacgcacagtataccaaccccttaaacgagtcagtgtggcaaaaatatagcctgtagatacaggcaacccagatatttactgactttgaaaagttattaaatttccagaggcctcagttttcccttctgaaaaggggcaataataaatgttttcacgagcttttgttaatgccaactgagataacaccaatatagtcacagcccctaataaatgcccattcctgctttgcagaagttttctttaataatttttaatgtatttatttttttacagacagggtctcactctgtcagccaggctggatgcagtggtgtgatcatagctcactgcagcctcagattcctaagtgatcctcctgcctcagcctccccagtagctaggactacaggcaagcaccaccactctggttaatttttaaatttctttagatatggagtcttgccatattgcccaggctgatcttgaacatctggtctcaaatgatctgtttgccttggcctccaaagtgctgggattacaggcatgatccaccacacccggcttctttatttttaataaatttatcatcacaggttcaaaatgcgctttttaatctttgtaaccattgcatacttctgaatgtaacagctcaagatagtacttctttcactttccatccatgatgtaaaatatactaccttttaactttcctaaatctgcctttttcaagtttcaaataatatccttagattttacaactgaagaaaaaattcttatagccacacttttcatgatttctagacctctttaacaattatcatctcttaaatgcttaggatttctttgccaaagtgaggcagagaatttctaattaaaacccaagtcatttaagtatatgcgaatttttaacagaattaccctagagcaataatttgcaaatgactggggaacacaagggcatgtttaatttgaaagaaaaacatttttaaaggtacgtttgatatgatcagcctattgctcagcaaagaactgctgtttggacatttcacttggctacaaagatgtgaaaggcatgaatcttatagccactgaattgtgttggtctcggtgagctcataatccagggagtgatctgtattagctactgacttgcttccaagtaccatttgaagtgttgatcataatctttaagtacttagagccctgagcaatttagggattgtgtgtctctatgcagtcactgagataagctatttttccccctttccttgcataatggtctagagggcagggtgtgttctttggagggccactgtctgcagattttccaggctgttgatccttttttttttttttccttcttgtagactcgattcttctggtagaatgactccccagtgtggatgcttcaaaaaaaatgactttattgctcttgactcagcttttaaatatcttttaatgtgttttaaattttcatttgcttccttggagtaatccataaactagtctataatttcatcaactgcaataaatcagccatacaagtttcacctgagttgcctgtccttatgtcatatactaggatcttgtatctgcatgtagataacctaagagtttgactggattatggccccaaagacattccagcagaggcacacaggtgacggtgaaaatctcagttcagtaatttaccttgcaacgcatttgttctgcatggagctcttcatggtgatccgggagagactgcgaaagcttctttttgaaagttcgtagtttctccagggaatctgctattcctttctcacatttttcccagtcctatcatgggaataaaaacaaatagcatagatgtttttgatgtaggaaactggggggggaaaagaaaagaaacactcttcttcattcccagagaaagaatgaaagttacactgatggctgagtgtggtggctcacgcgtgtaatcccagcactttgggaggccgaggcgggtggatcactcgaggtcaggagtttgtaaccagtctggccaacatggtgaaaccttgtctctactaaaaacacaaaaattagccaggcatggtggcaggctcctataatcccagctactcagaaggctgaggcaggagaattgcttgaacccaggaggcagaagttgcagtgagctgagatcacaccactgcactccagtctaggcaaaagagcgagactctgtctcaaaaaaaaaaaaaaaaaaaaaaagcaaaaaaaaaaaagaacaaagttgcgctgatgaacaatatgaaggtatgcccacactcattgccaggggaggcaacatgctgttgtcatcagaagagctgagttcaaaactgactctgttactgactatctgtgtggctttaagcagataatgctctatgtttccattttccctacgaaaatggaaaaaatacaaactctccatatttattggagcccaaaggaagcaatgagtgtcaaggcatcaagcacaatgaccagaatattatgggtatccaagaatgttatctgaatccacatctatctgcagaggtaggactataatctcagtaccttgtctctttcttaaccccatccataactacacccaatgtctaccctttcccaaatgtactataagggatttaaaaaaaaaagaggatatggcatgtcttacagaaagagaaatatgcactacaaaagcatggcatttttgactggctttatcttgttcatgctgaaacatatgtagcaaaggattaaatgtgtaatatataaaaacccatgtaaattaagatgtagaagaagagagataatgcacaatttaagaaatctatatctaatatgcaaagtagcagtaagtgctctggagaggaataggccagggcaggtggtagagataggcagtatagaatgaggtagagctctatgtactgacaaaataaaacatctattgtgtggttatgttttgaaaggttacacagcaaactggtaacaatggttacctcttgagaatataggagaatttggatggcacaataagggaaatttcattttttactctgtatagttaaattattacctaatttttaaaaatcagacacacgtaatttttttgtaataaaaaagtagaattttaaaaaatgacaggaaccacagcagagcttgatcttttttatagcaccttatctacacattaactcctatccggtgtcttagtgccagtgaaaattaatttcaactaaacaagtctccttcatgttgtccaacactgcccgtttgtcaaactctccaatccaggccttcctgctccccactcatctccccagtggccactccatacaccgtgaattacagaattccaaagcaagacaactagaatcatgactagaatcacttttagttgtcaatatggtgtcaaatcatgttccatcttccttcacaatatctcttccattatcatcagtcttttcttatctggattatttctacttctctcctgacaccttagtttgagcataacaacccagaggtgttattaccacaactattttctggaagcagtgttgactaaagtgcccccttactcaaaatgtctttattcaaaaactgaactgagaatttggcacaagtctcatttctctttaaaattccttcatagaacttcttagagtgcataaccacattccctcttcccaattaccagaaaaaaaaattcttaaaaaacaaaaaaaaattgtctatcagggacagagttgttcaaattctcctttgttttatgctttgtgttcccagggctacaattagcttatcaatgctaaccatagtgagggtagacaaaaagtttctctttctgcttaaattaaacaacattctcaataaaactatcaaacatcctgaattgatcaacatacagttgataaaaatttattgatctaaaagagataagatcatcacgggtgctgtgacccacacctataatcctagcactttgggaggccaaggaagggcagatcacttgaagccaggagttcgagaccagcctggccaacatggtgaaaacccatctctactaaaaatacaaaaattagccaggcgtggtggcgtgcacctgtaatcccacctacttgagaggctgatgcacgagaatcacttgaacccagaagagtggaggttgcaattagccaagactgcaccacagcactccagcctgggtgacacagggagactctatgtcaaaaaaaaaaaaaagaaaaaaaaacaagaaagaaagataaaaaagatcagcttcttacttttcagaacaaaattaagagatgatagtgaagaaggtgaacatacagagcatggaattataatgcctatatttggcatacttactaacagtattaaaagctaaatatagataagtattatagctggggtaaaaaatagactaaaatgaggctatataaacatcaaaattcagattcataaattccttcttaggcaaacggatgtagtgtaaaagtcaaaataaaataaactttaacaagaacagaagagggattcctctttccaaggatgacttagattctaaatctataaccaagtccttttatgacgtgaattataaggaaataacttaatgtcatgagcctgcaaatatctattaaagtggatgttttctacaccaacaaacagacagacaagaaaagcaaatgtagtgactcagacatcatgccttattaagtcttggaaacatctccaaaaatcacatcacaaatttaaaaaaatatatgattaacatgttctctacaggatgagttacaatgttttaaatcctttcctaaaagcaaaaggaagaaaatgaacctggcatattacattactgatgaaactgtgctgtgtgcaaataatagttttttatagatgtccagtggcatttttgatggattgcttactacacagaaggcaatatattattaaataaaattcaatagaataaatccaatgggtatgtatgcacactttaagcattaaaaaaaaaaagcaaaatcttttctattaaccttagtcattacctttgatccaaacatgtgacaggccaaatttaatagataccctcactgaagtgttggtgattatcaacatatacaggaccataacatttaggtgtctttacttttaaagattgtaataacatcaactatgataatcactatcattcatttagcgctcagtatgagccaggtaaggtaccacatgattcactatcattatttcattaagtcctcacaatggccacatggaggtggtgaaattatatacccactctaccgatgaggaaactgaggcttagataggctaagttaactgggtcacttggtttaccatgattttaacttgagattatcttattttagaggtcctgtcctttttaaactgctcatttaattatgcattatacatgcaattgaagagtgagagagaaaagcatattgtgggaggtccggataaatctacattttccaaaacttactgtgtgatcagtatgtgatctgtatccaactaagggcttaatacacctcctggagattttatctcatggcaacttgcttggatcagctaagataaattaagagtatctttctggattggtttttcccttccataaaagaagagataccaatcttgaaaaccactttagagtctcagattagggagtggaacctaccctttgaatttctgtgtggatttataaagtcatcacatggctaaggtttcatactggtcattaatcagaattcatagcttagacagtcttattagactttactttgttgggaggttgtcctgaaaaattaaatgctgaaaattgggaaacttttccagtttgtgcaagataagacaaagtcttaaataaaacacagagaatcaaaatactgcagggtattatttcatgatctttgcattatttgatttgtagaataacaatgggaggaagtagtacaacgactaaaagggttttttggttcgtttttttctaactgaacttactttcaacaagaaggctagttttttcttctgttcttccagccgcatgctggctgatttccatttctcttggatttcagcgagttcggcctgcaaggcggcctcagcgccactgtccgccgagagaaggagttgcttgccagcctccacagtcaggatgtagctgccttgttgccgcagaaacactttttctttgaactgaaaggaaccatagctttttattttctcattctttctttcatcgtttccttcccataaggatttttaaatggccctaacttttgccctctttcatccagcaagcatttaccgtagtggtgctttgcacatgcatgcaccagtgaataaatgagtgagaatacaatggagacaggcttagtttctgtctccaaggtaagtacgattgatgtaataagataaccactctttaagattgatgcgtggaaatacagagggacatctgacccagcagggggcgcaccaagaggcagagaggcttcctcaaagcagtaaaggctgaatgtgtcttgcgagacatgaacttcaccagattaagaaggacctggtgcggtgagatgagtgtgatcaggagtggaggagaggccaccttctcacagagaaatgaggatgcgcacattcactatatgagaaaaatatgataaattcaggaaactaagtatggttttcagtggctggagtgtggatggcatgtgagagagtggtaggagatgaggccagacgacatcttgcagaaatttggtttttatactaaaagtgactggggttcacagaagaatattgatgttgggattaaagttttcataaaagcactcaggaatcgagtaaaagtagaatggaagaaggatgtgtgttggatatactaagattaggaagctattgtctatctgggcaagaaatcgcgagcacctaaccaaggcagtggcagcagggatgtagagttagggagattagataaggggatgatagacaaggagaagtatagctctcaaattattctaggattcctagactaatggcacttcctggaagtgtgatgggaaagggagaaaagttggtccagagaccacaggttctgctgggacccacagggtacaaggcatctgtgatgcacatagacataaactcacaaggtggttagaaacacaagtcaaaagcacagcaggtaaatatgaccagaagatatgaatatgccccttctctgctggcagggggcagttgaagtcatgtctgcgaatgagggctctcagagaaatttggaggagaaacgaacgaaagaacagtgactttaagggaagaggaactcattggatacactggggagaactcactagagtgataggagatatctctctaagatgctagaagcctgaaggtaaggggcaacctggaaatgaacaaagaactcaaacaggacagggcttcctgtcttctttggaatactcaagttacgtgtttaaattgctcaagaataaaatgtatgcaagcaacatgaagtttttcttcccttgccattaccttttcatccctgctgggatttagtgagctgcggcaggccatagtgtgtgaagtgtaagcagcctttgtgagaggctggggcttactatcatttcaccattagatatgggctttgtattgcaatcattttgtatatttctgttgacatttgagaacaatgtttgtcccagctgcaatgtcactctagagtccttttgaaaaaccgaggcgaaggtaaagtgtgcggtggaaatgcctaagaggtgtgagaacactgtgttttgcatcttacctgcacttcatcaaagagggtccttgcttgttgcagtggtataggaacacttccgagaccactcatggggaggtaggacacttcaaccaaccatttacgaagcttttctgccatctccctatagcgctgccactggcgaatctggctgtcaatgatcccccgcctctgctgggccctgcgaatcactccctgccattgattactgaggagtgtcaatttcaggttgaattcatccctagtgaagaaataattacatggtaaaaaagcactgttatcttggatgcagttacgcaatcagccaatgtatacactgtcaacaaccctaagccctgagaagtgatctagggcggtggtttttgaatatcatgccatgatctcttactgggttttgggtctattgcaattaatttttaaaattaaaccaccagtgtttgcaaatggtgagtgttttcatgtctcagcataggttgaaggcaaatatacaataaggtcattgtccttcactgtctccctgagagcatgagaggggaggagtggacagctgcaggtgcaacgggaatagctgcaaatcctaagcagctccatagcaacatgtgcagctcgtgatgatgatatcatcttgtgggacacactgcaggaaaatgtgtggaacaaggcttatgtagaacctctgtcttcagttcgaatcataagccacttgaatcaaattatgtaatttaaaaagattttttaaaaactgtactccataaactctctcagtattccctcacaataaacagccccaacctttagcaaatcattccagatgttcatctgaattatctcttctacattgtaggctgacttcactttattcttagaaagatgaaaacttgttatcatagtctgtataaatgtcattaatatatttagaaataataaattttacttaagatttctcaagttcaggctaaagtatatcaggtcttctaatgtgttcttacctctctgttttctggctttaaaaaaatataggtagttctttattacgttttatttaatatttaatttatggctctagaactggctagtaagagtctgtcccgcatgaaacagaatgagtttctatgtagattacagtgttattcacacctaaagtgcaagtaatgttgcactttaatactaaacacttgcacttctctattacaatagttttgcttttcttcctcagatatactatcctcttctcttgagggtagcatcaactttgaattggacttgctattgtgaacttgtatcttcttgaaacttcctattatccagaaccactataaactttgattttgtaaccaaatatgctgttagtcctagaaacttatttaatgactcaacttaaacaaaaggtgaataacacccagacaacgtcaacaaaacaagtattaaaaataaaatgtactaagtaaagcctctgcaaaaaatttcgtatgccctctcatcttaaaaatagatccataatgggccgggcccggtgactcacgtctttaatcccagcaccttgggaggccgaggtgggtggatcacctgaggtcaggagtttgagaccagcctggccaacatggcgaaatcccatctctattacaaatacaaaaattagccgggcgtggtggtgcgtgcctgtattcccagctacttgggaggctgagacaggagaatcacttgaacccagaaggtggaggttgcagtgagccgagatagcgccacttcactctagcctgagcgaaagagcaagacgctgtctcaaaaaagaaaaaaaaaaaaaatccatgtgatagctacttagattttgatgatgacttctgtttttgaaaggaaattttgctgtattaatcaatgtactagcattcaagtgtgatgaattaggttcatgatacttccctaaaagttacaagcatctgtcatcgcagaaaatgtacaactccaggacttgagaatatcgtataatcttgctttccctaccaggtaaccatccaaggcctcttaggattccccaccctctcttgatacaaccaagctgtcccaaactacctgccagcatgaggaattacttaaaacatgacactgttccctgtgctgaacttgaagctctaaaaaacgtaactcataaattaactttcagaacaaaatacacttgcaatctgaggccttcttattgtcagtaggctctaatctgatttttttttcccttcaactttcaaaattctttaccctcaagtctaacctcccattttcatctctttggtgtattttccctaaatgttagtattgaaaagttaatagatgctggcttgcatgtgagtatttaatttttattttacttaatgactcaaacatttataatattgttatagagttggctaagaaatgataaagcaaaagataaaagttaattgtatttgaatttgttttattttcaaggccttaaattctcaggaaagctcccatttaagtttggcttacttagagtagaataaatataatatcacattctgttgttccaagcttaaccatgaagatcttttatgtacttccaaagaaatagccacttaaaactgaaattgcttctacaacattaaagacaaaactctcaataaaaataatttattttttattttttgaaaaaatatcaaattaattttagtcacaactactggttcctaaatatgagaaaggtatacatatgtaatagaacacatgaggctaatactccaaatatcaccacggaaagtcgattagataaagtaaatattgttcctaggaaatgtaaatatagtatgaaattgtcatttctcataccataaatctggggagaagctaaatttttacctctccatttttaataaagagataatttgctattgtaaatgaaaaggaagaaaagatttcaggcggcatgtaatctgacttaaggtagcaaaccattttcaaacacagaattctcatggcatgagaaagctggctggtatgatccagtactgactgaaaaccagacatgagctccaggcctgattctgctgctacttagttctgtgaccctggtcaaatcagttcacatttgtggattttgggtttttcatctgtaagtaagagagatgggctagtgatctctatgctccttttacaaaaaaatttctgtaattatataagaatattagaagcatctgtttacaaaccgttgataggtcattgatatggttcatgctgatctattcattaattccatttcctacagatgactagtgaaggttggctaggtgatttccaattactctatgcccttcatataatataatagcagctctccaaaaaagattcaatactcattcatttcagagattgagacaagtttctcctccaattactgaggccccactacagttcaattgcctcaggaagattggatatatgccctccaatctgctcattaaaaagaaaatgactaatttactggaacctttctttgtaataatttatcaaagatcctacctgtcatcaacttgaccttgttctagaagacgttgcccatcaataatgattgagtgcaaaatctgctgacgactgaacatctcggcttgaaacaactataatttaaaaaaaagaagaacatactttagagttcctaattttagtgatcggttctctgataactttccaaatattctagttttcgcaagactatgaaagctatcaccagctgaaccagaaaatgtgtgaaatcctgcagtttaggaatcatttatttttaaatcatcaattaagatacactcaaagataaagtttagtgtttggtttactaaaactagatgaccaaaagtagaattatatttctcttctttctttcaaaaacacctaataaagtaagttaatgcacaatttgttttctggtttattttgtatataaaatatggtccatattcaaaacttagagaatagcttaggaccgttaaagaagtcaaagaaaaaaaatagcctagtctttttctgtcttttaaaactcactgtttttaagttttaaattttaaaattaataaattttaataaatttatttcactattttaaaaaactcaagagaaggtccttcgaattatttctactgttttttaaacaactttattgagtaacaattcacataccatacaattcactcatttaaaatgttcaatttagtggtgtttattatatttacagactttacaatcattaccacaatcaattttagaattttcattgccccaaaaagaaagtccatcctcattagcaatcattccccatttcttcccaatcctccagccttcagcaaccactcatctattttatgtctctatgaattacttactctggacatttcttgtaaatggaatcttgcgatatgtagtcttttgtgactggtttctttcccttggcataatgtttccaaggttcatacatgttgcaacatatatcagtaccttattcctttttattgcaaatagtattctattatatagacatttcacattttatttatccatttatcagttgatggacatttgggttgtctccaccttttggctattatgactaatgctcctataaataatgtacttacacaagtttttgtgtggacacatattttcatttatcctgagtatatacctaggagtggaatttctgggttatatgattactctacgtaactctatatggtaactctatgttaactgttttccaaagcagcttcaccattttacattcccatcagcaatgtattagggttccaattcctttacaccctcaccaaaatttgttattttttcattatagtcatccttgtgggtgtgagatgcaatctcattgtagtcttttttctattatttcatcatctgtcaattcaacaaaactggatttaaaaataccttagatatctttaaattttctatttaaaaaattctgaattaagtttttcttttctcttaggtaagacctatctctccatgtgcatatcattcataaatacacaaactgacttagttataccggtaaatagcaacataaggattaacagtgggcaaatttattaatttactttgtgtatatagttcttctccctctttgtttcttaagaaataattataatgcaatttaatcaagaggtacacctggagacatttgatagattgatttcctggtataaaattcatatacgctctttgaagatcacaaaatttttaaagacttttgatcaaagcatagtctcttaagcaattgtccttggcatattaaagtagtctctaacccagtttgaaaattgtctaactatctatacacgttccaccaactttgcctgtctcgagtaagtagcctttaaccacaattctggcattatactttacaaggaactgaagattgacacgtgcttataaacaatcatggagcagcgaataggactacatttttataattaagttatcaaaacctcaagcttaagaaagaaggcaaaatgatgcatgcatttagacactcgtgcaaagggcatgattttaattctcccacacagcatttcgtagcatcttctaagggcctaaaaatttcttattacccccaaatctactgatacaacttacctcgtgtgctctctgctgttccaaaaggtgctgataatttcctgaaatctctactgctaacttttgttctgtctgaactaggaattccatccatgtttcacatttttccaagaaagtctgatgttgtagcaaaaatgactgcaacttgctgaaagaacaaagggcaaggaacaatggttatttcactgcttattcttacttctctagcatataaaactagattaaataatctctgtgctcaattctaattgaaccaccacaaagctttcatgtcaggtggtaaaattattttaaaaaagaagaaagaggccagttgcagtggctcacgcctgtaatcccaacactttgggagactgaggtggacagatcacctgaggtcaggagttgtagaccagcctggtcaacatggtgaaaccccatctctactaaaaatacaaaaattagccgggtgtggtggtgtgtgactgtaatcccagctacttgggatgctgagacaggagaattgcttgaacccaacattgcagtgagccgagattgtgcctttgcactccagcctgggtgacaagaatgaaactccgtctcaaaaaaaaaaaaaaaaagaagaaagaaagttgaaaaaatgtagaagtttaaaatgtacctcttttaaaatgataaaaattatgtatatacttttaatatattctcacttaaaagagttttctgattaaagtgctatttagtacactaaacatgagaaacgactttacaatttgaatttcccacttttagttcaaattttgtcagtgttatgggaaagatcagaatttataaacatacacaagtcatgagcttatattctattgatacattggtgctatggtgtgaatgtatcccttccataattcaggtgatgaaacttcgtggtgaatgttggtagtattctgaggcagagcctttacacggtgattaggccatgaggactcctcctttgtcaatgggattaagggtcttttaaaagaagattcacacagcgttcagcactgttgtccttctgccttccactgtgtgaggacacagcaactctcccctcctgaggatgcagcaaaacctgccctcttgaaagcagagagcagccctcaccagacaactgaatctgctagcaccttgactgcggacttcccagtctccagaactgtgagactgttcaacatttctgttctttataaattatgcattctgtagtattttgacatagcggcacaaaccagactaagacaactggagcaaccaagacatctcttgtttactctacctgaatctttctgtagtctgagaggagatcagagaccaatggcggttcagattctgcattcttttgatttccttatcattcaagggtaacctatatccaagctcatttagacggtctaaatctggagccatgctgctgaattttaacatctgtccctagaaggaagatttaaaagtaggtttagcaccatggtcaaaaaagtcaaaactttttcaaagtgcgcagtgaatttctgatttcaggaagtagctggtcttcggtctagtggcctctgcatttctaggccacttacttacaatctctaggtacgaatagcgaaaagccaaatctacttttcagtctaaactgctgctgctgctgctattgctactcaagctactcattatcctttatggactacttaacgtgtattctgttatttacttgatatattatttacttgtatggtttatacatacaaatatattatttactttatttacacgtattatattatttacttgatttttattacgtgtattatattacatatactatttacttgatttactcatatgtaattatattacaagtattatattatttacttgatttatttactcataggcaattcttgacagaactgattaaggatgaaaattatgctgataagtaaaagaccttacttcttaccatttacgtttaatttgttcatgctaatttcctcctttattattcacaactaacaaaagttataacagtgatagctaacgtttattgagcacttactatgaatcaagcactgacaagagctttacaagtaagaactcattttatcctcaaaacgatcacataagataagtcatgctgctattctctctttacaagggaggaaagggaggcacagaaactaagtaaattgctccaggccagccagctagtaaatggaagagggtaaacgaacctccttgggttcttgctagagaaaataagatttcacttgagctatgaagtgaccacacattttaagagctccagttttaggtctctgacccgccaccccacagctggtgagactcaatcaaaagagcaatctattcttttggatctcttccctcccttcaaacacaggacaatgttgtcggttctgattttcccatgggtatccttatctccatctaggaaattggttacaggaaagaaaaaatgtcaggccacctttggctatgtgtgtgtcttctctttgcatgttctgcaaaagactcatgttttttgaagaaagaataaatctcaaatattgaaaccaaaatataactgttaaatggcataatgtccatgggtagacatcagcaatgaacaaaatagccatgacacagtccttcccctcgtggcacttacagggaataagatactattctagtagtcaaaagtgcaacagtagtcccctactcacaggaatgtaattaaatgacatgatagagcatggaagaaaaacaatagtgtgctatgaaaatgtgtcactggggggcctggtcctggacagacagtggagactttcctaagagagtgacattgaacaaaatgaccaggactttactctttttagtgaggagtgagctgacgaggacaagaaaacaaatccagagagaggaaatatcacgggcacagtggcacgggagtggctggagggagagagtggctatggtgcaacagaataagatcctcaggaaaggtggaaccaggatgccgccttgagaagccacatggtcttttccctaagagcagtgggaaaccttgagagctttaaccaagggaataatacaataaaattttcatgcctgttgaattattttgcttacttgattgaatatttaaaatcattcacaattggcagggcacagtggctcatgcctgtaatcccagtgctttgggaggccaaggagggcggatcacaaggtcaggagttcgagaccagcctggccaacatagtgaaccacccccctctccatctctactaaaaatacaaaaattagcagggcatggtggcacatgcctgtagtcccagctatttgggaggctgaggcaggagaattgcttgaaactgggaggcaggggttgcagtgagccgagatcgtgccactgcactccagcctgcgcaatagagcaagactctatctcaaaaaaaaaaaaaattcacaactaagtaaaacctttttttttttttttttttaaaaaagtattacattaggcctgtaatcccagcactttgggaggctgaggcgggcagatcacaaggtcaggagattgagaccatcctggctaacatgatgaaaccccgtctctactaaaaatacaaaaaaaattagccaggcgtggtggacagtacctgcagtcctaactactcgggaggctgaggcaagagaatggcgtgaacctgggagggagagcttgcagtgagccgagattgcaccactgcactccagcctgggcgacaaagcaagactccgtcacaaaaaaaaaaaaagaaaaaaaaattattaaattatttttgatggacaaattataatcgtatatatttatggagtatgatatgatgttttcacacaatgtggaatgattaaatcaagctaattaagtaaaacccttaaaaagaacaaaaaaggtcattctgacagccaggaggaggggaggttgggtgaatggatgcagatctgtgggaggcggctgtagggtctcagagagataggagtagattgagctaggagtagatgatgttagaaacagagacgagaggttcaaaagttaatagagaggtgatggactgggtacaggaacatggagagggaccagccgtggaaaggaggagtgaggtggtttccagcggtggaaagagggaggagtgaggtggcttccaggagtgagctgggaaatcagcctgtgcccactgccagcacacagtctactgtttgccagagaaagtctcactgggggctcactcgaaagaaagagtgggtctacatcagctttgagtttcacttaagattttgaaaacagggctgggtgtggttgctcattcctgtaattccagcattttgggaggcctgacctcgggtgatcagttcaagaccagtgaaacctcgtctctactaaaaatacaaaaactagccaggagtggtggcgtgcccctataatcctagctactcgggaggatgaggcagaatcgcttgaacccggaaagcagaggttgcagtgagccgagatcacaccacggcactccagcttgggcgacagagtgagactccatctcaaaaaaaaaaagatttttgaagacagatggtaaaagatctgggactcagatttgaacacacttaccttaagttcttccatcctttcctggattgtggagaggtcagatgagtggctagggtcctgcccttgtagtatttcttcagcttccactatccaggcctccaaagcttctaaactcttggcaaaggtttcataatcaagaactccagcctttttttccacaaaagaaattggtatttcagttaaaaaaaaaaaaattggtattttaataaagtctggtaaaagggcaagtggatattaaaattatttttcatattcttgtatcaaattgccattctctagacgttcctataaaaaaagctataacaatttaaatcttctttatgtaatttttctaaaaactataattatttctatgcaccataagtcaataacaattcaaattattctttaaatacatgatcaaacaacacgtctgaaaaatcttctgattcttgtaaaagtctgagttaaataaacacgaatatttatattaaagccgcttagtgtttattaattgaacaggccatggtggcaggcattggttcaggggcttgcatcttaaaccgattttaaaattccttggcagagaacagcgcaaaacgtccaccttcatcgtccccaccagaacttccaagtttgtttacttgctattttcttgagtcttgaaggaggcattgttgccatgacaaggaattctttttctgtgtttgtgcccagatattagagaacagccaatatacagaagatactaaataggagctctgtacctgtaatgaagtctgctgtttgcagagagcttgctccagggcacacaagtgttgactcaaagagagttgatccgattgaatagctgatgctgcggaagcatccacttgttgcttcagttgctctcccagctcatggagaaaaaagagggaatctttaactgtgcccagtcctttgaggaggtcctagaagaggtgaaaatatgcccactctgaagcatgttgatactccttatcataaacagcaatcggcaaagggctacacatgtagaaacacaccattcctacggatcatattattaggctaaataaacttcacctgtggaaaaatgaacacgcactgaaccccattttttaaaatgctatgttaatattttaaacatacattatacacatataacctatggctatatataattactcttttgttagtaaaagctatgtaggttcattacaggaccttggggaaatgcagaaaaacatacataaacaagaaaaaaaaaaaaaacaaacatgacccaagagtagagccaataactggaaatattttggcagtttttttcctgcctctttatgtaatttgtatcaaattgaaaacaaaatgttatatttttcctttttctattattatcatacacaccaggaatttgtccgtggtgtcttctatatgtgtggtcacattattgcaagtacagcaacctcctatctcagtagggtacagaacacagtgatgattttggtgagcagggggtgagagtagcctgtattcccattcttttccatgggatctctttgcctccactttctgtgggaccctcctacaggttaaaaaatataagccaatggaaactccctgtttctgctttctatcctatcattgagagataataagtgactgcttcttctacctgttgctggtatcccactcagtcatgttatgcctaggcagtgacttctgtgagagaaagaagaacaaagggctctttacgcttgacacagataacagacaaggtgtatttcaattcaggagtattgaaaatgacagttcttgtacacacaaattatgtggatgaaaaaagcactgtattatctttattttaaaatacccatctttagctttaaagtgattattcaggttgaagatattagaataggttaaacttttatttacatagtttttatagcttgcctaattctaataaactgatttggaaaagtttataaaaagatcctcgtaacaagctcttaaaaataaagacaaataaggacaaatagtaagagccatgtaatgcttgaaacaagagaagagctgttccttaaacccttaagtaggttattggcagctacagtgaaaaagagaattattaaaaagccattaaaagaagtataccagtaaattaggagagaaagacttctttctaccattaatatcttagatgaaactattgtgtagatgcttacataggagttaatgaatgtaaatggacaacatctggaacagaagattttttaaagatagaacactattccccatatggtcatgtcttatattgaccaccctagaaaacacaaagagcctcaatctttcacattgactaaattccactaggaaaaatgggaaaacaactcattttaaaaaataaaacaatgggaggagacctcttagtctgatgcatgtgcacctgtgttctgaaaatcaggcaggctctttgatcctaagacagttatttttgggtaactgtctcacatagaaagacataccaaagcttacacagaccaaaagctaaacttgggcagtctaagaagggcatgtggggaaaacaaggtagctcctgaacatacgttgcaatcttgaatccatgtggcaacctcatcatcggcaatgtccttgtttgtggctgccttcaacagctcattggttcgatcctcctgctgctgaactgtcgaagcacactgtttggagtagtccttgtatctttgccaaagctgaagtagggccttgctggactgtagctgctcagcaatctcttccagcaagttattccatctggaaataataaccaacactcatgagcagattaccacctctcaccaaatgtggatatgtgctattttatttttcatgatcctggttcatgtgaatatagacataatcatttctagttaacataataaaaattaatgtttcatattcctagtttcagggtaggtaatgaggatgatggcaatctttgggtgtacagtacttctaattctttctaaatctcttcactacatttatttatccttaaattcatgttgtgaaagagaagtttaaaggaatagaatctatatagctcaaattcaaactgtcattgttttaattatatcattatttataataaggctgtgatataaatagtgtgtaaagttaacatactccatacctcatgttgacttctttcagtgtattggtaagagtttctgtcacgggtgggtgacactcttttaataattggttggtgatagagccaaatttctgtaagctcctttcctgtttttccagatcatcttggagattctgccccaaaaaaaagacccatagatgacataacaggatctaaattctaataagcaagtttaaaaggaatttgtatatgttttcataaatatgtacatatacttgtataaaccaggcatgacttagcaccaatgctttatcagctttctttagataatcatttattctcttttgtaggattttgttattttggctatgagaagaggttctgagcaatgaagccttcttctattggcatttgcattctgctgaaaaactcacatagggtgcccttgtccattgtctggtaggaagctgccagagatggtaaattcctcttcaaagggtttaattgtgtaatgtccttgtccttggttcagaggcctcacctccttgtactttcttgtttctggcctgtgagcagccctcctgctcttgttgtgtcctgacttgcccagacatgtccaaacttgccttgtgctgtaacacagggaccactcctacccctccctcccttgagaatcacatatttaccctaattggaaaagtttaagtcttagccaactgaggtcagtttagattgagtggtccaaccctagccaacaggggaaggatgcagggatagggactgcgttagggataaaaactccttctctcctttgttcagtgtgctcttgcagcagccagaagtgtgagtggcaccctcctgcagaagtaaatttgccttgctgagaaatcctttaagtgctcattttccttgctaccccaagctcttgtttctaacaaagccatggcaatggtgttatgtaacgtgctatctgccaaactgtggatctctttgacactcaaagccaaagccaggtctctattttgttacatacccgcagtgcttctaccacaaactcccgaagatgaagactctaagaaggcacagctttgccaagctttatctctgggtgttcttccttgccaagaattatttttaacttaaaaaaatgattttcaattgacaaataataattgtatgtatttgtagggtactatatgatgttttgatatatgtttacattgtggaatgaataaattaagataattaacatatcattacctcacatacttatccatttttgtctagcaaagttgaactcatagaagtagagagtagaatggtagttaccagggcatgggataagggattagatggggaaaagaaagatgttgatcaaaaggaacatagtttcagctacacaggagggataagctttagtgatccaccgtacagaatggagactataattaataataatgcactgtatatgtcaagattgcttaaagcaaagaatatttatcagacaggtttggcatcttctaccaagcctatctaaatagtctgctaccaaggaccagtaagggaactgaaagaaagttgtttctctggaaatagtgctgaggtgacagactcagttcttcataaaactccacaggtgaagtaggctacaaaaatcgagtactgtttaacaccaatatctgattaccctcaaatgaaaacagtcaaggaaaagacccttaatcctttcatgtcttaagacagctcttgcaagtattaaacataacatatattaaattaaaaagcatttctaacctcctcaaagttataagatgtgcttttaaatttactatcctcagaagaagttttcgtgatccttagtaacgacaatttaagggttaagaaattatatagacaaatttgtccttcctctcttccaccctaccctaaaaaaaatatttccttaagaaagtcggccgggcatggtggctcatgcctgtaatcccagcactttgggaggctgaggcatgtggatcatgaggtcaggagttcaagaccagcctggccaagatggtgaaactccatctctactaaaaatacaaaaattagccaggcatggaggcacatgccgtaatcccagctactcaggaggctgaggcagagaattgcttaaacccgggaggcggaggttgcagtgagccgagatagcaccactgcactccagtctgggcgacagagcgagactctgtctcaaaaaggaaggaggggaggggagggaaggagaggggaagggaggggagaagaggggaggagaggaaggcaggctgcatctgaggtcagcaacatagaagctttgattggctggccagggaggcggactagatattagcagggcacatgctggtctcttgttggcctcccatcccttaggggcctgccctgcccatcccatagtctgtgttctttagccaagaagaaagagcagtgacaggtgagagtggcccggtgcacaggagagtgggggcagcaggaatttgagggcggtgacctgagacaggagagagtgctatgttgaagacaaacatcagggatatcattttacatggacacaatgacaaaggacccacaggaaaccaagcagtaagtgctagaaaggaagattctgtggacacgctggataggccactgatattttactgaatggaagcaactgaatggtttaaacatttaccacttttgccgtttttctctgtgttttcttttgaacattccttagaatatgtttggagatgcagataagaagagaaaaggaagacaaaaggcagtgacaatgaatcaaggaggttcagttgggcataaaatcattgtataaaagacgatgtgaatatttttttacaacaggatcttggaaaccatttagttatataccagctaatccagaatttggcacacacaggcaagtttgctcaagtaacaataacacaggtaaaattaattttaaagatcttaaaaaataattaaacgtaaacaacatatggcaatatttcaggatgatgtctccatttggtaatttttcagttttctaaaattaaaatgaacgttaaggatgtgttaaattaattccttacctgaagattgtccacctgaacttgcacagcttctaaggagccagtcagcagacggaatcgggaaagagagtatctggcctccatgaggtaactgtttatcttgtcaaaggccactttgtgactactccattggtcaagcactgatttcagcagtatctttaattgtccaaccttttgaaaaagacaaatatggcttataatttcataatatctagaatgatggaatatatattcaattgatgggaaaatattaacatctaagaacttcatcagggtttcaggtatcataaacaaacaaaactaaaaagaaaaagatttaaaaggtaaaatgtatcaactttgaaatttatgccttccacactttaaacactcagttctaagtggaaatgcttaaaagggtaactgataaatatatatatatatgtatatatatacatatatacatatgtatacacatatatatgtgtatatatatatacatatatgtatatatatttttaagttataagaggttgatacttttaataaaacagtttaagaattgtattaaatgagtgtttcaaatgcattaactcatttaatcctcacaacaccttatgagataggtatgatcattatccccattttatagatgaggaaactgagacactaagaggtaatgaaaattacccaagattatactgctagaatgtgagaaatttcaatttgaatacaggtagtcaggtcccagaaagtgaaatctatctatagctataacaatatccatatctatctcacatatgcgcaaacacacacacacacacacacacgcacacacacacacacactcagataaatatcttaagacaaaacatctaagatattccttcctcataattatttatctctgtcagaaaagtgtttagcttggtttgcatcacttagatacagatatccactttgtatatcttttgccaggctggagacagatgtttgagaatgatctattgccatgggaatggatgagatcattaagagagtaatgtttaaaataaaggcttattctagaaaacaccagaaactagactttaaaaaaaaaaaagaggataacgaagtggacttaaaagtacaaggagataatgtatagatttgattatttcctctgctactttaggaaaaccaaaacccagagtttggacagagctggcaaacacggtcctggagctggctttctgtgagcaatattaccatgtgatctaaatttgcccaggtttggccgagctctcgcagtgtgctcatgacaatgctagagacgtcttctttcttgttctgaatcaaagcaagtccattctgctcaattttctctacttctttttcttttgctttaatcaaatcttccagatcctgaaagatttaaaaaatagtcactttaaattgttctattatggaactctggggtgcactgaaattgggccattatagtttcatgtcctaaaaaccttttactaatccaaaaagcttatctctttcagaagaggcacgctgcagaagtacttcttcctacactcaaatgcaaaaaaaaagtcatctttttacacatggcaaattagcataactttaaaaaagtaaaatttgatattctaccagataaggaaatggtactatgtaattttctcaagaggctgtgaggaaagaaatacatgtcagaaactgtaatattatttatattattaagttcatatatgttggtattcaaaaagttacgctgcctacctcataggaagaaatgtgatcgaatgtggtattctgggccctagtatctgagatttagtcacatttctactactcacctacccaaagctgagtcactttgggtaggtgagaaatttctactgggtctcagtttcttcagatgggaaatcagaagactgacttcagatgggaaaagatcatctgtatgatcctctctctctaaaatactctgaattctatgtgattctgaaaggcttcaggcttctttgatgaatcaaatcctcattttatttgggatatgcattcataattgtcagtataaaatgttcaagaatgaaaagcaaaatgaagaaaagatctggagctcatactgaacctgtatcataaccctaatttctattttaatgccatctgaaaatttgagaagctcagtgaagcagactgagactgctatcaacattttataaataaataaattgaagatcaagtcatccgacctgtcttgggtaaaagagctggtgagggatggagtggggattagaacccagtctttggagcctatggactcccagcctgatgccagaaggagtcggctgaacctcagactgtggagggaatataaatcccatgttggggtgatatgaaaagccaggcattaaggcatggttacagtcccatattcagaagtataccctcagaactaaaagcagatttgtagttcttggagattcgaatggagaaaattcccaaatactttaactttggataacacctcaattgtataaaaaatattttcacccccctcatgatccatacatgagtaataagattgaaattggatagtgctgctgataaggtgttaatgaggagtccagtctctgttatattaatttcaaatgtcatgcctctttaaaaataatttttgcctcttttatttctgtttctattatggttcaacttgttaatctctctctacctcatttttaaaatagtaataataagacattttctccttactccaaggagataaaattaggtaaatatatataaaatatattttaagctgtcaaaaagtagctaaatgcaagatattattatgtttagccatttggcaatgtgccatgtttcagtgcaaatttatttatttttctctattgaattatcatgaagctatttttgttttggttaattagttagacactcacgcatttggcagcttaaagtgatcatttttgtttttcatattgttctcttatttccactctataattttgtcactattttgacagctttgataattaccagagaataaatatagtgattgctggggttacaggtcctttgtgtagtataggaaatataattaatttactatttagaacttttctatttctgtaaagagattaaaagaccagaaacaatccttccaatatgtctttaatatgattctaaaattcaacaattagaaattgagtttatcctcatttttctatgatgttaactttttctcagtgaggaatattaaatgaatgttccattgcttagaaactatttctaaaatgccctgcacacgtatgttggtagaagagcaaaacccatgagggaaacagggctgaaatatatattttataaaaaataaaggtgtgtttcccttgctttcaataataattaaaagatgattctgtttctgatcaaaaaggggaaaggccaaacctaccatttttaaaaacaataaaacattcttaacttcgattaattcataaatatcagttttatgttggtttaaattaataaatcacctataaaagactgggaaaatactcaagatttttaaaacaaaataaagctggaatccagtcaccaatttaagtatactggcttgaatttcacactttggtccaaaaaacaatttctcaaaaatgacagttgtatcaagacctgtagtatagccaaatagaaccttccagttaggccattgtgatttatttatatgcgttgtcccaaaataattatatgggctactttcattctgtcttttgtttcaaagatatgacttttcatttgaaatcatgaaccggcatcagtacaaagttctttcaaccacactttaagctttccctcctgacactgtctgacctggctctctgaaagactaaaacttaggtcctacacttggtaaaacatggtcaagctgctgctatattttccagatggtaaggtgtctccctgttaaatagaagaaatgaacaggagaagaaacaaaatggaaaatggcagaaaaagctatgttaaagagaagaaaaaaatactaagagagagaaaaagtaaagtatggaagaaaagaagtggaaaaaataaaagaaaatgcaaatggtattaatgtggtatttcagtctttcaacagtaaagtttatcacaaccatgcaaccagaaggtcctcactttgctaattctaatacgcagaattacctttcaaaatcaatggatatgttttaatttaggaactcaacaaaagttatgacattttgtcctcagaagtaaagagctgaaattctggattacttgtagatttttgaatttatggcctaaatcagaaataccactggcctctagaaagttggaaatgcaatgagactagctgaggcatgttcttcaacttcagtctttaagcacccattttctgatgtgaggcttttttttattaaataaaaaaactattattacttcaaggtattctctatacgatgtttttctttatcaattttatgcagtctcaaaattgtaatccattagctggggagccagcacttctcttccttttcagaaccgaaaagctttgattaagtgcttaaatatacctctctttatatgtgtcccaaacagaaaacataatgattggaagagagatcattaccaaagttctttctttctgaaacccgaaatagaaaaacaagatttgcagagagaagcttttctgtagaattacttcactgtttagttttcaattgtttttaggaaacactataagggaacagtcataatctgtaacaatatatgaattcatgaattattttcaaaaatcttattactgtattaactgcaatagctcacttttcttttgggcacacaagaagacctgtggaaagactgtgtgtccctgagtcactggaaaacatttggaacgttactgcttcacctgaactttcaatccgcatccctcagagtagaacaagcacactctgtgtacttctccatgtgacaaaaaaggaagtaacatggatacttcctattaattaataatgggatattattaataattaattaataggaattccactgtgaagtgcttgttcagaggaggtgaacgggaatccaactaagcctctagtgctaacttccatttataggacatacagaggagagaagaacaaattaaacatcttaaggacattcataggccaatcctgaacatggcacccatcaacagcttctgcgacaggttatggtcttaaaaaaatattcaaaagatttaagagatctaacaagcaaatgtagcatatgcatattgtttgcatccttattttgaataagttaacatataaaagaaattttaaagacaaccgaggaaataggattatgcgttgaacataaaataatattagaaattattaaacttttggtggtgataataatatggatgcattaagaaaatgtctatttttcaaagatatatattgtatgtaagaataaagtgacatgatgtctggtatttactatgatatctattttagaaaaagaaataatttaggcaattttttttttcttggaaacagggtctcactctgtcacccaggctgaagtgccatggtgtaaacatggcttactgcagcctcgatctcctgaattcaagcaatcctcccacctcagcctcctgagtagctgggactacagggacaagcaccaccacgtctggctgatttttgtagctttttgtagagagagggtttcaccatgttgcccaggctgcaaatcttgacaattattaaatctgatgctcagtatacagggttcatagcatttctctctacttacgagtatgtttgaaaattttcataatttcaaatttttaaaaacgagtgaaaaaaacctaatgtattttaaaaaaaaccctataaactcacaaaatcagcaaaatttgttactaaatgcaacttttaaatatttaaaaaaatatttaacttgcaactctcaaggcctataaacatattagcatacgctatgaaattgtgagatggtgcatgttagccacctggacaagttacctgacagtctttcagtgcattttgaacagaagcctgatctccaattcgatgctgttgttttagtctcttttcctgggtttcaaaccatgttttcagacattgtacattattttcatattctgaccaagattccaataagccttccaacagctggatctgaacaaacacaataaaatgaaatttgcaactttattttaataaaatcaaatcattagcagactaattattctagccagtattttctccaaattaagaattcttaaaatacagttcatcgtatatatgatttaaaacaggggtgtctaatcttttggcttccctgggccacactggaagaagaagaattgtcttgagccacacataaaataaacgaacactaacaatagccgacgatctaaaaaaaaaaaaaattgcaaaagaatctcataatgttttaagaaagtttacggatttgtgttgggctgcattcaaggccgtcctgggccgcatgcagcccgcgggctgggcaagcttgatttaataaatgaatttcataaagtatgaatcaatgactattactgggaagcaagaaaggactaaagtcaacttgaagcaaaggcaaaataaatcaagaggcatctttagaaaactgaaacaccataaaatatacaaagagcagagaatgtataagagaaaatcatcaacaggttaaaggaagtttagggtgattaaccttcagcggtattattggaagcgttctttgcccagtatagccacgctacttgtgaacccagtcttccttacagagtgtgcctgttcttggggttttcatgtaaatctggacagtgggaagccactggcttaccttctcagttactagaccttgcagaatttgccaacttttattcattgctccaagttgctcagcaaaatcagtcttatcactacgcttactttccacatcctgactgctgatttgtagcacggactggttcacaaaatccactgtcagctgtttacagttaatgtctatcttaaaaccctaaaaaaaaagaggagaaaataagattatacaataaatgtctcattagttttccaggagttggaaagccttaagtaaccttaatattaatattatcacttccataactcagctgaaatggcacaatttgtctgtgttcacacaacccattatttttagaagccgaatatatatttgtatacgtttatatgaacataaacacagatatacgtgtgtatgtgtgtgtgtgtgtgtgtatatatatatttaggtagaagatttagaactagataaattatataacctcactataaaatatttataaatttatttttataatttctgtaattctttaataacacaaaattattcaaaatcattcctagtactggatatttcttcttatttctataactgataatgcatttttcttgctattgaattcctatctggtcactgtgtaggaaacatacattccaagacttgattaccataatttgagttttttagttctttcaaataaaatggtctgaaaatatgaaaagttaaaaacaaaaaattttaattaccttatatttctgaaggtattcatgaattgccttgtaacctatggaatttttaatattatcttcatccttctgaataacattttccattagagaaatccaactcatgacttcagaaatggcatggcgggaaggcagtttatccatctggagctgtccaagtcagggagagaaccagtcccaagtgttaaaatggaaaccccaacttctgctaacttaaaaaccctacaataattcttaaaaatgtaccaagagagataacactccttaatgacatttggagatcttaccctttctgaaagcttgaagttaaacatcaggcaaatgttgaggaataatagtcattttatgttcacttgatatccaatactgtaaacactgtataaacattaactaattaatcaaagcaccagaaagaagagaatattattcttattttataactagttttatgagtctaaaaaaacttaaccagaaaacattcaacagatgtattttattaattatcttgtaaaatctctgcatattatgactcaggaatgttaaaagaagaaagaaaaataccacactacaagctatcattttctagagtttttggcactctaatctttattcctaagaacatagccaatttcctcagcccttagctgatatacactacttacaattcgaaatcttacttaacatatcacacatttatgcatatgtgtattacgatgatttggaggaacaaaagcaatcatttaaaatctttgtatatcaacttctgtgtggtgctgaaagatatagcaatgaacgtgggttggttcctgccctctgggggcgcacagctgttgcttaggagagattaggcatgtacacaaaacacagctatcctgcctgaaacacagtgatgagtgtcaaagagagataaagataaaatgttctgggatttcaggggaggtgggtgtattttcagataagaggattatttacatctactgaatgccagttgctctcctatacataagatatttttaacatatattacgttctaaatcttcataaccactcactttatgagaaaagtgtatgtaactgtccacattttatctgagacaaaacagagtttaaacaaagccagacaaacattccaatacacatacccacacccacatacacacattaaagaaaccctcagaggaaatgcctttggggcagggctttgtagcgtagttcactcttttttttttttctggagacagtctcactgtcacccaggctggagtgcagtggcgcgatctcggctcactccatctgcctccccagttcaaacaattctgctgcctcagcctcccgagtagctgggactacaggcgcacaccgccacgccaggctaattttttgtattttagtagagacggggtttcaccgtgttgcccaggctggtcttgaactcctgagctcaggcaatccaccctcctcagcctccctaagtgctaggattacaggtgcgagccaccgcgcccggccagagttcactcttaatattaatacaacgggagagagaagaggccaggtgtctgggacaaagctgatataaatttgtgagcaaaagcaaattaatgtatttctccatgtcaaatagcttaagtcagctatttcccacgaaagcaatcctttctgtacctggtggagcttctcctggacggctgggatattggttagcaggtcagtccactggctatcaatgcgcgacagctcagagcgcagcgtggctgtgtccaccttttttagtcgaaggagctgatttccagtactcagaacagatgatttcagggaagattgggcatccacttctttagaaaactcctgaaacaagtagcgatgttcaaattagggttaaatagctagaccattcattaaaaggaaagcgaccaatttagtgcatgaaacaatttcctttacatcctggagggggttatgctgaacactcaaaagaaaatgaaagcagtacacccttgccctcgaatgaaaggaaactacgaagccccgacttgagaactacttgtaagaggcagtgttgagtcactgagccctattactttgcataattatggaacacacatagtcaacattaatatattctctatagcttagtttattaagtatatccactgatggttgacttcctttcttttcttttctttttttctttttagatggagtcgctcgctctgttgcccaggctggagtgcagtggcacaatctcagctcgctgcaatctctgccttccgggttcaagcgattctcctgcctcagcctcctgagtagctgggattataggcatgcactaccacgcccggctaatatttgtatttttagtagagacagggtttcaccatgttggtcaggctggtcccgaactcctgacctcgtgatctgactgcttggcctcccaaagtgtgggattacaggtgtgagccaccgcacccggcctgacttcttttctactggtgtatgggtcaggcctaacttataggcctgaatcaaatgctttagattcttagacttaccaggaaagcatttagatgatcacggaccatttccagctcttgtgggactgtcacagattgctgagtccaaaattctagccggtcttttgcagattgtaaccagtgaattagatctgcagattcactttgatatctgttaagtatattatggagtccattaagtaaacatttcatccctatcttctactcacctacgttactcaccaatgccaacagttttaaaacgagaggtctgaagatttagaagaaaaatgcatgaggttggcactctgaaattttcttcatattgatacctttatcaagcctgtctctctgggtttccgctggcctgtctttaagctgggtataaaaatacctttcccctactctttcacattgatgctacttagaaaatattagatgatggttacaaaaagtcctttgaaataaaggcggcttagacacagactatgtcattatgtaaaaatcaaccctccaccccgctgaatgcttcccattgcccttgagaagcttctgcttctcaatccatgttttctctttctctccctctcaggctttactgtgatatctcagacacagtgattaggcaagggagggtgaaactcaaaggtaaggtgccttatgcatctgcctccctgctcacttctaattatatgtttatatgagtatacaagaatccaagtggggactttctacttttcttttgtttttgagatggagtttcgctcttgttgcccaggctggagtgcaatggcgcaatcttggctcactgcaacctccccttcccgggttcaagcgattctcctgcctcagcctcctgagcagctgggattacaggcatgcaccaccacgcctggctaattttgtatttttagtagaaatggggtttctccatgttggtcaggctggtctcgaactcctgacctcaggggatctgcccgcctcagcctcccaaagtgttgggattacaggcgtgagccactgcacctggcctctgcttatctttattttccaaactatacaatacgtttctagaggagccatgtcactttcaagtgaatatctacttgccttatttatttatttatttttgagacacagtctcactctattgcccaggctggagtacagtagcatgatcatggctcactgcagcctcaacctcccaggctgaagcaatcctcccacttcagcctctccaatagcagggaccacaggcatgtgccaccatacctagtccttttgtaatttttttgtagagattggggtcttactatgttgcccaggctggtcttgaactcctggcctcaagcagtcctcccgtattggccacccaagtaatgagattataggtttgagccatcatcccccacccgcactagccttattaatacaatgcagcacttatctaaaaatatacaaaacagtcattgtattacctggtccagtgtttcaatattgtttccagtctgtgaagttccttagacattttattggtgttacttagccagcactctccaagttgatttagttggctttctagatctgagcagctgatggatatcagaagtcgtttcccatcatctaatacttgatataatttgggctggtattcattaaggctagattttaaatgctaaaatattgaaattattgagttaaaagtttggatatgcaatttttgtctttaagaattataatttctctggtacctacaatgttcccattacctgttattcaaacttaaactatactcactcaagtaacattgaaaactttaagatgtttcatctatatttaagtatagacagtctccttttgttgtttattattttttttttggtaatgactttaggtggatttaaaactgtcaaattattatttcaagaattgtgtggcatcagcataaactacagaaaatgcttggtggaggctgaattttcaaaaagagctctcagtaaaaaaaagaaaaaagaaagacttttaataatgtccaactataaataacagaaacattatctcctttcaatgtcaataacttgaaagaaaagtaaaagtactaataaaataattgatcacaagtttgtttacattctgttaaaactattggtaagtttctaaaggcaatgtggcggcttgtaacaccaacctggtagagtgttatgcggtcaataagcctgtcctcgttctcctccaccagacccacgcttgggatgctgctttccaccacctccagctgtctgctgagctcctgctggtcctcatccagatgggaccacgtctagaaacacaacatgagtctgtgagctaaaaaaaccctcattagcgaaagacattcttccttgggtgcaaaatacgtgcctgacagtctctccttaaagttatatcagagatgtttgcgttgggccttgctttgggaagcaaaagatggctttaaagcaagtaatcaaatggtgacccttgaaagcattgtgaatgggctctggaatctgccactaagcccctttacaactgtgagtaagctactaaactctgtacctcttttccatacgttacaatggggataataatagctatcttctccatcatgaggattaaatggaataatgtatgcagtgtaccttctattgggtatgcacttttttttttttttttttttttagataggctctcactctgttgcccaggctggagtacagtggcacaatcatggatcactgtagactcgaactcctgggctcaagggatcctcctgcttcatcctcccaagtagctgggaccacaggcgcattccaccacaccaggctaacttaaaaaaaatttttttgtagagatgggggtctcactatgttgtccagcctggtctcaaactcctggtatcaaaagatcctcctgcttcagcctcccaaagtgctgggattacaggcatgagccaccacatctagcccaggtatgtatggttttattctttaccacagtaaggatttaagtcaaaaggatggggatgtttgcctttcatgtaacgagtaaacaaatcaattacatttgcatatgaaacatatctataaatatgaatatatagtttatatattctgttaaagaaaaataccacatcacttattcctaagttcagacttttattttatttaaaactggaaaacactttttaaaagatcagttgaagtcttttccagtaatttacgctgtgggtcagcagtttctcagtgtgagtatgctcacttcactgtgcagttggagtggcaacagggcacagtagtagaaacccatgctttttaaatacacttaccaaatatctattgcctggtattttcaatgcctagggatctgggagtaaataaaacagacacaaacccaggccttctagtgaggagagacaggcaatcaataataaacaataaaccaaaaacaaacaataagttgtatggtataatagagttcttgtgctgtggaagaataaaacagaactgggtaggggtgggagggagtgcccaggtgtgtgcctggtggggctacaatttaaatggtgtcatcaggtaagtttcatggagaaacacacatttcaggtcgtgaagtcagacagatgaaggtgtgatctctgactttgccaccaattaaccacgtgtcttggcaaacagttgctcccagactcattgctgaaacagggattcaaaattctatctcaaagggttatgataaagatgagatggattcatgtaaatgtaagaagtcttgccagggacctgacatgtcaataaagtgtaactattattacagagatttcaaacgttaaaggtagatgtctctccaaaatatagggaattccacatcagggaattccacatctgggatttgggggttagctacctatgaaaatgttggcccagggaaaatcccatttagaaaaaatgcaaatacgacctgcaggcaacccagttaagatcagtaatattgtgggagtgggtggggaagtccacaaaggggagagagattataatctctaaaacttccaagggaaagaggaagaatgagaaagcaggaacagtttagggcaactggtacagttactgaagaaagaaaggggactgttccatcaataatgtcctacatttccacggggttctatagcttgccagtagccaccactgagcactactctgttccaagagcaaccgcatttgggacagaaaaaaatatttctacattttactttcatttttttttttttttgagacagagttttactcccgttgcccaggctggagtgcaatggtgtgaccttggctcactgcaaccactgcctcccggttcaagtgattctcctgcctcagcctcccaagtagctgagattacaggcacccacgacgacgtccggctaattttttgtatttttagtagagacggggtttcaacatgttggtttgtttcatcatgttggccaggctggtctcgaactcctgacctcaagtgatccacccgcctcagcctcccaaagtgctgggatgacaggtgtgagccactgcacctggcctatttctacatttttcatactcttaagtaagctatcagtctgaatatcaaaaccccaaatatcttcatgcatagtctgaagtcagtgtgtatctatcttactttcgacatggcacagcagatagcccaatgtacacagaaaacacagggggaataagcaacacagaaccataggaaaagtgcagtcctgagcccgagagcgcagctagttctgaggttatgtgaggcaaactgcatggatagatacatcttgcattaaaggtctattttgcagcaggaagtttgcagcacagaagatatgacatcaatggtctcacctctagaatgtactccagctccacacccctcttgtgagcccgtttcagtacagcagaagcctgagccatcagctctgtatggaactgggtttccttttggactgcaaagctgattatctttctgaagagtgtttcagtcaagatcatatgagattccaggccctgaaagtattcctgcaatttttcaggaagaaagaagtcagcaactcattcatatattatgttagaatcaaaattggtttagggccgggtgcggtggctcacgcctgtaatcccaacagttggggaggctgaagtgggtggattacctgaggtcaagagctcaagaccagcctggccaatgtggtggaatccgtttctactaaaaatacaaaaatcagccgggcatgctggtgtgtgcctgtaatcctagctactcaggaggctgaggcacaagaatcgcttgaacctgggaggccgaggttgcagtgagccaagatcgtgccactgcactccagcctgggtggagaggagttcacaccaacccagcgctggagctgagtagacagctctgcatttctagaggagagtgaggagtgcgcgaggagtccttgaccaggacaagggagggcagagggagcaactaggaccaggtgtacaaaggggcaaaaaggaaacacagggaaaggtagaggtaagaacgaaggtgggctcctttgaagacaggctctgagtttttctttgccaggacagttggagctctggttggagactccatctcaaaacaaacaaacaaacaaacaaacaaaaaacattgctttccttcctccatggctgggcttgggctctactttctgaacttctaggatatttgcgtgctcattccatgttgtcaagcacagctttatatgcactgattgatattataaatttgctttccttgtattatacctacacataacataactgtaggccttgcgccatcctactaatgtttttgaaatgttaccgtttgtgtataatagaccctggagaatggagattgagcttatctcatttcctgttcccagtaccatgataaaatggaagagctggcaactgataatgacagttaacattaattatgtgcttactgtttgctaggcactccataaatactttatctgactcatctcatcctcctaacaactctataactctatgagataggcagttttgtttccagttttacagatgagaacactgagtccccccagtctatgtagcttgcccaaggtcacatagctagtcacggcagagcttggggttcaaacccaagggcagtgtggctttatctgtgcttctcaccagcactgcagaactctccctcagaaaatgggctggtgagtagaagctagaatcattatttttaaccaacaattaccaaatcagagtcctaaagttggaggagactttgaagttcatctagcccaacatgcaatgaaagctgagattccttttacaagcccatctcccctaaaagccttggctggacttctcatggccagaagggctgtctgctcaatggcagcttactccttttatagttctttttctattgaggtttatttccctgttatttatactcattgatcctagtttcccctctggaataactcagaatgatcttttattgctatggtcaacaacgtgagaaacaccagctgtggactttaaagcaatgttttcaaagccaaatgataaggttttaataaatcatgaagctttggacaaaaacgtctgggaaaaaataggaacgacaatttgaaaaagacaaaaaaaacccacctttacaagccaccagagagctacacaatggtagaagattttaaacttctataacccaatgggatttttttagtttccctacaggaaattcccatagtctagaaggctgggtttctggactggcaaaattgctttcgtaatcattgccaataatgcaagagctgtgtgtgtgtgtgtgtgtgtgtgtgtgtgaaatacgcattcttctaccatggagtagtgtccaacctgagcttggctgtggcacacaatgatggagtgatttcgggcctcccaagtttgattacatagtaaacggccttgctgttcccagggagaaagtctgaagtctacagcaactagaggagcatatgtgtaagggtcagaggatctaaacaatgcatgtaaaagacaccaacccaaccctggatctgagtagtcagctctgcatttctagaggagagcaaggagtgagcgaggagtccttgacgaggacaagggagggcaaagagggtaactgggaccaggtggacaaatgggcaaaaaggaaacacagggaaaagtggagttaagaatgaagatgggctcctttgaagagaggctctgagttttcctttgattttagctcatctagggagaaagcctggctaatactagtgaggaactgataggtaaaattacaggtaagttggttttcttttttaatttacaacattatagaaacatatcccctataatttctctgtgctactgaaagccagtgggtttgaatataaattttttggccatttttaaagaataacttatacaagtaagaactcataaaagactgagaatattaggttttactaaatatatatcagggtttgagagcatgctttccaattacattttctctctatcactcttttttgttatgtaccttatgtttgtcaagtagttgctggatttcctctttggaagacacgatgattttctggtctcctgccatcttctcctgaccagtttctagcaggtcagccagatcttgtagggccctctcatactgactcttgagtgtaaggttctgattcagaccactcctccgggagccaatgatcatcatcagctcatcatacatgtcctaagaagcagagaccacaagactcactctcaattcatattctggcaaccctctaaaagcatatgaactatgaacgcaccaagcccgagacccaaccaagaaaatgccttcagggatgtgcctcctggaaacgctctacctgtaggccatctgcttgtctttctatgagccttactttgaaaacatgtttcacaaagaaatgacctttggacctctattctcatgcctatgatattcgttgtgactttactgtgtcttgatacctggtggttcaagttctttcattaatcttatttggtattcttatcttgctgttttaaattttattttatttctaacggacaataaagcacaacggagaaactgaaaaaaaactgaattcataaaaatgtaagtatgaagtcactgaaaggataaaataaatattcaataaataatgtggaaacaactcaactctttgaagaaaaataaagtcttatctcatgccacatatcaaaatgcaatttagattgattacaaaataaaaatttaataagttaaaatatgaaaggaaataaagatatgtctataaaaaataaggttaatattttaagattttaaaggacatgtaaaagtgtttcctagaaatgatacatgaggtagatttgacaactgttttctcaggatatcaatagtttatgataagatgtggggtaaaactgttgaaaaactgtccatgtggctgagggacatgtcatagaaaatgtaattcccatttttatagtattctcaacattcatataatttcagagcaattgaatataatatccttaacattttcctgctaaataacaatcatatttgggactacccctcaaacaaagagctagagaaataggggagtttaatgtgagcagaaagagtttcaaacttaagaaggcaatatttttgccaaatgtggtggagtatataactatttaaactggaaagacattttaggagatgatgacacaccaaacacaaaatttatttgaggcatacggacctgattaacatatcacattaaggtttagcaggccaaaatggttcaatctggaagagttcaattttaatgcctatttacggcaatgacatttgactcttacacctgatgcttaagtgctgtcggaaaactgtctaaaaaagtacaaagtgggggaggtgggcttatgatattatgaaatgttagataaaggacagatacagttaaaataaaaatgttcttttgtttataaggtctattttattttctcaaagaaagaactcacaaccctgtactggactgaggttaccagttctcaatagttctgcacacagagaaaatctaacatgtgtgtctgtgtgactgtacacagttgtacacaattttttcttgatcgaacataactgcttgcctagttgatgctaaattttgttggtctaatatccaaggatcttcttcctaccccaatatcagattcttgcctaaatgtcagatctagcaaaggaaattaacccaaagcattattctctgttcctgaaggatgataggaagtctgtttagatttcaactaccttctagtttaatttttgttgttgttgttctagaattgaaacaatgtctctattccattcaaacatatatggaggataaactatagtgcttgccttagaaaaaaacactttctacaaagtattactttgattatttgctttttaaaatagtatttgaagacatagtgcaatacgagggtagatatcccttttttaaatttttctaggtaggattaaaagttattctattttctacagtagaaaataatatgctacaactaaactatactgtaatgcttaaccatgagaataataataaagtaactgtcagaaaaacatatgaatcttagcagcatgaaaacaactcatttccttgtactaaacatgttaagcttcagaaaattttctaagagttgcttggtagaaaggttaggacctaagtggcgtgaattttataaagaaagccaagaaaaataaagtgattttttctagacttcaagtttgatgtacccctgcagctgaatactactggctgaaggctgcacctggagcttggagagttcttgcatggacggctgctcgacctgtagcttgtcaccacgcctctttaattcaatgattcctgcatcaaattctttgagtccatcttcagcctgttgtattgcctaagtaagatccatgacattttattaaaactcccatgaacaatttccccacggaagatgtgattattgtatctctttctgtgttcctcctctccatgtaaaacattctcaatatatacaaaaggaatcatttcaataaaacaaatcgaaagccatgttcagagggtatatagaaaacagaagaagtcccctcattagtacagagcagttatcttacagataatgaggcaggagaaagtcagggtagagggctgggagaaggatgtcttgcttaaacaaaaaagggagttttgaaaagcaatagttaaaaaaaagagcatcatttaggacatagttaaaaaaaggtatttgcctgagattttctaagggaccatgttctgctgtccttgaaacgtagctgtgagcatctttggagagagattcagcgaggcaacaaaacatatattacagcatggtcaaagaatctgtgctccttgttgtgaagtggaaaatcaatcagtcaacaagtattcaagtggctgctattgctaagccttgtcttcccagtgtgaggtctgtagaagcagaacaagatctcatcctgtccttcaaggagctgatggtctggttaggaagccagagtaaacagagaaaaataaagcaaggctgaatataagtaagtactatactcgataatgcaactcatccccattagcagagatcagagaagggagataccagaccacaaatcctggagcagcctaagcaggcgtttggaaagagggcaacagaggttgcccctgaaggaggacaaaaacaagactccagatggcagctgaaacacatgtgtccaatgttctctttcctgaaaaccccctacagtcagagtgagtattttgtttgcttgttctctggcatattttttccccataaatctaaaaggacaagggaacagaaaagaaaacaatgccaacaatatgttgggagctagaagtcaaaagaatacatgataattgacttaggaaatctggggaagctgaattctaaaccagtggaggatctccaccacccacttcagagcaacagaaatctctggaactctgggtgaagtaagctggggtgctaagtaaggagggttagtgaagagctgcttaaaggacagttaacccacagatgcccctccttattccatactgtccctttttcttcccgggtaaaagactgaaagtgtgttctctggagaaggtaaaacagacagaggggcactggacacagctgtgagcttgagtgcttgactgaaagcaagggatgaaataactggatgctccctgcatgctgaatgtggggcccctgagtcttctctccctggggcaagaagtgctgcagtcagggctctagtctccagagatgagagggaaaaatatctgaacacaccaataagacaggcctgacaatttgacagaaggattctctaacaaataaatggtccatagagaccatcctgcaggaactcttaaaattatcatgttccatccacacacagagttccctttcagctgtttagtcctccatcctaaacctgaataggcaacaaaagatttcaatatgcctttcgatgacatgaaagatggggactaacagaagcaaacaaataaaagcaagctggaggaaaacagattatacaggaaaagtagaactttaaacaacaaaaaaaaaaccattaatatacccagaaagatataaacgataatgtattcattaaaaaaaataaaaaatactacaaaaaggatcattcggagaaccaaagtgagctccgggaaaattaaatacgtgagagcagaaatgccaattcagtacaagagtctggagttgaaattgaggacgtttctcaaaaagcggagcaaaaagacaaagaaaggtctcttggtaagacagttcaagggttgaacccgagtatctgacaaaaaggagttctccagaaaagaagacaggtaaaatgcaggaaagaaatgtattaaataaatcattagaaaattttccagaacagaaagatgagagctgccaaatcagaagagtcccttgagctcccagcccagtggataaaaatagatcctccccaaggcatgtgattgtgaaatttcaggacactggaaacctttgggaattagaatgtttttagattccttaagacaacactgagagctagaaaacaatgaagaaaaagccttgaaactccaaaagaattcatattcaacaaatgaccctgaaggatcacataaaaacagcaaagcgatcaataaagtgtgaacatggtataagaacattttcagacatacatctggaaaaatacacttatcatgtaccctttctaagaaaggacatgcactaacgaaacaaggaagcaatgcagtaaagagaaagacttgggattcagaagagagaagatccaacataggaagaaatgaagggattctcaggatggtggtgaagggaaatccaagaagacaactgtgcaccaggtttatgaggcaagagaactgctctggattggaacagcacaactcaagagatgactatattgagtgaggtgtgtcttccccatgccctctgctgttattgcctttttaatccaagttgggtaggcatggaattagcacgttcattagttgcattccatttattcaaagaaaaaaatctaactggttatttcttcatctgtgacattcagttatattggtcaaaaattagtaaaaattattacttgtgatcatacatatctcataattcatattagaaatccaaagcaagacatcactacagttgctccagtcttttttggaatcacacatacattataagccaagaaaaaaaacaaaaagatttttcatggggagaaatgagaaatctctttaaaaagcagatgaaattatggtcaagaaaaatgcacagccggatgcggtggctcacaccggtaatcccaacactttgggaggctgagatgggagaactgcttgagcccaggagttcaagaccagaccagcctgggcaacaaagtgagaccctatctccatattaaaatatatattttttattatatatatatatatatatatatacacacacacacacacacacacacacacacatatatttttaaaaataaataaaaagaaaaatgcacactcacagttttgcaaactattttgagaggtgttctttaacacacacacacacacacacacacacacacacacatattatatgtcagattattctctatcgtctatccatagattcccgggaagttcgctgaaattaaatcagagaattctattaaaacacatacttctcacaattacttagcttatgaaacaggagatattctaacatccctcccatttcttctatctgcattttcatgccatcatgccagtttgggttctcattctttctctccagtacagctacatgaagcctcatgatggatctcctgtttcctgaccctggtgctgtcatgtaaactaaccagaagcaagatctagaactgccattcatttttacctgcaaacatcccctacaactttccatggccagggatctcccagctgagtctaaacacccaagagtgtgcaagatgatttaccaggatgaaacaccacatctttcatttatattcaaccacattaattttcaattttggttgtagcatgtacacaaacaaaaattgaaaataaatttggctgaatttaattgtgatttataacataaattgcttataatttataaataaataaaaatacatacacttatgctgcatatttatttccttttttttttagctaatgaggcatgcaacaaataaagtgtacaggtaactagtttatagaataaagtccaaagtcacacattcaacaggccctacaaactgccttaaatttacatatccaatcttgtttgtcctcagtcactttcatttatcttaaattcagctaaaatagaattacctgtgtttttccctaagtgctcagaattctctaacaatttgtgccttttttcttgctgtcctctttaccgtgatatctttctttcctgttgttgtgtgtccaaactcttaggttcagttcaaatttccctctacaaagcttccctaatcctacccctgctggaggccagaagggtctgagtacccataatgctttgtcagtaccactcccaggacagtttgactttctgccctatgtcattgaggttcatatctaatctcatcattgggcagaaaactccttcaggtcagcatctgccatggataccttttcccagctcacatttcctagttctgtgcagatgtaagtaacagagtcaatgtcacctggtatgttattcaaacccagtactcaaaaacaaaaatactacaaacaaaagtgccactgtgagccattaatctttcatagaatattcaaaatttcatagtaagtcatatctcctctatgcattttctcttctaggaaaaggcagctataaatacctctatttgttctgctacgggctgttcaaacacatttgccagtttttgcagaatgatgtatttgttgtcagccagtgatgtaaacagcactttcagatcattctaaggaggaaagcaacgggaaaactcaaaatgtgtaacagggaattcaaaatacttgtaaatataacacagattctaagaaataacatagaggcacagaaatttaatttccaggagaaacaatactgtgctatgggaaggtaaaaggaactggtaacaatttacttatgtgctaaaactgactcctgaagaatctgttacccaaagtattttctacataacacaaatgaagttgaaccatacatgtaaaaagcaacgcttgtcaccctaatctcattacatccgaaataaatgagcacagtcaaacattgcacagaaatattatattagtggctcttatctagggaaataacctataggtgttatcctgatttgggaaataatatgatacttaagaatcatatgatttccattttgctctctcctcttcttccctccctccatcagtttcttcttctatttttggaaaatttgcacaagctttaaaaaagccatccagaagtttagaaaataaatattatccatgatggccaaaaacatgtgaagagacaacacaaaaagatcttgttaggtattttgttcaaaaatattactcatttaaatgtccaaatatatttatattgagttagatttgtataaaaaggagacaactatcagaactttggtacttaattccacagggaataataaattagaagaatatttaaattataaaaaattttggccaggtgcagtggttcatctctgtaataccagaattttgggtgcctgaggcagatcacttgaggccaggagttcaagaccagccggggcaacacagtgcacccggtctctacaaaaagtttaaaaaaaaaataagtggacacagtggcatgcctgtagtcctatctacttgggaggctgaagtggaaggatcccttgagttcaggagtttgaggttgaagtgagctatgatcacgccactacatgccagcctgggtgactttatctcaaaaaaaaaaaattaccaaaaaaatgtatttttttctctaaaatatcaacaaataagttctatttcataatagtcagcaaaaatatatttgtcagaggttaaagctcaactcaggacctctttaccagggcctgatcacgcacatcaccaacatgcaaacattctgactgtctaatgagtggaaggataatcgtaccaaggaagaaaaacatctataagaacatgtgaaggctttataatgtaaattcaggtctaaaaagcaaaataatgggtgcattatgcagtaaaaattataaaattgaaaatatagcgctgaacatgagaactagaatagttgccactaaccaaaactcaaagcaatctgcaagtctagtggctaactaaataggaaattataataacagccctggaaaaatcctagaaacaatagttttacatatgagttactaggtctgtatcattcaactgtgttcagagtaaggtcacgtgggccattaaaaccatcacacatttatctgtttttaaacctagtaaaagatgtcctgcattcacttgaacagaagcctacattatctacatatgtgtgtatagtgacattcgtccagttaatctaaatgagtagctaagtatatataacataacatgggttagaaatgaagagtgcatagatagatttcctgtatgccagttttatgctttgttttgttttgttttgagacagagtcttgctctgtcacccaggctggagtgcggtggcgcgatctcggctcactggaacctcagcctcccaggttgaagcaattctcctgcctcagcctcccaagtagctgggactataggcatgcaccaccacgtctggctaattttttgtatttttagtagagacggggtttcaccatcttgcccaggctggtcgcgaactcctgagctcaggtgatccacctgcctcagcctcccaaagtgctgggattacaggcgtgagccaccgcacccggcccatttttatgcttttaatagcatattttctctcttaactatgttctactcaaggtggtaggaaacacagagttcatatttctggaagtcagactgattattgggagagactagtcaagaagatagtaaagcaaagaatatgattgattttaaaattactaaataaaaactttaagaggtgctagtaatcacatggatattgacattttcttaaaaataaaaatgcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacctgggaggcggagcttgcagtgagccgagatcccgccactgcactccagcctgggtgacagagcgagactccgtctcaaaaaaaataaaaataaataaaaataaaaatgcaaagaattgaactatttttgtattattacacttgcgatacaacaggataattaaggtatccatatattacaaacataaaatacatcactttttttttcttaatagtcactggaattattggcagggcaaaaaggagcaggattctagccattgagaaacagatttgcagaaagtttcaagctttaaaaccagttgtgtccgggcacagtggttcatgcctgtattcccaggactttgggaggtggaggcaggcagatgacctgaggtcgggagttcgagaccagcttggccaacatacagtgaaagcccatctctacttaaaaatacaaaaattagctgggcatggcgtgcatgcctgtagttctagctacttgggaagctgaggcagaagaattgtttgaacacgggaggcagaggttgcagtgagctgagatctccccattgcactccagcctgggcaacaagagcaaaactctgtctcaataaataaattaaataaataaataaataaataataaaataaataaaatcagttgtgctgcctcactcattcattaaagaattctttcattcattttccaattttcaaaataatttacaatacacaattatatgtttggggaatttgaggttacgtccatgggtaaaatttttgaaatacaaaatagttcataattgactttattgtgattctatatatgtaatgtacatctacataacatctatgcatccttccaaatagtctttttggtatagaataatgttagcagtctggcaaaagctaatcctgaaagattaaatgcagaatgaaggcatacccttccagtaactgctgaggactgacagcataccaaggtgtttggtgcaaagttaaaacaaaaaggaaaatagtttgtgacttgacctttaattatgttaacattggaaagtttctctcaactaaattggaacacaaatattttgaaatgtctttttgttcgtgagctggccaccaacaaatagaaacttgttggcagaagaaaaatagagaacgtgatttaaagagaattccatgattctcttagatccttaaaacaaagtaagttccagagcattcatgcctaattcatattttactgtgactggtgataattaccaataaagtttaaaagtatgaaagtactaaagatactaaatgcaattcacaaaagatatggggaatgagagcaaaagggactgctgaggcactcggggattctgacttgatcatcttgggggcagtaactatcagggaagactgctagatagcagtgccactgactcagggacaagactgagttgctggtggtaccatcaactggcaaaggatattggataaaatttaagagactctaatgaaggcccacattctccatcttccctgagatcaccctaatatgataaaatacaaaaatatatatattctttgagtaaaatcctggctctagttcttaatggttgagtaacactgaagtaatttaatctttctcttggttttagatcctgtatctcttataatactactactaataacaataacaacacttgctgagtgtttactatgtatcaggcactgttcagagtattttaaacacatctcaactcatttcatcctcaccacagtctatgaggcagttaatatgagtatgagtttgatttgacagttgaggataccaaggttcatggaagtcaagccgcaaagttatacagcagtaagtgacaaagccggaatttgaacccagactgttagctttggagactacatgtttaatttttactgttctgactttgcaaaattattatcagaacaacgtctgcaggatgtcgcaaagattaaagacaatgaatatgagaaaatattttgtgaataaaaaaatgaaactcaaatgtttgtgatggttttactctgtggttttaagaatgtagactaccagaaggcagtggtaatttgtgcctcgtgaaaattccatgtttcttggctaatgctacatttatgtgtagtggtttggttttttttttttttttttttttttttttttttttttttttttgcaaatcaaaactccacatgaaactcttggccctaatgacatgtctctattttataaaatctttcatgttggttaaaaataacattcaattaaaacttatgtattctcaaagagtgctttttattaggaatgaaaaatcagcactaaaagtttatcagcagcttttgcatttgttccggtatatattcataggaaaagtttcctaagcacacaataagaattataatatggggctaaaaggcagtaagtctgaggagttaggactggaaagtaacgtaacacattttaacacaggtagaagtaattagaccacagccactttcaaagactcttaggtactacagtctatggccctttctatattccaacactttctgcatactctttttttttttttttttttttttttgagacggagtcttgctctgtcacctaggctggagtgcagtggtgcaatctcagttcactgctacctctgcgtcccgggttcaagcgatcctcctgcctcagcctccaagtagctgggattacaggcctgcaccaccacaccctgctaatttttgtatttttagtagagatgggttgcattatgttggccaagctggtctcaaactcctgacctcaaatgatttgcctgccgtggcctcccaaagtgctgggatcacaggcgtgagccactgtgcccggccattttctgcatattctttcgcaatgtgtttaaactccggtattagtaactaaaaattataattataatgatccataaatttgacttttattgattgaattctattcagtccttagtttgaagtgggtggttttctcaaccttccatttctaggagcaaaaaatctttagcttctaatcctttaattcaacccccttcattttctacaatgctcttgttcttcattacgcatttagaaaaacaacaaccaggtctgtaacacagactcgtgactgactattactgaatacctagagaatggtcacgtatcctttgataatatcttacttacctggaaatttagtatttgctgaagtctttctttcatctgatgacatcgttgattcactactgagtctagcaaggataacctgcccaaaagacaacccaaagtatcttcaataacatctcgattatcaccattctctggaaaagcttgggaaaacaagtttttgttcttatccatttcttcagacatttccttaatgtctttggcaagaatctagaggtgataaaagggcatttttcagtgtttagatacatgaattgatatgcaaatcatgttattttctcatagaaagtcaactagatctctctggctgcttagtaataatcagacctaagacaactggaacctctttcaaatacttctatacatttcaggaagttgctctcagagactttacctcattcactagtaataatgagcaatgtaaagtgctatttaggaatttggtactttttttaagcatgtgtttcgtatttggaagatttgtgatacataacagtgtttctacaaagagtttcccatttttccctcatacttacacaagacaaagaatgaaaatgcgaactataaatattctgcatttaagcaattatgttctgcattattagaattgttttatgtttgactttctttatgcataaaattaattatcccatcaaaatgtcaagtgctttgtaatgttatacacacacaggcaggaactactaaacctacctcttggttgaagagacaagtctctgtttcttctggtaaaagtgctgtggcaacaaataaacgttcttcaacgtcatccaaccaagtagaggtggctgagactccatcatacaacttctgctccaagtgtatactctgcctctttgcccctccactctgggaaacacaaaacagggtcaaataatcaatttcagtgttttgaaaatccaggaaaaatatcaggatggggccggtgcagtgctcacacctgtaatctgagcactttggtagcccaaagcagacagatcacttgaggtcaggagttcaagactggcctggccaatagggcaaaaccccatctgtactaaaaaatacaaaaatttgccagtcgtggtggcatgtgcctgtagtcccagcttcttaggaggctgaagcatgagaattacttgaacccaggaggtggaggctgcagtgagctgagatcgtgccactgcactctagcctgggtgacagtgcaagactctgaaaaaaataaaataaaataaaataaaaaacaggaaacaggatggggccaggcgcggtggctcgcgcctgtaatcccagcactttgggaggctgaggcgggcggatcacgaggtcaggagatcgagaccatcctggctaacatggtgaaaccccgtcttcactaaaaataaaaaaaataaaaaaaaatcagccaggtgtggtggcacacgcctgtagtcccagctattcgggagggtgagacaggagaatcccttgaacccaggaggcggaggttgcaatgagccgagattgcaccactgcactccagcttgggtgacagagtgagactcggtctaaaaaataaataaataaataaataaataaataaataaataggatgggactccagggtccagtgatctttgtttcagcgcttatcactagtgttgggtctcatgctcaggggtggatgcaacagtctcacagaggccaggcaaatcaatacaagcaaaacaagactcttataaaccaagccaaacacactgataacacagccttacctgggatgaaacctcctcgaaggcttggttcagtccatccagcaaagatgtaactgcagatttatcttgggttggcacgtcccctttgtacagtggcacaccagacaagagtcgatttggcctgctataaagctgtaggcaaacaaaggcagcttgttgaagagcatatgcattatgtcccagtattctcatttggaaatgcatactgaaatagatgctgaaaacactgtccatatgaaaatttcttctagagaaatataacttctacaacataccatgtccactgaacacagtggccagatgcatcaatggcaatgtttccatggatggattttttttttttaagcagtggaaaaaaatgtctgacagataggaggaataagttctggtgttctattacacaggaggtcaaacacagttaactataacatattgtatatctcaatagctagaagagaggattctgaatgtctctaccgcaaagaagtgataaatgtttgagatgatgagtctgctaattaccctgacttgaacattacacactgtatacatgtatccaaacatcacactatacaccagaaatatgtacaaatattatatacaaataaaataaagcaggccacccacgatggctcatgcctgtaatcacagcactctgggaggctgaggtgggcagatcatttgaggccaggagttcaagaccggcctggccaacatggtgaaaccccgtctctactaaaaatacaaaaaatagccaggtatggtggcatacgcctataatcccagcaattcaggtgactgaggcacgagaattgcttgaaccagaggcagaaattgcagtgagctgagatcacaccactgcactccagcgtgggcaaaagagcaagaccctgtttcaaaacacacaaaagatgacattataaaaaaagaaaattaaattaaaaggtggcttgcaaattttatgaaataaatgacattaagacataaataaattagaaacagaaaggatgagaacagacattgctgaaaatggaatcactggcatagagaaaactcttgcaataatcagatgaaaagtaaatccaaattttaaaaaaacaaagatcagtacaactaaaaataagtcaataggtatagaaaaaagatgatctaacacaaggataattgatgtccctgaagcagagatataataaatatagcataaaatacatctaaatcatgccaaaaaattccctaaaattaataaaaaagcaaaccttgattcttaaatataaaaaaagtacattgtgttacaggaaaaatatgatagcagaacactcaacatcaaacatagcctagataagctgttgaaacttaaagaaaactaaataattcttctggcatccatacagagaacaatgacaaaaaataaataaggggaaaaatagtagactgatgttagatttttctaaagcgtcattcaatgccagaagagaaaaatagatataaatacaaattctgaagggataaaagtatgacagaaaactgtccatccaatatagaggcaactagctgatattcccaaacatgatagaacctgagttttcttgaaaaaagttatttgacaatgaaattaatacctgagagctggatcaaaattaaaaatttaggaattaaaaagatatgctgaaaggattggttatgagcactgaggaatttaaagattaaattgatttacagaatatgggaattgttacaattgttccttttcattttcatctttgcacttggctgcattatgcgaattattataatgcatatatgtagtttttcaaaataatagagtaatttttcttaaaattgactaaataaagttattagcaatcataaagaaatcttatcacagctttcctctcaacttttcttcttggttttagtagtacctatagtgaaataatccatcctaaatacaagactcctagactgatctctttgctttcattattaaccccatttcccctaaactcttttaggtatacatatggctccccaataagggcaatgatatggtgtagcattcaaacttttgaccatgttttcaatcaaactcagtctcctttttctttttttcttcttctttttttttttttgagatggagtcttgctccatcgcccaggctggagtgtagtggtgcgatcttggcacactgcaacctctgcctcccgggttcaagtgattctcctgtctcagccgcctgaatagcttggattacaggtgtgcaccaccacatgaagctaatttttgtatttttagtagagacaggatttccccatgttggccaggctggtcttgaactcctgacctcatgtgatccgcccgcctcagcctcccaaagtgttgggattacaggtgtgagccactgcacccagccatcagtctcttttgacttttcaaaatacctcctcacctttcaggctgactactcatgatcctgtaaatatgccaagcccattccccattgcagctgggatatcctccacccagcatccccttaaaatctactactttaatttccataccgatcatagcaacttttgactattttttcttaacctttgtttcctttgaattcctgcttatggatcctgtcatagttgcctaattttttttttagaaatgtatgcactatttccttattcgggttataggttctcagaagcaggagctgtatttcaccctgaagccaagtaggttgttgtgcatggaagcattaaatacattggaagtaaacagattaagaaaaattgctctaagaggttagtgccctttgacctagtgaactttaggccaaaatgtgcctgtttttacatatgaaactagtaagtatttctaggatacaaaattgccattaaggtagtatgaaagaggagggacttaggtaacagagatatcggcttcctgattccagattcacctcttcttagtcgcaagaccctctctaagcctcagtttccaggtctacaaagtagagataatattgacctcaccacaacgttgttagcgatgttaacacctagaacttaaaatgtgctcattatatgatcactcctttctgcctggaaactgacagctaaattgcttcttccctctcttttccttcaccttttcacaccacagagaggaaaacaacctatgaggcactttgtacaaatgaccagcgattgctgaaacaaagcactcaaatgcaaaaatgtcattaaaaaaagaacattcaatgcttttatttctaatccaaaggcaagggaggcacaacatgaacctaaatttgaacagtccaggtattgtggaatgtcagtggcagcagggcaaggtttgttcagtaagcacagcatggaggacgctggagtgtcggctccaactgagagcaaaagcagctcttgaagatgaaagcgggtaatggatgagacctccaggaggtctgcagatgccggacgaatcacacaggtgctttatgaatggagaataatacgcaagcacagaatctagaaatatcgtagatttctctaacttaagatagtcagaaaagactgcagtccctgattcagaactgtacatacctctcctattcaaaggattggagggatactagaatatgaagggagagctagcagtcaagtccagaagatccgtatcaggaacaaggaatttgagctatgagtctggaggacattttatcagggatttgaggaaggatgaattaaaatacagggaggaggtccacgcaaaaagtatagggcaccatttgccagggtggatacgattctgggacacctgcttccaggaatacagtgctttaagtttcccagggcagagctggtggctatttctgcagacagaggtaaagaagcctcctggccagagagggaaagtgagggggcagaaaattcacaaaagcatgtgcttttataaaaacagaatagaaagcgtggctctggagagacgtatgtgtggctatccacagatgacaggacaccttatgaccttcagaccagcgatccccaacctttttggcaccaggggttggtttctcgggggtgggagagacggttttagaatgaaactgttccacctcagatcatcaggcattaaattcataatagaagcatgcaacctagatcactcacaagcatagttcacaatagggttcacattcctatgagcatctagtgctgctactgttctaaccaggaagcagagctcaggcagtaatgctcacctgcctgccgctcacctcttgctgtgaggtccagttcctaacaggccacggacccatacctgtctgcagcctgggggttgggaagccctgctttagaccatctccttccatttaactctggcaggttgcgcctgctttctaatgcctactttctcagctccagcgtttccctcctccaattcactacagttattgacaccctttgcttctggtttagcctctcccagcccctaagctagttctggccagagcagagaaacagcagcttccgcagagcaacaggaaaggttttagaattcactccgataatactgctgacttggaatgagcctagatggacgctgctagcccaggacaaaggactagtcttgtatctgaagaattcctctgggccacagctgtggtaggcatcccaggctggcttgtgttcctgactccctcatttgccctctaactttctaagtcctctgacttccagttgttccctggcttctgcttagagtgaagtaatagccattatctggaaccatctgttgctgtcttcaattcccttggatttggcatgcctggtggaaccaagcccgacagcacacagtatccctcccaggaaccagccttgcagatgggtccataactattccagctgaccactggcttcacttccctgccctagacccaccaacgtcccaatatgtttctcattaagatctcctgaaattattaaatactggaagtggcaatggaaaataagatggcctcacaattgagttccagatttgtggaaatccttctgtcctagatgtgcatatccttgatttccatccttactttttcaagtttgcaaaacacacacaaaaagagggcacttaaaatgtaatggtttaggctaataaggaatcagatattaatcatctctgaggaaaaatattgtctataaatcaaataaattttcacatataaatatataattatgaagggaaatgtgaaatagacttgttaagaaaaatgtagagtgaaaaattggtgtcatgtcttagtttgaaattgatcatgaaaattaagttgattgcacagttataatccctcagcataaactctacatcttttatattagttaatatataatgtaaaatatttgataccacttgctcttgttcctgttccagaacattctgtagtagtttctgcttggtactaaattcttgatgtaggctttcccatttcattctcatctggtcttcagcggatgatttctccccttccatccccaactcctgggataacacatcaggtttttcgctattagaagaataaataatctaagtttacaatgtgcacaaaaaagtgataagacaggtaacttattgtgtgtaccagacctggcttctcaaatgaaataagattaccttagttattagcttacactttaaaaataacaaaaatgtttaggccaatcataaagcaactatattcctactcattgataaactgaaccatgtgcagaagggatacttaaaaatgcattgaataaaaataattgtaacatttggaataaaaaattatagcacgattacagactagtatcctttggcaaatagcagaaaagttagttcaaaaccttaaaaatgtgttagtctagggagagttacgattatgagtccagagaaaacacaggacacaggagggcggtgcaggacacaggagggtacaacaggacacagagaaatagtacagggcctggaaaggtagtacaggacagaggaaggatcgtacaggacctgggaaggtagtacagggcatggagggatagtacaggacctgggaaggtagtacaggacacgggaatgatcatacaggaactgcgaaggtagtacagggcatggaggtatagtaacagggcctgggaaggaagtataggacatggagagataggacaggacctgagaaggtagtagaggaccctgaggaggaataatacaggacctgggaacgtagtacagggcacggagggatagtacagggcctgggaaggtagcacaggacacggggagatagtacagggcctgggaaggtgatacaggacatggaggggtaatacagggtctgggaaggtagtacaggacacggaaagatagtacagggcctgggaaggtagtacaggacatggagagatagtacgggacctgggaaggtagtataggacacggaaagatagtacagggcctgggaaggtagtacaggacacaggaatgatcgtacaggatgtgggaaggtagtatagggcatggaggaatagtacagggcgtgggaaggtagtgcaggacataggaaggatcgtatagagcctgggaaggtagtacaggacacagagagacagtacagcacctaggaaggtagtacaggacacggagggatagtgcagagagatatgggaggaaggccctgcagtgtcatccttaaaggtaggcagcaatgtgacatctgagattggtatggctcttatttatttatttatttttgagacagggtttcactctgtcacccaagctggtgtggactcgtgtgatcacagctcactgtacactcaaactgctgggctcatgcaatcctcccacctcagcctcccaagtagcctcccaagtctggtatgcaccaccagacttggctaatttttttttttttaattctttgtagagacagggtctcactatgtttcccaggctggtctggaactcctgaactcagatgatcctcctgcctcagcctcccaaatttgtggatttcaggagtgagccaccatggctagccaagtttaacttttagagtgagacagacctggattatgaccctccctctagcacattatctgtgacactggggtaatttgtttcacttctctgtgcctcaatcttctcatctttaaaatgaagatagtatctaccttgcatgattatgagaatgaaagagaatacatgcataaggcctataaccctatctgggaaataatggccactcaataaatgggggttaataatgacgaaaatgggctgggtgtggtggctcatgcccagcactttgggaggccaaggcaggtggatcacctgagatcaggagttcaagaccagcctgggcaacatgatgaaacctcatttctactaaaaatacaaaaattagccaggcatggtggcgcacacctgttgtcccagctactcgggaggctgaggcaggagaatcacttgaacccaggaagcagatgttgtggtgagctgagattgcaccactgtactcttcttggtgacagagcaagactccatctcaaaaaaaaaaaaaaaaaaaaaaaaaagatgaaaacaggaacaacctagggtggctgaatttccacggatcttcattcttcaggacctttgaagtcctaactaaaaccgtgtcatctaaaaggaatactagatattaattaatattttgatgcagggcgttttgctcaagtgaaaaaaaaagaataacaagtgtgttggcaggataatactctgtggtaccccaaagccaattattcttagaataaatgtaaacacaacagtgtctttagataagtctctagaaataagacttaaaatttctgtaaactggccaggcacagtggctcacacctgtaatcccaacactttgggaatctgaggcaagaggatcacttgagcccaggagtttgagcccagcctggacaacatagccagaccctgtctctacaaaaaaaaattcaaaaattagccaggcatggtggtacatgccggtagtcccagctactttggaggctaaggcaagaaaatcatttgagcctgggagttcaaggctgcagtaagctataatcacaccactgcactccagcctgggtgacagagtgagaccctgtctcaagaaaaataaaactcttaaaatgtgtgatgcagggattccactcctaggatataatgcagagaatctttcccatctgagagacatgtaggaagttaatttaaacaatgctaaaagcagcaatcttagggctgggcgtggtggctcacacctgtaaacacagcattttgggaggccaaggtgggtggatcacttaggtccggagttcaagaccagcctggccaacatggtgaaaccccatctctactgaaaacacaattagccaagcatagtggtgggcacctgtaatcccagctactcgagaggctaaggcaggagaatcacttgtacccgggaggcagaggttgcagtgagctgagatcgcatcactgcactccagcctgggcaacgcagcaagactctgtctcagaaaaaaaaaaaaaaaaaaagcaatagtaacaataataataatggcaatggcaatagtgcaaatatccagcaataagaaaatgggtgaataaattatgttcacaaaataaaatactattaaacagttaaaatgaagaactagatctatatctcaacatgcatatatctcaaaaaataatggcgagtgaaaaaaatgccaaaacataattgataccttcagttgagtgtctataatattagtatctgaatttttctattttctaaaaattatttttaaaaagctttgaagttcctatgaggttaaatttctttattgcttttttcttttgtggtaatagcctatagtatagcacttttaattcatttgtatttacataaaaatttgtaataaaaccagaggaatatttaatatttatagtcttacatttaatcattgacacacgtacaacaccagtagcaaaccttttaaaacatagccttttgttccccatgaaaattattcttctttccttttatattgacatcaacaaatttccagttgtttttccttagtaatcttggaaggcaccctccatcaaccctcgacaagtaacatagtacttattccttacacggcaaatgtgtgactctataaagtaggtcatgcccttcccacagaggtttcctcacacaaaccaagtcacatttatagtcttagaaaagcagctggcaagttaagggctgaatatcaggctttttcctagcaaggtttatatatatatacatatatatttactttggaatgtagatatcattaattcatggttaattgtttgcctggtacccaaaggcttgaaaacaggctgagctgttatcaactgcatataaaggtgaagtttcttaaaaatttgtgtaaaagttaaagaatttataagtagtctttaaagtggatcttatatagaaagccagtactgcactgcaaatttatttttaaaatattttttatatttgaaagagtaacttacagttgtttgtatttcatttaggtcctttccaaagctaaaggccaaggaaagaaaaaaatatatatggtaataaagttgcagaagatcccttctgctcctttagtgatgatacatacagagaggaagcaatgctggatgggttctttgtcaaaatatttgtttggcaaaaatattcagaaaactatgcaagataagtaaacattttagaggacctggaatgtaacgtgaaggcaagtcttggctcaatcaacatgaaagaaacagtctcacttcgggtttattacagacacatattcatggtctaatcagcatctttaagcatgatacacaacagacagtttttaaactcctttatatttttaaggcaatttttacagttttagggttatttaaagtcagtccctgcttatagatgccataatactattcattcctattcttttacattgatatttattagccatgtcaaaactttcacagatttttgttttgttttccttttcttgaatgccttcctatttcctacattttttgtcacaatatatctgctgcaattgcattttagtttgtttattctcctatcacttgccctcagaattcgtatatatgtatatatgtgtgtgtatatgtaacagactgtacgtagtcagcattgacgtcatatgtcagcactgattaaactgcaaaaaaaaagtttaattcctatgtcgtccatctctaaaatgttttttttattattgacggtctattctagttcttatctacacacatactctactttcaactttatatcacatttttacttagcatcatacatttattttttgatacggttacatcacttttggttaagattatatatgtataaaattttcttcaacttttttatagtagtgagcatttatgtctttttaattatttggtattacaaataatatttccaaaaccaccttcataatacatatttcctcctttatgttacttcccctaaaaaatgactattcagaaatgggaaatggagtcaaagttatttgccaaaggatactaccaaattacaacttttagtaatacataaacacagaggttgcatgaaaacttttttttttatgttttagatttcaaagaaagttttcctgtatatcctctcagttgacattcataattatcacaaaacttctgtgatgaccttagtggattattattctaaattctacagaggaggctcacagtcgagtgacttttccaaagtgaccttcgtggaactagaataaaactcagacctgcctcaaaatatagtggtgcttccacactgctgcaattcctctatgaccttttaaataaaagtcttcaacttgaaaattctccaacttccttaatttttcttgactcttctgtgtagaagactttgaaagtcttcactccagaccaagatttcaaaatatttaacgggcccctgcatttattttttagaatgttgttagggcaagataagctcttacagagagaatgctctccagtgagatacaatcattcagttagaaacatcatgcatctcatttataatgcatttcttattcgattaaaaagatgaactcatgagcatctttggacagataggctgcgcaggctggaaggagggcaaacaagtaagcttactacaggcgctatgctcaggcaatgcaacagaatgttcaaaatgcaggtacatttactaccctaaagtaaaaataagatgactaaattttgcagaagatgtttaaaataaaattttgagtgagatgtttacttttcttcaaatgtcagggaaacacaatgaagagaaaatggaagcattttgaaacatacccagcatcaccagaggtctctgccgccgaatgttgaattagaatctcctctccacgactggctactgagcgaaggagactcttctgctcggctaattcctgttctaactcctgctcaagggaaaggacaaacgcaaacacatttgctactttatgattattgcctacaatcatagttctagctataaaattctcagagaacttcggtagtgagcttttaagtttgcatattgcataaagcatgaggtttatgtaaatattcaaatgtgtctccaaagtactctgtagtgttcttttgctttgatacaggatacctctgaaaaatctgggggttaaaaaaaaaaaaaaaaccaccaatgggaaaagaaaattttgccgggcaatagtgccctcaagtggtacaaaatgtactctcatttttcaaaatcaatattgtcatgctaaaaggatagatccttgggaaaagtggctttttaagttctccacttaattgataaattaggttatcaatagatttggctttaattcttcattatttataataaatcctcttgttatttgagaaaataaaatatttgaatatgctttttacatacagttaaggtaccaatgagaaatcattcttattcatcaaagttcatttgtttcactaggcaacaattagcaatcctattttgtaacgacatctacttgaaagtaaaaatacaaactgcattcattaaaaaaaataacaaacatgcaacttacactttcaccaaacctcaaaaggctttcctgagatttatattaaaattaaatagattcagagggcaaatctgaaaacagaataggtatctctggtaaagaagatgagagccatgttacactatttgtaaacctaaacacaagcttttcttaaagactggattttcaaatgaccaatcatcccagtggtcatgagtcaatacactgaaacaccaacatcttgcttcattcaaagagaagataaagagacactctgtctttagtacagaagcaacttgtctgtccttctgaaatatgcctctcaggttcttctctgggcagatctgcaagctagagagaggtaggaaacactttactttttgttgctggagactgctctgccgctgctgggtccatgtggtgcgagcttgggccagccattcctggacgccggggctctgcgtggctgttaggtcaacatcgctctcctccttctcctgtgctgttccctgcttttaacgaggcagaaatcaagtcatgctacacaccggaaaaccttaaccaaaggggagagaaggctactttggtgtgatctatgtaatgataccaaagtggctccactgggatgtgaaaccacattttttaaaaaaaacagtaacacaaaacccatctaagttatggcatttgcaggagcaagaacaacatacagataatcacacatagaactgtttgaggggaaaacccatatatttagaggttagtcttttagctgaccaatgtggtcatcagatattccagattttttttccacaaaaacataactcaagatcctttgatgagtttgttttttaagtcacacaaaggtaaactgtttctcaaatgatcattacccacaataattgtgtctctcccgtgaaagcattaccctgccttatgtcactttctctaatccaggtccagacaatgaaagatttttagaataatcttcctaaaaatttttctaaaagattattaatcaaagacattttaatgtctttgagaagcaaaaagttcactgttctgtaaggcatcatactctctggaattcagtaagaacttaaatttgattctcagttcatatgggagaaaatgtactgcagcatagaggcaaggagtctaaacaagggtttcccaggccggctggacatcctctgttccacctttcacagaccaggtcttgacctctatgtcacagagcctcacctccaccacagtaactcaagtcccaagacactgaactaggcaggaagcctcatccctgatactggtctgtgtaaaccttctgtgtctaccctactagggcgatagatttaaattattcctagaattctctatctttgagagtctgctgtttatataataatatttatagactgacctacataattaatagactgtactcaaagatgaaaactctttaagagtctttctttcagaaccatcaattagcacattaaaaaaagtcatttactgtgggcacgtgtggttaccattttacaaattcaaagcttaattgagccttgagaggtcagtggtgtgattattaaaggtgagatctctgaaaaagtacccttcactccctccatcaccatcaccagaaactggcccattgctaagctggcttggagaaagtctgactaaaggagaaagaccaaagtaatgactcagcacctaggcaagagttgatccttcctgcctgattattctaatggaatttgaaaggccctaaaatgttgcacatcaaatgggattagttctgaatgagagcttttctactcacatagattcatctgtcaaaggataaattataatttcaatataactcattcactacttaataagcactcactagacactgttctagaagctgggagtgttttggaagccagatgagggccctggtggggagttagactataaacaaacagataactgagctgaagataaggcctacagagactgataatgggatagaaagttttagggaggcctaaggaagcatctttagaagagacaattgcactctgcatgacgagagaccaccagccttgcaaagatctagagtgagggcattcagacccagggaacagttggcacaaagaccctaaggtgaaagaaatttgccatttcagagagaacagagcagtgaagaggacagcagggctggcgtaccatggggcagaggaaggatattttacaggttgcttccacggaggagcctcctgccatctatttctggagctgctgctcgcctgcccctggttgttctttgcaatgtctgagcacaacatgggacccagccattccagctcatccaacctaactgcccacagagacccttctctcgctctcctattttcagagttttatactcaccattttagggaaatagatgggatctgtttacctttctgtttcttctttttttcattagaatctcatgattaaattgtctaatagactttatctttatctttgcaaggcggtgtcggtgcttgaagctaaatgaacagtaaaaacctgtaggtaatagtatataaaactttctcccagattctgagcccacccgagctcagaggtacttcctttcctttcagatgatccagccagagattgcagtttaggtagaacaacgggggtgcaatggtctaatatatgctagttgcattttgcaagaccttcagaatgggtgactagtgacactaaattctccaccttctgcggaatttctcaaagataagcagtgattttcctagagatgggaagtttgggtggatgggcattctcccagaactggaacccatgattttctgcatgaaaacagattctctctcatctaagactccaccaccttctaagaataagctctaaaagatcctggttcttccaagcaaagttgaaacagcagttcaaaaggaacccatagaaaatggcctcaagaaatcagtggacgagactgaaagttgtccccatcagagctgctccagctgccaaagtagtggccctggccatgacctgctgacttgcttttgtgggatccaggccacttcctctctgcttttctcttcagcaaaaatttgtttttcagagcccggcctgaagactcccttggaaaattctccgagccctgagcccaacacgctcttctacaccagttactatggtctgattgagagaggttggctcaagttccttacaccaaatttggatttggaacactgacaatcgaaatgttaggtcttaacaacttcctcacttttatatgcacagatatatattcagattctatgcggttagactcagtttttcagtgagtgaatttttctctgaatgatttagtcattgtgaaacataagacttggaccacaggaagcaaaccatgattaagaatccagttcaaatttcattctctttcccctggggataagaaggtgcagccagaaggaatgtaattatggtaattactttctctgaggtgtgataacagttttctgccatgcctagggaatgcagaggttaggcggtttctgtcaccagtccccactgggtggggctacataaactttattttggaaatactagaacagtaaccacttttgccaggaacattccttggaagatgaatgaggactgggcagtgctaaacattacataaaacatttctttataaagctttttattattttatggggcaatctctctgttcttttaatgaatgataatgtgtgaaaaagacccagcttcatgaagataccacgtaattcaggagatcttactacatgcccttaagatcttcacatagagaagcagtctatttgataggaaacaaaaaagcatagtcattcactgatacccatgcaagtcaaattagttaaaaggaatggaggtaagaggtattaccatctcccagcttcagtagcactaagtaatggtgtgcttacagacttaggaaggtattccaaccctcctgaatcatccaagccccaattaaagagcattaacattgctgagggctgcatttaatggatgatttgttttctgcaattaactttagttaatttcagattaactccaaattatttttagttttctacataaagggacatgatccttttcatggcaataataatgtaaacagggctccttttcttcccacagatggaaaaacaatcttccaggaagctctaattattttaaaagatctagtaatattttatatgctgggaacttcattagatgaaagatgatggaatttatagatagtttaaaaataaacagtaaccaatttccatgtagtaaaacactaccacatttttctgtatttacacttcacccaatgtgggcagggtcaggacttgactcagtttaaagaattcccgtggacctgggcaggatctgctgggtgtggacaccacagtggtgtgtacatgctcagtccagcccgctaagtctcaagcctggcctttcagcatagcagaagcttcttcgtctcaaagaatgtgatttggaaacagttggttattgttattaattattttaactgctgcaatttgagcatttattgtattacttgcatttaaatcctcactgttttttttctttttgattattttttccacatgttctaaagaatttttttaagttaaatattattatccatattttacagatgagaaaactgatccgtaagaaagttgtggaaaatttaaggctcttgccccaggtcacctcgttaataatgaatgggaaaaagataaacagatttcaatcctggcttgtggatatgctttctttggcacacaaattattttaaaattttagatttaaatgtcaacgtttaaaagttgggaggctttagaaataaatccacattccctatctcttgaaaaactagaagatccagcaatgccacttgtaaattcttgtgtgataatagctagagcttagtaacagctgcttcttagacaggagaccagcttgccaagggccaggctgggcctgctcccctcattggttttgcccttcccaggccacgagaccttggaatttgtggttcctgccttgtttaatccctcttgtgcttgtgagtgaggatcaggccgccccttcccttactacctgcctctagcggtagggtggggcaagggagtaataagagctttataaatgattgctatcctacctaggaaactttcaaggctttccctttattttagcttctttagaaattaagttcattcagagatcaccactgaaaatagaagaaagcattatatattagacctataatagctgtttacaaaactaggtgaattgctgtctacttttacagctagaaaatcattctacttctgttcagttttagtatgtgtaaccttttcttttgactttaattacaaagtcacattgcatgtgcattttcaagtgtgtaaatccaagtgaaaagttatattttttatttgcatctatttacccaacacagagttcaaacgtcttttcatatgttcattgtccatttatatttcttttcctgtgaattatctcttcatatcttttgtccatattctattatttgatctttccttattgttttacaaaagatttgtgaattgcatagtttcttccctgtttgtctatgtcttttgttttattttgtgttactcattcctccctgtctatgtctttcaatttggttacttttttgggggtggggaaggggggtcatacagaacttttttatttttgtgtagtagtttcatttttatttgtttatttatttatttacttattcatttttgagatggagtttcactcctgttgcccaggctggagtgcaatggcgtgatctcggctcactgcaacctctgcctcctcggttcaagtgattctcctgcctcagcctcctgagtagctgggattacaggttcccaccaccacacctggctaattttgtatttttagtatagacggagtttcactatgttggctaggctggtctcgaactcctgacctcaggtgatccacctgcctcagcctcccaaagtgctgggattacaggtgggagccatggcccatttgtttatttttttagttggcgtctcacactgtcacccaggctgcagtgcagtggcacaatcatagctcgctgcagcctcaaccacctgggcttaagggattctcccacctcctcccagcttctcccatcccagcttccttagtagctgggaccacaggcgtgtgccaccacgcccggctaatgtttttattatttgtagagatggggttttgctatgatacccaggctggtcttgaacttctgggctcaagcaattctcccttcttagcctcccaaactgctaagattacaggcataagccaccaagccctgccaatgtattagtttaaaagaagctataaaattatgggtttggggtatactggcaaaggttttccctatcctaagattaaaaaaaaaaaatcatacattgagtaccttgcagacttaagttttatattgaaatctttgatccacctgtgatacatttttctgtaaaatatggggtagaaaatacagtttatcacgtttcaagtgattatttacagagtgagtcatattttgtccactgatttgtaatgccacctaaaatatttatcaaattcctttacataccaaatctctttctggaatagttattgtttaattttctgttcacatatttattgcgccaacaccaaactattttaattattgtaatattgtattttaatatgtgattagactggccgggcatggtagctcacgcctataatctcagcactttgggaggctgaggtgggtggattgcctgtgctcaggagttgaagaccagcctgggcaacattgagagacctccatctctacaaaaaattaaaaaaattagctaggcaggtggtgcgcgcctatagtcccagctactcaggaggctgaggtgggagcattacttgagactgggaggcagaggttgcaatgagctgagattgcgtccctgcactccagcctgggtgacagagcaagaccctgtctcaaaaaaaaaaaaacaaaaaaaaatccacacacatatatgataagactaataatccctcaaaactcttcattttcaaaattttatatgggatattacattattcctctaacttgttttttgtctatgtaaaaactataaattctcgacttcttttttttttttttttttttttgagacaggatttcactctgttgcccaagctagagcacagtggcacaatctcggctcactgcaacctctgcctcccaggttcaagcagttctcatgcctcagcctcccaagcagctgggattacaggcatgccccaccacacccggctaatttttgtatttttagtagagatggggtttcaccatgttggccaggctggtctcaaactcccgacctcaggtgatccacctgccttggcctcccaaattgctggggatacaggcgtgagccactgtgctcggctgacttcattttttaatttttattttttgttggattcttttatgcttttcaatgacctaacttcatatttttaataagccagtcatcttcctaaatttctccattgcttctaaatagtttttagttgattaagtttggttttccatatcatataatcatatcatcagcaaaaagccgaaaaaaaaaatacataggttagtcctaacaatcatcctcacactgagaaaacagaagcaatcacagtgaacttccatgaagtttccgttaacaatatttatgtcctacttcctaccagtatttgtattccaacatagatgctttccctccctcctcattttacttggagaacagattggcctggtctcaaccattattgcaggagaaaggtgtaaatggtaaaggaaggcacagtttggattaggccacaagaaggagcagatgataccatcagatgcttatagggttggggcagctaatgggcttctaaactatttggtccctggcttacttagcaagaagggtagggaagaccaaactctgcactcttttttttttttttttttttttttgagacggcgtctccctctgtctcccaggctggagtgcagtggtgcgatctcagctcactgtaacctctgcttcccaggttcaggttcaggagattctcctgcctcagcttcccaagtagctgggactacaggcgcccaccactatgcccggctaatttttggtatttttattagaaacggggtttcaccgtgttagccaggatggtctccatctcctgacttcatgatctgccagccttggcttcccaaagtgctgggattacaggtgtgagccaccgcacctggcctgtgtactttttatcctatccgtttcctccccaacaagaagattgttcttgcaatcacactcctttttctttttcttttttttttttttttttttttttttgttatgagacagagtcttgctctgtcgcccagactggagtgcagtgatataatctcggctcactgaaatctccacctcccaggttcaagcaattctcctgcctcagcctcccgagtaactgagattacaggtgtccaccacaaggcccagctaatttttttttttttttgtatttttagcagagatggggtttcaccatgttagccagtctggtctcgaactcctgacctcaagtgatctgcttgtctcggcctcccaaagtgctgggattacaggcgtgagccacggcgccctgcccacattcctttttcaccaacttttcctctattgagttatttccatcaacgtgtaaacttattatttttctgatcttaaaatgaaatactcaaattgtgatgaatgtaaaagaaaaaaagagataaaattttctttgacccacttctccttatagcttatctcattcctctatataccactttacagcaacactcctggagtagcctttactttccctctccagttcctctcctctcattgttactttcatgtcagagtgctttttgcctccaccactccgctgaacagctgttgttagtagtcctaacaaaatctatttgcaaatgtttgccaaagtccaagagtgtaaacttaaagctgcatgctaaaatgtcagcgtaaagcaggtacacacacaagtacgcgtcaccgccaacctgttcctttacctggcaaaccttagaaggagcacgtgaacagtgtgccaactttcagctgtgggccagcggctggaaccctcacctgcatgttgagctgcttatcatgcagggctctctgcagctccagcaggctccccttgagccttctcagctttccagccagctgctcggcctcgtccttggtgtgagctttgccctccagcagcaggttctcattgtggactgacagttctgataaagccaccaccttctgctctatttccaccagcatattctgcagcaacagaaataagaatgaaactcacacatctccccagcctctgcaaagactgtttcccacagtgaaatacagccctttggagtcttttacgaaacggacaggctttcatgattttttgtagttttcccacggccttgacgagtaagtagtctgtaggctttttttttatattttttaatttatttttatttttttagacagaatctcactctgtcgcccaggctggagtttagtggagcgatcttgactcactgcaagctccgcctcccaggttcacgccattctcctgcctcagcctcccgagcagctgggactacaggcgcccaccactatgcccggctactgttttgttttttagtagagacggggtttcaccgtgttagctaggatggtctagatctcctgacctcatgatccgcccacctcggcctcccaaagtgctgggattacaggagtgagagccactgcacctggcccttttttgtttttgtttttttttgagggagggtcttgttctgttgcccaggctggagtgctttggcatgaacatggctcactgcggcctccatctactgggttcaagggatccccttgcctgagcctcccatgtagctgggatcacagacatgtgacaccacacctggctaaattttttattttttcaacagaaacaaggtctcactttgttgcctgggctggtctcaaactcctgggctcaaacaatgctcccacctcagccttccaaaagtgttgggattacaggtgtgagccactgtgtctggtgacttttaattgtctgttatggtattagaggggtccataaaaaatttgcctgagcctctcaatttttcttttcttttctttttttttttttttttttgagacaaggtctcctctaaaatggagactaaattagagaaaaagaaaaatagcctttcttcttcctagataagacttaaaacaaaaaacaaaaaagactaaaaaaaaaaacaaaaaaaagttttactttccttataaatcattgtttttatgttaattctgcaccctttgaaatgtactttcttctttatattaaataaagtaatttgttaatgagaaaagatacttcatttccctatacaaaatcaaaattaagaatataaagtcaggctgggtgtggtggctctcacctgtaatcccagcactttgggaggccgaggcaggcagatcgcttgagctcaggagtttgagaccagcctgggcaacatagtgaaaccccgtctctccaaaaaatacaaaaaaataagccaggcgtggtggcacgtgcctgtactccccgcacttgcggggctgaggtgggagaattgcttgaacccaggaagtcaaggctgcagtgggctgaggttgcaccactgctctccagcctgggtgacaaagtgagaccttgtctcaaaaaaaaaaaaaaaaaaaagaatataacatcaaaccaaaaaactagaactaagtagaagagtaatacttttattaaaataggaattaaaagatgatttcctgaggattattgttaagaaattaacataattctgtgcagggttgattttaccattaggcacagcaagtacagtgctgagggtctgtgatgcttttagagccccaagaaaatgtttgattttaatttcttttaaaatcaaaagaaaaaaactgaatataataatatggaatacatcacaacaaatctattccgaatcatgtaagtctttgtaccacagcaattgtaaaactgaaaacataatttttagcacttccatgggggaaacagcctacaaaaatgaagtgcccagacccacaaaggacatcacgtggttccaattctgtgtaatagtcaccgttataattagtgtgcaactgaattcatattagattttaactgacaagattttagctggcttatatgtaagattttaattgaatctaattaaaatttgaattaatttaatgtagtaatttaatattagatttttaaaaactattttctggtgtgatttaatatgtttccagtttcttaaagtaagcttgtccaacccacggaccatgggccgcatgtggcccaggacagccttgaatgtagccaacacaaattcagaaactttcttaaaatgttattttttttttgtaatttttttttaagctcatcatctagtgctagtgtattttatgtgtggaccaagacaattcttcttcttccaatgtggcccagggaagccaaaagattgaacacccctgtcttaaagtatggtcaaaacactattttaatactttggaaaagtattgaaatacattacctggtttatggactttatgtgttacaataaaaacagatatcttcacaagagagaggtggcagtatgataaaacataactttgaaatgttagtttgggtggtaacttcaagtgccaaaaggcaatgggctaatagatgtttcttctcaaaaaataaacattagaaagaagatataaagagcagaaaaacttgcatatggctaattaatctctatcatcatggcaaagaataacagtgctttggatacacatagataagtttcctaaagcattaaaaaatccgaatgataatgatcaatattatgaatctcaaatcacaaataagaatagccaaaatggtgtaccgtaaattaagaaaaaagttagtgtgcactaagtaatgattttcacatatttcctctgagtccaaaaaaaaggaatataaagttgtatatattgatacttaaccctgaagactagacagggttttctagatatttcctagttaataaaatgaaaaagcttttaaggtatacttcacccatgtgcgaagtcaaatatgaagatcatcattgaagtttgatgacaagcatatgggacttcattatctattctttatacttatatgcatttttgaaaaattccataataaagaggtaagaaaatagcattagaataaagactttaatgcaattactcctcacagtaattcctagagccctaacataggtggaaaacacattctctgctccaaaagacagccttcccatcttcagtctccctgtttgcctaaaactgacacttggaaaagttttccgaataatatatcaggattagaaccaaaattgtaacagagcacctagagatacttcctgttgtgtttatttccagtctgactcactgctactgattctccccattggctttgtattccttaataagtactaaatacagatattatggtattttggtatctacagtttttaaacatgacctttaggaagccggagacactgtggtcaatgtttttcaaaaagtgagtccaagtttggatttcatttaagcttttataatgtattacttttctattctttaaatgtataaagtctatgggttgggaaaaatcatatatccacaccaagcctttttatagtatgttttctgtagtttaaaaaaatgtgcttcatgatgttgacatattcctttgagaccattttggtacctggcagtccataagctgggcctccatgtccatgggctccttgggtggactcagcgcagtgtccagagtggccttggtactcaagagccagctgtccagctcatcggcttcacagcgatacctctgcagggcctgttcctgcctttgttcctccagctgatcattcaacttctcctgttgaattcagtagaaggtaatatagatcacgctaaggtaaaatcttgagaatttaacacagtaaagcaatggttccaggccctggctgtacataagaatcactggtaaaacttttaaaaatttcctttgcttaggccacatcccagaacaacaatcagaatttctaggggtgagtctcaaaattggtatttttaaaaagactccctagtgattttaatgtgtacctagagttgaacaaggtattctcaaataacatacctataggaccaggcagtaatagaaatgatggaaatcagtcaaggattagaacaaaacaatggcataaagcggttggtaaatggcagtagacaccggacctctatttctgggaagagtagggagtgatggagactgtggcaaactgaaaaacatgcggcctgtctaaaacagcagccacatacagtttcaggcaattgatccctgtgggaagcggtggcccagtgttaactttcatctccagtaaagggagaaatccaaatttctaggttagctctctgagtttttcaatgattgcaaataattcatgttgaaaaaaaaatcgacgtcaatcgcttcattttgaaacccccacaagtttttcatagagttactggggacaatataaatgaattaaaagttaacttttaaaatactctaaatactttattttaaaaattattttatgaataattcattattttaaaattaattttattaaaccatttaaaatagaaattaagaagtagggcagacacatcggctttaaatttctctaatacaagaagtattaggttggtgcagaagtaattgtgatttttgccgttacttttgcacaaatctaatatatgaatatattatttgactaatcatataataggtaaaactagagagagactacacacccagcaacagggtcatggttaattgcattatggtgtaattagcagctaaataaaataatattcagttcatataataagaaatgtattgagaacccattatgtgccagagaagctgctaagagatacaagatgatagatactgtaaaggtctttagggagcctccagtctaaccaaactacaggagcaacaatatgagtagcctagaagcttagggccaagaatttacgagagaacaaataaaaaaggaagatagctgatttttaacacagatattactgctgcccaaatttgtctctatattaaataatatttaaattaagtaacgtgggaaccagaatagcaagagtattttcatgaattactatgtctgaattggctaacagtgactaagtaggatttattctttatagtgttagtaatatcatccatcaaatgctgtcgtgtaaacatagcaaaccattatgcaaatcctctacaattattcttcacaaggctcatgtctaccaagaatttgctttccacattctcaatatttcacgcctgaaatgagtcagaaaggagtcaaaggacatattcatggctacacactgactgtactctattcgggagactgttttgttttgtttgtttgtttgtttgtttgcttttttgagacagagtctcgctctgttgcccaggctggagtgcagtggtgcaatcttggctcaccacaacctctgcctcccgggctcaagtgattctcctgtctcagcctcccaagtagctgggactacaggcacacaccaccatgtctggctcatttttatatttttagtagagacagggtttcactatgttagccaggctggtttcaaactcctgacctcgtgattcacctgcctcagcctcccaaagtgctgggattacaggtgtgaaccacccctcccggccgtggagaccattcttgaaacacaatcccagcttaggagagggaagcaatgaaaatgtaaatacgtaagtaacccacatacttggtaacacaacgttaaaagttaactcagaagtgaggaggccactttacagttattggttacctccaaaagctgccgtttccccgaggctttcatcctgatggtggacattcgctcggctaagacagtgagcgtggactgcaaggccagctgctccgcagggtcggcctcacaagactcggataccagctcctctgcgagagaggactggagctcattgatttcatcctggagcatgagaatctcatccatcaatgcctggaggaaagactgtggaatcacactcatgtattcatttcttcactgagggatcattagcactagctgagtctcacatccattgggattagcggaagagatttcacctgggaatcattaatcaatcaacaaatagcagcctactcacctacatttctaaatgaaaggccaggacttttctgattttatgtatgtatcactaaccaaagtgagtttgaacaacttaattaatctttctagttttcaataggatcatctgtaatacaaggatcatctgtaataccaacttattttttattttttagagacagagtctcactctgtcactcaggctggagtgcagtggtatgatcacagctcactgtaatcttgaactcctgggctcaagcggccctcctgcttgaagctgggactggtgtgtgctaccacacctggtaatttttttttttttttttttttttttttactttttgtaaagacaggatcatgctatgttgcccaggctggtctcaaactcctggcctcagggaatcctccagcctggatcacaggcatgagccaccacatttctcaatcatttctaagagtctccaatacaacgttgaaaataaaatgtattactttcttcctcaacatgattttcccacattaacctgttgctttccccaaatctgaaacagcattgaactctagtccaaaactcacatggtttctcacaggatgggagaaacctgtaacctatttctatgtcgtcacactactcatttttctcatttaccaaactctaaaaaataagggtctctcccgggtgatgtcttccattcccaagatttcaaatgctttctaatcctgagcacttccaaaggtacatccctaacccagacacctgccctaagtttcaggctgtgtattcaacttacctagttcacgggtgtctgcatagtgttaagtctaatcctgcttccccgcctgtcttccaccacctctcattatggctcaagctggagacttgggaatcactcttcacaccttcctctccttcactcaccagatccaaaccatcacccagtccaatggcttttatctcaaaaatatatcttgtatatctgaatatccccactgcccccacctgaagccaaagtcaacttcctctctcgactgagttgctatataatggtctactaatgagtctatctgcttacactcttgttgctccagtccagtctatatgaagcaattacagcaaccttttgaaaatatcaattaggtcctctcactcccctgctttgaaatatgtactggattcttgctgtgaaataaatcaaacttgttactacactcgtgtagtctcactcttcctgcctcgtgtgccacactcccttcttgctcaccatactccagccttcttcagccactccagggccccacttcagtcacttcctggcttcagggcctttgaacatgctgttccctcaacacgaaaaactcttcccgctctgtgtgagatggctctattcatcctttgctcttaggttaattgtcatatcttcagagaggcctttcatgaccacccaatcctaagaaaatctccatcattctctctcatagcaccctgttttcctgtctatcataattatacttgattttatttctcttttttggagtattttatgacttgctctttagatggaatcttcacaggagaaattgttatttaggatttcaatgaagttggaaaaacaggctctatcaccagagcggcaactatgatttcaagtaaagtaacataggctttatatttgccagcatttcatagtttccaatgtgcccttatttgcataattcctatcttttccacaggactggaggcttcactgtaagtgcagtgcctcctcagagtgggctctcacaatgttaaacagcaaaaaccccttatcttttcctaatatcaaatatcatcatgacaattaatttttaaataaactattaatattatatacatctagaaaagtgaacagattataagcacaccaactatatatatccatgctgctgctacccagatcaagaaatggaatatttccaggattctataagctcttttgacctcctccttcttgctactgctgtcctcaaaaatcaccactgtgttaacttgtaaatatcaggggactttggcccttatttgagctttatagaaatggagtcatacacgatgcactgctctgtgtctggctcctttcatgattgtgagagtcgttcattttgttgcacggagaaagagttaacccatttttatcattataccatattccactgtcgcctggttgtgaattgttttcactttaagtttttctagtgggtttaatagtggaatctcattgtaattttaatttccatttccccgatgactaatgagattgagtgtcttttgtgactgcctgctaaaaatcttttgcccattttccactagagttgttccttttcttattgatgtatggagttgtttgtatattctggataggagtgcctgtgtttcttttggttctgcatatagcaaataatctgttcccactttgaggcatggttttcccttaacgggaagagacttccttaataatatctgttgatggaaagaagttcttaattttatcatggtctaatagaatcaatatttccctttattgttagggcttttggtatactatataggaaatcttttgcctaatccaaggtcataaatagaatacattcgcatacgttatcttctgtaagaatgctactcaaagcgtggtccacagaataataacagtctgcacaatgtttgttactggcttatgatgagataaacatattgagagcaagtgctaagaaacttttatagtaatttgacagttatgacatccaagcagcatttgatttaattttactaaagtatccgtctgtgatggattagaatgttttttaaaaagatcattcaccatagatattttaaagtattattttcaaacttttttttttggtaataacttcacatttagatctacaaaccacataaacttaattttcatgtccagtgtagaaagaggtgaaaattcttctttttttcacccattgttttgcagtgtaatctttgccacaagtcaagtgtctgtataaatgtgattctgctctgggctcgaattctgttccatcaacccatttggctgtttgtgcaaataccacacaatcttaattattgtagctttataaatctccctatctggtaggatatatctttcaactttattaatctttttcaagactgtcctggttattctttacttctggcatttttaatatatattttcccacacatttgcagcatactttattattattattactatttttgagacagagtctcaccctgttgctcgtgctggagtcagtggcaagatcttggctcactgcaacctctgcctcccaggttcaagtgattctcctgcctcagcctccagagtagctgggattataggcatgcaccaccacacccagctaatttttgtatttttagtagagatgtggtttcaccatgttggccaggctggtcttgaattcctaggctcaagtgatctgcccgcttcagcctcccaaagtgctgggattacaggcatgagccaccgcacccagcctgcagtatactttagaattagcttgtcaacctccaccaaaaaacttgctgcaatttttaaaacgtgattgcaatgaatttacagactgatattgtttattatatatgcaaagtattttttatacattcaaagtattatacattcaaaaacttccattcagtaaattattttccattatttcataataatgttttgtgcctgaatgctaaaagtataaaatctatatttggtttgattttaaatgctcctccataattagatggatcttattatgtctttgtttttttttttttacactgatccttctgtacaagcaagaagagcctcctaacaatttcacactgtgttcattctcatcctctcttctgtgcctttccacacacatttacatttatagtgcctcctacccactcctgttgccattccaaattttcaaactctgtctcctcaaagtccttgttagatctcatttaacctactttccactaactgtagcccacaagcagatttctgttttctgtttgatgtgttggtaactctcaccagcactacctcattaaatctcattggctttgaccaaccaggtgtgcactgaaggtatcagctgccatttaaaactcacaatgttcttaaatagctctctgaatgttctgcagtcagtaataaaggaattaggaaaatctggaactgttcacttaaatctttttttaatttttttgggagacagtctcgctctgtcacccaggctggagtgcagtggcacgatctcagctcactgcaacctccgccccctgagttcaagcaattcttctgccttagcctctcaagtagctgggactacaggctgcaccaccacgcccagctaatttttgtattttcagtagagacaaggtttcaccatgttggccaggctggtcttgaactcctgacctcaagtgatccacctgccttggcctcccaaagtgctgggattacaggtgtgagccactgtgcccagcctcacttaaatcttgttagaagcagtcctctccactcatgcttgagtttactcttaaagatgagtggacatttttggaaggtagctagagtttttaacttcaagatctagcagccaggctcagggggggcgtgagattttcttttggggtcataaaaatgttttggaaccagagagagacagtggttgtacagcattgtgaatgtactaataccactaaattgtacaatttaaaatggttaattttatgctatgtgaatttcacctcaattaaaaaaaatttagccatcaaatatgtcttcagtcccataactctgagtataagagctggtggccagcagctacccgacaatatatgattcaagataaggagaaagagatgaaatgcatgcttttgggtttctgatttgtaattgcaaacttggcatgtgtatgacacttacatagcttagagaagttccatgagcttctctaacataaaaactctttaatagtaagggtgaaaagaaacacggaccttatgtgaccttcagaactgtctacatgaacacaagtttttgtttgtttgtttgttttagggggatggaagcttgctctgtcacctagctgccatctctgctcactgtaacctccaccttccaggttcaagcaattctgctgtctcagcctcctgagtagctgggactacaggtgtgcaccaccatgcccagctaatttttgtagttttagtagagatggggtttcagcatgttggccaggctgaaatgtttcctattttatttatttatttatttattttttgagacggagtctcgctctgtcgctcaggctggagtgcggtggcgcaatctcggttcactgcaagctccgcctcccaggttcacgtcattctcctgcctcagcctcccaagtagctgggactacaagcgcccaccaccatgcctggctaagtttttgtatttttagtagagacggggtttcaccatgttagccaggatggtcgcgatctcctgacctcgtgatccgcccgccttggcctcccaaagtgctgggattacaggcatgagctaccgcgcccagccttttttttttttttttttttaagcctacagtacctggtattcctgggcagtctcccatccaagtactaaccaggcccaaccctgcttaacttccaagatcagatgagagaccacagttcttctcacattctattttagttgttacatatatgaaaaaacaaaacaaaacaaaataaccacagacctctgtgcgctatatatcactgagctttgtgtggcaacacatgtccctaaagcatcagatgcccatgataataaggtcgcaatgacagagggcttaacagtcagtacaacagccacaagtcagctcatgaactgcattcaaaccttaaaatgaaatctgtaagacagccaagcatggtggctcacacctgtaatcccagcactttgggaggccgaggtaagtggatcacctgaggtcaggagttcgagaccagcctggccaacatggtgaaacctcatctctactaaaaatacaaaaattagtccagcgtggtggcaagcacctgtaattccagctactcgggaggctgaggcaggagaatcacttgaacctgggaggtgaggttgcagtgagccaagatcacgtcactacattccagcctgggcaacagactgagactctgtctcaaaaaaaagaaatctataagacaatttagagaggataaccagaaaggcacagcattccacacaaattcagtagtttagacaagtgtttaaaggaaaaatgtaggaattaggttacctccttaaaaaaacatgaatacttccaagagagtgttgggaaagaaataaaaactaaagtatttctattactttttaggaaatataaaaaaccatactggacttcctcacacccattcagttgaaatttagaaatagtaattctataacagtgcttgacatttttaaagtaccattcctgaagctaagaacaaatttagatactgtgataccaccagcttttcatgtgggcagctgtgttccagaacttgtagaacttctggcacagacagcaaaaggtagcaaaaatagctcagatgaaatatgtgatgatacatgaaattatatactaaattctacattattgctattttctttccctctcattagaacattaatatgttctaattatattaatatgatatattaatatatacaattatattaatatgatatattaatatatgcaattatattaatatgatatattaatatatgcaattatattaatatgatatattaatatatgcaattatattaatatgatatattaatatatgcaattatattaatatgatatattaatatatgcaattatattaatatgatatattaatatatgcaattatattaatatgatatattaatatattttctctcttaataaaccattaagccccaatgactggtaatcttcactaaattagctgtacctccttactgctgtgatggctagtacgactactaccaacttagaaagggaaaaaaagtcatgtggttggccttaatgacaagaaaagtcacagattcacttctaatttataattatcagaattaatgtgcaattttgagttgtctccattaaatcccttgaacagaatcatcattttgctccacattcagtttatgtgtgtttccatcctaatgcctgagcaacagggtggtggtgctgattggaagctaacttgcattttcatgtacgaactctggaagggcagagcaggccaccagtatcctgttttcatgcagctcctaactattgtgggagccagtgatgggtctttggcaattgtgggcagcctcctgggccacaagaatgggggcttgaacaaaggtggagatgtcctgaagctggagagagggtcaaactacttaaactttctgcaacatcgtcatctgataatctgagtgagtgactctcaaatgcactctaatccagcccttgcataatttacactatattccttctgaatgcttaaagaacggggcctcctacagaacagccatcgaggttggcctgaggagcacatactcaacctgaaggaagctctctggctccttccagtacagtgaagcagaggtgcagggaacagctggacagacagaaccgcaggagcaaggaagacctaggagccacagggagcacactggagcaacagggacaccccttcagatcagaaagaggtggccgctggcaacagaaaactgaagtagcagctaaagagaactgggagacactgaggcccctttagaaaggagaggggtttgggagactagcagtctagtgataaaatgggggaagctcagaagtaaatggcattggaatagtcccccaagcccctgaccatcctcctgattggtctggtcttggataacaagggttaattctcatttcgtgctttcatagcatcctctgcaaatgtggctaagggtgggtgactgtgggatagcagaaagacctacagaaggtagttttttaccaaaataaggcctaaaaatggacgctatgcacttcgatctctatcttcagaagtcacaagagtgtaaaaaacctgaaaccactatttctcaatatgctgtctctagatgaaatgttctcatttttatgttatactgaaagatatatactgcaaaagaatgcaactttatctgactacacatatgaacaggcagtctattccaaggttatcctgcttccaaaactagaaagatgtaaagtagaagaaagacaaagtacaacgtttcactcctaaagctgttaagttaccctgtgttgataaacatgcttaccatgccatgctttcatagctcttaattaacatctaaaaatatctttctttcctcctgccttctgaaggattgtcacatgctcctgggttcttgtcccagccaggcagcattttcctacctcacggtgatgaatatgtaggagaatgtgtgcctcagtatccttagaccccagttatacaaaataaatataattttaacagcgtacctcattagactgctaaagtattaaccagactttaatttctgaacatttcttagcatgcattttaacttgacacatttttaacattatctttctgcattagattaatgtaatgatctctgtttttcatgtaaagctaatattttgcctagtttaaccttttaaaaaatgatttaagtcagggacaatcacaagatgagacttagaacttatgaagtctgagatgtattttctgaagtgataatggaggggcaccccctggctaagtttcttaaaacaacaatatcgagaaaaggtagatttggagtatattttattcttacaacaatggctcacaacaaaatcaaaataacttggcaactctaaggaaacacattttgtgtaatcaaagttaaaaagcaacataaatgcatgtagctttctttaattagattcaaggtctgcatgtctctctctctctccctctctctctttttctcagatccctccctgaatcagtagtagaaatgaccaccattaggacccttgtttactctggaagaactgataaggttaaaaaatttttaaaaagtcacctggctgtctcaaacacatgcctgacaggccaaccagtcacaacagtgccttattcaatcaagtaggaaactgaagtcatggctatttgtacctgatgttcagccatctggctttctggactcctgccaggctctgggctctcactgagtttcagctcaatggcctccatcttcgtagagatggactggagggagtcctggtacttctgctggcgttccaaagcttcatagagtgtgcgctgcttctcactgatctacaccagaaaagggatattaccaaatgcttcccagccccttatctttcagattacaacatttctttcttcagtgctttacctctgtggcccaacatagggtactcaactgtggactggatatgtaaactctctgcatgtatttcataagacaatcgctaaggttactggtgtctggtgggcataaactagtccaccttgaagacttaccacattctttaaggtttcccaagaacgctgcaaatcacccagtttggcagtagcggatggctccaatcccggttcatagaactcctgggatgcggatgtgctggggtgaatttttgcagcatctgtctgcaacctctcagcagacaaggcttggtaatatgcaatgtcctgtgagtgcaaagcacagtattgaattaaacaaaaagacaaagtctagattaatatgctctgggtactgttggtcatgtcaaggaaaggtttcagatctacacctttcatggggcactacaaactagtaaattagtaaactcttgtgacaagaaaaatgtaaagactgtatcaaagcacactgtaattgtttcagaattttggtttatatatatcaaaaaacaactttaccaatatttcaagttgccaaaactcaatcttattctatgtttgttaaatggaaatacaaaggatttaagcagtacacatgtatttaaaggttgattagaatagcaaaaaaagagaatcttaatgatctagttcctaaaatgttgtcgaatgtattcattaaagttttaaataatttaaaaactacttgacttaaataaaattaaatctacagatgcagccagatcttcactatctgtgggttcatcatttgctgaattaatttaaatattttgatattaaataagaaaaatgtaatggggaagttaccactactctaagaaacaaataatataaaggttttctatgcatttcctaaaagtatacacacaaaaaaaacaaagtgaatgatgaaatatcatgctttcaaattttttaaacctattataacattacatattttatttgtactgataaaatttactatatcaagagatatagtaaagatatatcaagagatatagtaaagatggtttttaactgtttctatggttatttatctgtatttcagtagaaatttaattgggggagtaattgctattataaagttcattgcttttgcagttgtactgttgaagggaattatgtcagcttaaaatacctgagtcttattgagaatcatgtattggtaaaaagtattgaagaaggctccagccgtctgagaaacaaatgtagcagtgtcatgcggtagaatgaattcagactgggacagctgagattctagcgaaattctcctcttgtgtagctatataattggagcaaataacttatatcttgcacactggttcactcattggtccaatcttgggtgggattgaggattatatgaaataatatttgagtgactatgacagcttctacccattttgttgttgttcctgaggtctccagatgagtccccaacatttattgatgatattggaacatggagactgcttcctctttattcctaaccctgtcactgtcttgagtggattactcttcatgtccttaatagctttagatccattgatcctcactcactcccaccccacttcagtcctccacacccttgtatgctgtcatcgctcagctggacttgtagttatgtctgaagttacttaaacccctttcttgccaagactcttgtttctcttgctcttttaacctttacttcatccacttggaaacccgcaaacatgactcaatccagagtcatttatgcatgtgtgtgtgttactgacacacacacacacacatacacacacaaacacgcacacacacacatacacatgcaatccaagctgtcaaggagatactgcaacttctcaaattttcaaaagtctatgtatattcacactcacccttatcttatgctttccagtttcactgcttaaacctgactctcccacagactctgagaatcccataaactgctttttcaaggatcttggtctattaacatcctctctggctttgttgactttctctcttccatccaaaaacacctgcacgcactgtttcttttatttgttttcttgaaggatatcacattttctaaaaagtccacagttcacaatgtgacggatcgtcacacgtgaatgcacttgcacacacaggctccatcctaatttctttgttttctccctttcatttcataatccaacttctgaaagggtgattttcatgggactttctcaccctcgatccacttctaaattccagtttggactttgatcctgatgactgcagagcttgctctcaccagcttcttctctttgacaaaaaatgatgaattttcatcccttcccttgccagacctctagcattcaatagcactgacaaaccctttccggaaacactttctaaaaaatctctctgttctcctcccagctttctagtcattcactctttctcttttatagtttgttttccactcactcgccaatattggtgaattgataagctccagactcacatatccagatgttcatgcatatcctgtaggctcttcaaagtcaacatttccaaaaggaaccaatttaggaaaaaacaatgaagtattatccatcttgcaataaatggaatgtcttctcacctaagctataaacttgggatttattcctgatttctcctcccccttaacatccactgcttatgggaggatggagtgctaacgatgcatatcctggccacagccttggttcaagttctcattacagtaacagcttcctaactcaaaggttgcaaactggcagcctgtgggctgcctctgacctgcacatatttagtgtggcttatacaatgttttaaattgtttaaaatctctcttcatgaagatagagagatttcattaaaattcacattcgtagcttgttttgcaaaccacaaggtatggtaacactgggccctgtgtctttgttaaagtaatgctaacagaggagacattgcctcatttatgtggagcaggagctgtccaggcctctgtagtccctcctggcctctgtagtccctcctggcctgtttctctcatttttatcaccagggtggaccaagcatgagactgtgtaacttctgtttctaacagctcccctggctctgaatttgcacacttctattctcctgtccacattgatccagaagtatcagttctgtacacagcttctcattaaattccctcagtggttaaatattagcttctggaggaagctgaaattccttcctgtggcattcagggcctccatgatgtggttcccatatccctctcagtctcatttccccctctcctcctcctccaatgtttctccaattacactgaaactatttgcagttgcctggatgggccattttgcttcccgcctccacagcttccaacaggtggtttcttctgcctgaaaatcttcatctcacacgacccaactgcactccaactgcctaactgtgctcctcccttaaaactaaagggggccatccttgacctctgcctgactccagccagtttaggtgccttctctaggccctcccacaacactgtactgccctcggccacactacctgccaccttctcttgtaagcatttgcctgtcctcacacacactgtaagctccctaagggctgtctgggtcactgcttttcgtcttcatcctgagcacattgtggagtgtttggcaaataacaggcaggcctatatgttcataataaatcatgcttgtaaatgcacttatataaattctattattttatatacatgtaaagtaatactattactgtccataaggaaaagcaggaatgcctttaaatggtgtaaacattttacattagatactctattataaatacagaaggctcccaaaagagctagaataaaataaatttattacaaataatttttttctggcagtctcactctgtgtgtgtgtgtgtgtgtgtgtgtgtgtgtgtgtgtgtgtgcgcgcgcacgtggctcatgcctacagatatgaatgacaactcctggtttcttaaaaggatttgaaaatatgtcaccttttatagatgaataatttctatttatttgaggtacatacataaattgaattaaaataaatcactcagtactataaataactactaaagtcaatacttgatgtagtgaggagtcactgttacaaatacgtttctcattgcttatgtgcctaagttataagacttatgagtagattcctaaggaaataaatttggacaactgtagctactatttgatcagtattttctagtttaaaaagcactttcacgattcatgtcacatttcattttcacaatgctgtgaattaagtagtattgcttctcacttacaaatgagggtatcaagggacttcccaggtgcactcagcttagaggagaaagagctgcaactcagtgtgagcttttaacttgaaggccaatgattttcccattacactcttgctccctcttttcaaatgtattcctccctcaactcttctgcagagtctaagccttggcttgcttctaaggggaatcaagaagcctacagcaaaatctaggaatgcctcggtatttctaccttcaagtaagctaaactgttattacattttagctaatagctactgtcagagacagaatacactgtgagtgggaccaggtagttatataacggagatctacttgcaggaacagcaggcacaaaaccttttttttttttaacaactgtgattttataaagcagttctatttggctgctccctgaaacagctgtacacattctgtgcacaaaactcagggtttttaatctgaaaactgaaacttaaggggatcctacatgtcctcctcagtttcaagagacaattttataaatccagtgcatcaccggtcatggtgtcatattttttcattgtcttctaactgacattactatacaaaaataacatgtggccgtaatgatggggttgatttgtttgatgaacaccaagcataatacatttcctttttaacagctccctcagagtaaagctgtgtgtcttaatctaagtaaaggcattttcccctactttgcagcatcacatgtaagtattttagattaacaatgcaatttaattgatgttttcctgtgactaggggagaggggaagaattaaaacaaagcctaatctcactgagttttaggacctgatgaagctttgtggttaatgtcaagaaataataatagaaatatttgcatgtttcatcatttttagggcactttcatgtatcctttgacactttacaagaagtagcatggagatttacagttttagaaaaggtatattttttccacaaagtctcaaataagtatttattattcagtttgaaaaatttgagaacctaaaccatattaaatagaacaattttttctatataataatcagccgactatagcttaatttctgtaataacatctgtaaccatagggaaggacaaatcatcaaagaatgagtaatacatattttaaaatgagaatttgaaaaacactttcccaaattccccacggctccctgaacttctccttttatgttgctgtttttagtttcctctgatcacattgttattatctgtcccatgtctgcctttctctctagactgtcagggccttgcaggtagggccatgctgactccttctcagctgcatcctcaggaaccaacacaaggtttcacgctgagcaggtgtcagaatgtacttgacaaatggatgagttgataatttccctagagctatcctgatttttaccaagagaacagtgtaagtgtattaactaaaggtttcatcaccttgatgttcctttttttttttaatgaggggggattctctttatcacagaaatcctatgacagtctgaatgcttctgctttaaaataaaagtaatataattgaattataatacaggttataaaacatttgctctgtttaatgcttctcccttaataatacatatcaacttctttgaaaaaatgtaatttcatagaatagtttacattttttagttgtcttcactaaaaaataaagtattacttaacatgcattaaaagtctttggttactataaaggcatatttttgatttctatctaacatttgacataaaagctttttgacatttaatttagtattatctacatttaatacatggtaaaaggcttcttataactaaatggttattttattttccccattttatagaaaataaaatttaagattattgaaagataagttaaacactcaaatctagtaggcattctagtataaatatggcagacattccttacattggtacacaagttgcaaataaagaagaagtctgacataataaatggaagtttcctgtcttcaaaatctgagctggtaaatgccagcactattttcaatgcatgttataaagccatcgaatcacgttattttacaatggtgacacacatcttttattttctgttggatgcagaaccccattccagatgattgctggaaactaaggccataatgtcttaaaacagagccttctgggctatcattcccatgacctaatttttgttcatcccactttctgtagcccaggagaggagatgacatactgagacacatgacaatcatagtttgtgcaactataacacctaatagtgtgtccctggaaccaaatgcaacaaagtctgagattcatacccacgatctaatggaaacagagaatggagtcctgcatctgcccagagattattgctagaggaatgccaactgggaggtacctggttaacagaagcatctgtattagccacaggtgaaggggagcgacaggcaggtggagaggaaatctcactgttggttccctcctccccagactcctcagtgaccggtgacagcaaagtgtgacagcgacctgcagtcatctgccacgtaaaatgtagcccaaaggacatgaaaatcaattagctatgttaacataagtcctgttcaggcacaggccaaaacagagttaattataaaacgaaggttaaaattactgggacccgaattcacatattaatcctgtgttagtatttaaaagttctgtcttcaagagaatatgatgctagtaatcatttgtaaaacaatcagggatgggggtgcatatgacattgaagttttgttgttgattaaatacttcattattttcctttctttggagagtttgtggctttataaataactggaaaaatcacgaatcatacaaatgagaaaaggtctgtgaaataaagcttggtcttttgtggacatctcaagtttcaaatatggtaggaagataaatgcacccaaagtactgttattgccaaatgggctcaggtatggttactcattacctgaggcacagcacatataagggaaaacacacagcactgggaaacattatagtcaccaaaatactcaatgcattttagatggcaagtgtataggaaaatagtggtgcagaatagaaaataacaaagttgatttattttaatccaaagccaagctttagacggtctgttttcatatttttctaacaatagctgttcttctaaattgtattacacatttatacagtagagtacatgcacatatgtagttagctagttagcgtggagaccacaactaaatatatatgccatgaatttcccatcccccagacaactaaaacactgtgcaagtaaattattgtttaaagctcagagcctctcagtattattgcgaaattataaacaaatacagggtagacctctgacatgttaagtaattcagctgtctcgagcacatagtttcattttaactgtcattgtttacagtgtcaaagattggcccggcccaacggtagtcaaagagacttaaggaatctgttcctccctctgaatctgcaagatcgaaggctggtccctgaaatcagccacggagagggaacatggagccactcgccaggctccagtcaaagagcaaagccgcggggacccactggatccttaccatgaccacagaggggtgggccgaaggcgtggggaggagctccccatccaggtcctctgtcccttccgccagcccctcgacctcggtcaccgtcagcagcatggtggcgtgcttggctttcatcgtcagcatcttgcacttggaattcaaagaagcgatctgctcctggtagcccttaattttctgcgccagctcctgaggaaacatttcccccaccggggtgtcagagcagcatcaaaaggaaacagaagtagtagcgttcatcttcctgcagggcgagccaatgagcgcgcagagccgcgcgggcccgggaggcaggatgtgtaggcggcgagtcctcctgcatctcgctaccgagccagaccgcaggctgcgcggcgcggcgcaggcacagccaaagtgcccgagcccgcgtccccgcgtcggtacaaaaggagaaatgaggggatgaggccgaatgagtggtttctaatcgcgagaggccccatatggaatcatgaacttccgcaacattaggaactgacaactctctttaaaagcagaaagcatctgaaatttaccagatggttcctgccatggaaattaggtcatgtgatggctaaaaccacaccaaaaaaaatgcaaggctcagctcttaccctactgagtacattcaacagagatgacagtcatttattttacatagggtcacatactcaatagcctgtctgttcctatgtctctaagaattttttttagataggctagatattgcatatggaaatcccaatttttaatgcagattgaccccccaaaaaaattttgtatattcatcaaattttttcttgctcacttcatcatgtctcaaatgttgctgaggctttaactagaactttaaacttgaaatgcaattcggatttagtgtcttttaatttcacttgcttttgaaaaaataattgtttttttgtttttgtttttgagcagacaagaatgaaaaaatatattatgagagatagaggttttaaatattttattaagagcttattggaaatataatctggatagcacataacccttaaaaaggtaactatagattcattttaggagtatggtaattctaaaatattaaagttttactttcttgcttaaatattttaagtatcaaatattaaaattatactttattgcatctttaaaaaacgaaaatacatatttcaaaacatgattcctaaaagtacaaaactattattctttttttttttttttttttggcttctttgtttcagaggctgtcatttattgtgcacatagaacacattttgtgggccgggtgcagtggctcatgcctgtaatcctagcactttgtgaggctgagacgaggggatcacttgagatcaggagttcaagaccagcctggccaacatggtgaaaccctgtctctactaaaaatacaaaaattagccagaaattgcttgaacccgggagatggaggttgcagtgagccaagattgtgccactgtactccagcctgggcaacagagtgagactctgtctcaaaaaaaaaaaaaagaacacattttgtgacaaaaatattaaattgtaatgtctttaaaataattgtgtacatacatacacatacattcatatatatacacacacatatacacatgcacacacacatatgtacacatagtcatccctcagtaactgaggggcgttggttctaggaaccctcttagatacaaaattcacagatattccagtttctgatgtaaaatggcatagtatttgcatataacctatgcacatcttcccaaatactttaaatcatctctagattactaataatacctaatacaatgtagatgctatgcattataaataggtgttatactgtacaatttagggaataatgacaagaaaagaagatcaacatgcagagatgcaaccatcctttttgctcctcaaatattttccatccatgattggttgaattcatggatgcagaacttatggatatggagggctgactgtatgcaaaacacgtgtgcacatgcacacacacacacacacacacacattttgttattattgttgttttgtttgtttcttcctgcccaactgaagccgagtggagcaaaaaacagtccagcagaactcagccagcaggcagtcagtcttcttgactcctaatagtataggaatttttaaaacaaggatttaaaaagtagacatcattgcttctttacctctggggatgcagttaattaaacctaataggatttttaaaaacagtgattgaatagctatttactatatcttgtctagtggctagcacgtgggtactcaataaatgacatttactgcaactagttaatactagaaaagagctctagcagattactggactccttgaatttcaagtcaccaagctttcgcacaatggtttgccattatacaaaaattgaaggaatcttttttattattttattttattttatttttgagatggagtctcgctctgtcacccaggctggagtgcagtggcgcaatctcggctcactgcaacctccatctccggggttcaagccattctcttgcctcagcctcccaagtagctggaattataggcacgcgccaccatgcccagctaatttttgtatttttagtagggacatgttggccaagctggtctcgaactcctgatctcaagtgatttgcctgccttggcctcccaaagtgctgagattacaggcgtgagccaccatgcccggcaatttgaggaatctttatgaagtagacagagttagtattaggccttccaccctttgtaatcacatggctgggcacagctccctgctacagtatcctgcaaagatgtgcccacactgacagcaagtgaccatttcttaagctgcaattctcaaccttattgtgtacaaaactcatttggattgtttctttaaaaaatgcaactctggtcaccacttccaaaggttctgatttaccaggtgtatgacagtctgcacttcataattagcccatgtgactccaatgcacgtgacttccactgagaaatagtactctacgacttgcttctgtaagtgtaaacctcttgtaatctcattacctttgagggttggttattcaagctgtggtcaaatccactaaaataaaatggaacacttggtttaatgttacccattctctttataaaatttctgaaaatgtttataaaggtaggaatttcaggtagagtggccgctagaagacaagcagccctctgtggccagtctctggtattcatgagcaggctttccgcatcaggcggaaagaaaagaggtgtgagtatcctctcctatgatttaaaagtggcaggatgatttttttcaaattaaatgcaacttttgaaaaagtattattattattattttttgagacagagtctctctctgttgcccaggctggagtgcagtgacacaatcttggctcactgcaacctccacctcccaggttcaagcgattctcctgtctcagcctcccgagtagctgagactacagacacccgtcaccacccaggctaatttttgtatttttagtagagacggggtttcaccatattggccaggctggtctcaaactcctgaccttgtgatctgcccgccttggcctccgaaaagtactgggattacaagtgtgagccaccacacctggccgaaaaattatttttaaaagtttgaattccttaggcataaataaatgatcagttatttttaaagttatttgtaagaaaactagattcaccataagattgagattcaattaaaacaagacagaaaatacaggcagaaaccctcttcccaatttgtatgttatcatcagttaagctttctccactcagcactttccttcctgtgtttgttttatacatacaatgaagctcacacaggactgcatcattttttacatgaaaatgtgttctaagtcacagttggtttaaaactaacaaacataacatggatgttcagaactgtggaagaaaatgtgacaaaataaacagctcactggaccaagagtcaggaagacatagtccactgctgactgagctgagttcactctgtgaccttgggggactcatttattttcctgggacttcattattctcttttgtttaattaagtagcccagatagtttctgttacagtggaagaaaaatcacggaatttggacacaaagatactgagactgagtccaatttcaatcagttactagatttaggagctcaggaagtcattttttctaagttcagtttttttgtcagtaaaataaagatgattttaaaaaaatccttaccccggccagtcgtggtggctcactcctgcaatcccaacactttgggaggccaaggtagatggatcacttgaggtcaggagttcaataccagcctggccaacgtggtgaaaccccgtctctactaaaaatacaaaaattatcagggcatggtgatgtgcgcctgtaatcccagctactcgggagcctgaggcaggagaatcgcctgaacccaggaggtggaagttgcagtgggccaagattgcaccactgcactccagcctgggcaacagagcgagactccatctaaaaaataaataaataaataaataaataaataaataaataaatacctcatagagttggtataaaaaagtgatgtaaaattttgtaagttactttaaaaaacataaagctggctgggcatggtgactcatatcttttattctagcactttgggaggctgaggcaggcatatcacttgagcccaggagtttgagaccaacctggataacatggcgaaactctgtctctactctacaaaaaaaaaaaatgcaaaaactagcctgaggtagtggtacatgctcgtagtcccaaatacttggaggctgaggtgggaggactgcctgaacccagtaggtacagactgcaataagccatgatcccactgtgagccatgatcttgccactgcactctagcttggatgatacagcaagactgtgtctcaaaaaaaaaaaaaaaaaaaaagcacaagtttcttggggaagaaaaaccgtacaacaaaaaagtttagtagtaataacaattattactccagaaaagattttaaaaatatctgtaccatgatagaagagttgttacaacaaaattttggatcttcctagatgggattaaaaatcgtttcaaaataaatatgtaatatatagtctaacatatagacctacataaacagtggtttcaaaaatctacataacactttcatttaaccattgtgtaagaaaaatcattaacatagatgatgtctacagttgttggagtaaatgtagatgggatatttaaatgattttgtaagtcatatataaatgaaaattattaatgtttgtagatgtcaagaaattaaataattaattgcatttggagaagagggtgagatttttcatccttacaaagcaataccttgaatcttttgagaatctcaatgtgagtggtttggaaaaattgttcatttttctcatgacaaagttaaaatagagcatatggaaggatatattccatatactctatccttagtacagaaaaaataagacaaccttctcccagttatttaccaaaattcacagtgctatgaaccagcccccaagggaaagagtgaatttgacctatatggaattgacaggtcaggaaaggaaattccctgctaagctcaatcactcaaggactatgatgtctgggacagggactgcacaaggagtggtcaagtcctaaggtcataatgatgccaaaggaacaaggaaagaacatttgaaaacgaggcacatgttagctggcccaatctgaaaattagcaaagtaaacaacctggaccatcctctgattttggggagaggaactgaaatgactaatatgtcaaagaagaaaatgtttaaaatattaagtcttgtttgtttgtttgtttgagactgagtctcactctgtcgccaggttggagtgcagtggcgcgatcttggctcactgcaacctctgcatcctgggttcaagtgcttctcctgcctcaacctccgaagtagctgggattacaggcgcatgccaccacacccagctaatttttgtatttttagtagagacggggtttcaccatgttgtccaggatggtctccatctcctgacctcatgatccacccatcttggcctcccaaagtgctgggattacaggagtgagccaccaagacagagatcaatgcagcaaagctttaagcgttgctgtttctcgtaggcattaaaaacagggtatggactgtgttttagtgtattaactgtgagaattctgggtgcaggagatgataatcagtgggtcccaaaggatataatacgaacaacgtgtagagaggttatggaatcaaggggaacgcacgtgttactgaatcaacaaaaacggcactcacaatgcttagatagccaaagaggcctctcaagagttgaacacattaagtgcaggacaggggaaactgttctcttccattctctagaaaccaaacatatactctaatcaagccagtttcctgccctcggtatttcgcctacattcctctcacctcatgccgagaaatctgagcctgcagctcctgtatgttactggtggcaacaggtttatcctcaatctctctgtgagctccttctatcagttgctggagatgtttcatttcttgctcatattgttcatattgtaccacagcttcctttgaaaaaaaaaaaaaacagaaagatagacagttttttttctctaccaataactaggtaagtgattctgtagtttaactcctatttacctgtacaggtagggaataaagaaatgatgggtaaaattcctagatggtttgaattcctcactttatgtagatatttcagaactttctctctaaaatgttgtagcaaaattattgatggaatcaaaatagttaagtggttaggattctttctctctcttttccctactgatatcgtcctgaagatggaacatgacggtcagaaagggtgaagcagtgtgggaaacattatttcatttttccatctaacaaatactgaatatataggtaagacacttatctaagtgctacggtagggaataaaaatacgaattatgggctgggcgcagtggctcaagcctgtaatctcagcacttttggaggccaaggtggctggatcatgtgagcccaggagttcaatacagcctgggcaacatggtgacacccccatctctaccaaacaaaagtatatacacatatgaagtatgaatgacttttagcctcaggaattttctgtccaacaaattacaagataacagggaggaaagggtagttgaccaaatgagccactagtgattttagtgagatgctattgatacaatttttggataaagcaagaattattagttgaagggagacataaggtaaacactgtcatttcttcctggtaaatgattttctcttactaggcaaagagactaagaattatacttgagtgcatttttttaggcactcaaaagaaaatggatttaatgctttaataagctgaaatatgaaaaaaactctgtaacacaagataacagtaaacctgtattatcagtttgtagatgattctcaggtgaataataagagataaaaacatgtaattgcatagaaaattaatctttacaagttatttatttaaaaatatcactaaaagataattttcaccaaggatattttttatatagcattccccaggcttttgtgggtgatccaaatgacagcattttaatctccttattttataaaaccacaacagcctgtcagattcaacaccctggatgtgttttgatggctgagcccacacaatgctaagaaaagaagcccatgattcatcagcaattgctctactggtgtgggtaccctgcacctgcctgcatgatgttacactgctggatggcggtgtgctgcagccggctggcctcttcctgcagccgcagagcagcatgacagagaggtaagctggcaaccacatcctcggggatccggagggcactctggcagagctgcactgcttgcaccttcggcttcagtgactccatctcagacaacaaatgctgaaaatgcaatttcatagttcaaaaatttaatatttaaatcatttatttcataagcaaaaggcactaaattatagttacgttgcaagttataaacattttgcaaaaaaaaaaaaatgtttaaaacagtgttgagtttaggggctggacacagtggttcacgtctgtaaccccagcactttgagaggctgaggtgggtggaccacatgagttcaggagttcgagaccagcctggccaacatagggataccctgtctctatttaaaaataaattaaaaaaaataaaacagtgttgagtttaggaggcatttttccttactatcctcttttaaaaatataggtccctgtccctatttactccaagttagtttggcttacctgccgatgagagagctgctccttgagactgagacgtccaacttctggagaagtcagtgttgcctgggcttgctccaaggcagcttgtaactttttcaactctgcttcaaattttttcatatcctagagagtcaatatcaatgtattgtacttgaagttcaaagccataggggaagaataacatcacagtcaagaaaccacatcacaggtgagcactatttccatagtggcattgccattttctttcaatgatagacatttttttctgtttcttttttttttctttttttaccttagctgcatcttggaggttctgcaaacgaattttgatcatctgtcgcaactcctcagtctcccgtcccagttctgccacttgctgagacattttttctgtacagtacacgctagtgaggtactgtaatttctcagtcattgcttccagctcactgtcaatttctttggattcttctagcagggtctagagtgaattgtcaatattcatgacattgacgggcaggtagagggatatagatattcaatatagcttggcataaaatgccctgtgtaagttctgtgtgtccgttattgtgtttaaccttcaccccccatgaccactttctacttggtagccacttactattataactatttcacagaaaaagaaatcacagtttaggaactgtaaacaatgtgcagaggtcacatgtcatactacgtgtgggaccatgaagctcctgctcggtcaagcccaagctgccccctcgtgagaacaggacataggaattctagcagtgaaaaacccaaacatactaggtgtcttatttgtatctctgggtctccattttctcatatttaaactaaagaatcacttttcagctctcatattctatacgactgaagttcatatttgtctaagaaatgaaaataagaacaagagcattacaagcaaaaaccttggctcacttgctttaagtgagacaaaggggtagaagatacgtgcaataactatcaagagaagcaaaaacatccctgatcattcagagtggtatcatctactgggtctatcagaaatacaatggataagtaaccattcaatgtacagtctatgaaaagtagaacgaaagagaagccagtgtgaagagatgactgcaacttggggaagattgggagaaggtctccgggaagaatcacatctgagcccagtcagaaggacttttgggatctgacagatgagggggaagaggaaagacatttcagacagagagaacagcatatgcataggtacaaagatgcgtgaatctagaacacacagttagtggggtgtgtaatgtgtaaagaggagaaatgaggaataggatattattcttaggcaatagactatttatttatttcttttttgagacggagtctcgctctttcgcccaggctggagtgcagtggcgcaatctcagctctctgcaagctccgcctcccgggttcacaccattctcctgcctcagccccccgagcagctgggactacacgcacccaggtgcccgccaccacgcctggctaattttttgtattttttagcagagacggggtttcatcgtgttagccaggatggtctcgatctcctgacctcgtgatccgcaggccttggcctcccaaaatgctgggattacaggcgtgagccactgcgcacagccggcgatagactttttttaatgaagtactttcttttctcacaataaatgtttataaatatatatttaacagataaatatttatctgtatatgatatatgatatgtatttatacaagatatatttatctttttttttttttttctgagacggagttttgctcctgttgcccaggctggagtgcaatggcgtgatctcggctcactgcaacctgcatctcctgggttcaagcgattctcctgcctcagcttcccgagtagctgggattacaggcatgagccgccacgcccagctaattttgtatttttagtagagacggggtttctccatgttggtcaggctggtctcaaactcctgaccttgtgatccgccagcctcggtcccccaaagtgctgggattacagatgtgactcactgcacccagcccctatacaagatatatttatttttaacacataaatatatatagtaaggatatatatatataatctgttaaatatatatttaatgtaaatgtataatttaagtatatttattaataatttaattattttaaatgatttaaatatatatttactatataaatatatcaaatagaaaatatatgacttggaaaatattgaaaatataaagaagaaaacaaaatatctcatcactttataacccagaaataactttaagagttaactgctgatacatttgggcacatttttaggtattaataattgaggtcataacatgactatagttttccatctttctttttcacccgaccttagcgttaccggaaaaaggtcccaatccagacctcaaaagcgggttcttgaatcttgtgcaagaaataatgtggggcaaatccagagtaaaatgaaagcaagtttattaagaaagtaaagggatgaaagaacggctactccattgacaaagcagggtgtccccaaaagcaggaaaagaaatgcatccaccttaggtacaatgtctgcttatatataagacaacaaagcaaaaaatcacggcggagatatgctctgcaagggcctgtgacaaaagattgttgatctttgtgtaactgctgtcttctataagaatctatgttaaaattattttttaaatatagatccaagaatgcttttgttcttaagataccaggatatcaggacattgcctgagtctgttatttcccagatctattaaggcctgggtatcttcagttagcattatcaacctgtctaaccataattattctgtgactaagaatgcctgacgtgggaatgctacccaataggtgtcatcctcatttacccagcccctattcaggcccctacgaagtcactctggttctcacatctctgacattagaaaaaacacaatggattttcttttctttttttttttttttttgaaatggagtcttgctctgtggccaggctggagtgcaatggcgcgatctaagctcactgcaacggctgcctcccaggttcaagcgattctcctgcctcagccatccgagcagctggaattacaggcactcccaaccacgtccagctaacttttgtatttttagtagagaatggggtttcactatgttggccaggctggtctcgaactcttgacctcaagtgatccacccctcttggcctctcaaagaacacaatggcttttctcacagtgcactctttttaaataaacacaggctgctttacttcctaaagggggcacgtgagaactcaccaaaagagtctacagtctgcgttctctcttcagcttctgagccagatcatctcaggacctggtgtctttttcactgtgccccatgatgcagtcaacccaccctactgctcgagtcatagaaacctgggaatcatccttgactcctccctgtctttcatcgttgactcctccctctctttcacccaattcagtctccaaattggagaattccagctgcttagtatctcttgactttgtcttctcctcctaatctccaaagagaggccttgtcatcttctactgaaatactgaaaccatcttttatattgtcttactgtcctcaatgtgttttccaaaggctgctaaatttgctttctgaaaatacaagtctgaacttgtcctttgcaggcagaatatcagtttcagaggcttcagagtgacttcaggataaagtccaaattcccaacagacttttaggatctttttcttatctctctattcttatctcttatcccttgtaccagcaccagaaaacactcctcacatttactgctaggatttcagcatacatttttatctaaacacattccacaagtaggctgtcatgtttttcaggactcagcccatcatcaccttttcctgagaagcctttctgcactttcctcttaaacccctggtgggcggttgggttgagcacactcctgtgggctccttcagcacctgggccctctgtctttgcacaaatcacactatattgtactgtttccttctatctgtcccctcccctaaataatcaactccctggggtggggacagggaatatcctttgtaccctaaatgcctaaccaaagtcctagtttgggaaaggactgtatgtttgttgaataaataaacaaacgcttgtattcccagaatttggggatgccaaggcgagtagatcgcttgaggccaggagtttgagaccagtctggccagcatggcgaaaccccatctctactaaaaatgcaacaattagccaggtgtgatggcacgtgcctgtagttccagctattcaggaggctgagggacaagattcacttgaacctgcccaggctgtagctcagtggcgtgatctcggctcactgcaatgatgacgaggttgcagtgagctgagatcacgccactgagctacagcctgggcgatagagcgaaatgctgtctcaaaaaagaaaaaaaaagtcatgataaccttaaggacttcattatattttattatatgcaaatatttacttggaaaaaaattatttcacatttaagttttctttaaactttcactacagttattaatactgtggaaaatattttctatattttggattgtagccataaaaaggagtccaaaaggagccaacaggccagagtagtaacttttttttttttttttttttttttgagatggagtctcactgtcacccaggctggagtgcagtggcatgatcttggctcactgcaacctccacctcccgagttcaagcgattctcctgcctcagattcctgagtagctgggactacaggtgcccaccaccatgcccagctaacttttgtatttttagtagagatggggtttcaccatattggccaagctggtcttgaactcctgaccttgtgatccacccacctcggcctcccaaagtgctgggattacaggtgtgagccaccgcacgtggcccagagtagcaacatttttgacaatcaccatacattttgccaattatttttcaaagagattttaccaggataccagcaatgtttgagagctctcacttccttaaatatgaacttgaaagaaacagtatgaatgtgacagttaagtttgtctttcttcctctctttttttgctgaaatttgcatttctagacttctaaggatgttggctttttttcattgttttcaaatcagtggtaacttaagtcctgtctgttcatatctaagcatatcttaaagcaaaagattggagttgcttaagaaagacattgtgggaagaatacgcaagattgatcagagaagaaagactgtgaatatagggaaaaattagaagctgttaaagcattccaaaaatggaaaaatgaggctttgatctagaaccctgtaaacaagaatggaaacagggattcatttaaaggccacaaggatacataaataatataagagacaaaaatctagaatactcgatacccatgtaactcctataaaagtcaccctatattttattatatgataactagcctattaactatctgtgtctaatttaagcttaagttacaaaaggatgaaataatttcctggatgacgtgactgacagaaaaggaacatttttctcatgtaacttcagaggaaatgaactaacatagccagcatgtgatgtggactcatggcttgctctgggctgcccgacctcctgtggaaggccagatgacaggcctgggtgagggctgagggaggaggcgggagatctcccactgagcacctgcatgtgccaggcagacgtttgcacgtgtgtaccttaaaccacttgatctcataagtctgaaatacgaatattatttacgtcttcatacaaatgatgagaagacagaattcagagaggcaaagcattctgctccaaatcacacagccctgcatggcggagcttggttttcccaccagtctgagtgtggagtctagaatctttccacacttcattgcatctcttcacaggaaagaatttcccaccagatccctgcagataattatttcaaagaagctacagaaaatgagttctacaaggctgattggtttgggtcttggtgtaaggtaggtttagggaagatcaaggatatttatttattcaatttcatgaaatttcatgagaagctcctttctgtccaactactgaacaacttaggggtaccttagcattctttttatctggtagctccaaaaattttacatcacagccctctaagtgttgtgtcagtctacccagttaaatcaaattgcccttggttactttttaaagattatttttcctaaggttacctgatgcaaaatatattgttcccgaagctggcttgcagaattccatgcaatagttccatgagccaagactttagctttttcaatccacttcaaaattaattcaagcatttcattgtattcttctaaatgtgatgctgcctgaaaaaccagtaacattaatgtaacaaatgtaaactcctcagtttcttgagctataaatcagtcttctctctctttggacacaacagtcttaggggttgatcattataatacctatgatattcaatggtatcaaaagatcgtttccctgttaaaatctgtcaaagctttctcagtgaccttaggataaagctcaagttcttaatatgattgaattattcctctttttctttcttttttcttttttcttttttttttttttccaaggtcttactgtcaccccggctggaatgcagcagctggatcatggttaattacagcctcaatcttacgggctcagcctcccacctcagcctcccacgtagctgggaccacaggcacgtgccaaccatgccctgttaaatttttgaatcttttgtaggtttcaccatgttgcccaggctggtctcaaactcctaggctcaagtgatccttctgcctcagcctcccaaagtactaggattataggtatgagccaccatgccaggccttcctctatcccttccttcaccctcccctgggtaaggaggtggcaagtggggattctagcaggcaaagtttcaaactataattaatgggttaccaactcctggttttaacttgtccctgattatattaatcgatttcaaaagtctagtctatatgcaacaattattacagacgtgcaatctgaatctattaagtcaacgtaagctgatatatatgtagcttacttaaaggtacttgaattcaccccaaactgatttcataaaacacgttaatgggtgaatattcattctacaaaatacttctccattttacaaaatattcactccaaagtccatttgtaggaccacctttgtcagtgactttatcatatggctggatataaagtaagtgctggtttatacctaagtcttaggatcacaagtgtagcatgaaataagctacacctaaactactctctcattgtccattttatctttttatttatgttaatttattttcaaaagagaaaagcagaacatggaagtttctgccttacacgatttggatttctggcccggaacacatacctgattgagcttggagagccgattctcagcttgtctaatggtctgctggtgaagttcagtcagttttcctatcttcttggccagtggcttacccagttggccattctgttccaagaatttctgtactgctgcatctaattccattaactttgaattacagccatctaattcctctcccagcaccttgatggtcaccaaaatgaaagaacattagagtacagaaaataaatttctccaggtttcccgagatcagactgatttttgtcaaagccaaatattataatgaataattctactataattctactatgatcaggtcatttttgtttcttcggttggaaaggcagggcaggatatgttgtaatgctggtgtttatttcctatgaggctgagtgagaaggctaacattttccttctgccccacccaaaaaggattagagtccctgaactcatcaacagaggaagaacacagatttagctaccaaggacacaattcagtttggaatttatatacttgtattcctaaatcatcacttagtcctttgacgctcttctttcgtacacactcatgcatgtatatttattaatactgttcaattataatgatcaattatgtaagaggatctgtgttgcttcagttacaaaatttctttaccacctgctgttactatttggttttaaaaaaggttcctaaaaggtttttatcctatatccccaagtaaaactgactccaaaaactatttaattcattcagtagtaccctttaaaattctacttcttaccttttggtcagttttagcttgaactacattatctgtcttcgctttcagcttagttagaatagttgtgaggtctttagctaacttctgaatttgccggctgagttcctggctcgtggccttgctctgctcaacttcttttattttgtcttggatctaaaaaaatcagtaagaacagcaaaacaagccatggttaaaagtgaataatagatactaaaaatctcaaatgatgttgacaagacacattttaactgctttggcattgaaacacctggtcacaccagcgatgtgcgattagttacaagccctcctggctttccctgacttcactatctttaagtatttactgcactccttgtgttccagcaaagatacaagcaatgtgtgtagagaaattcacttattaaatatttacagaatactcattatagatggttgtgtagacagctgagtttgaatcctatcttctccattaactaacgtaatgaccttgagcacacaaactcctctaagcctttttcttcataagatggaaaatcctcccaaacagttggaagcacactgatttgtttccaagcaccttttaataaatgactcttaatgatctgttaactctttttgtaactttccgactacagctctatagtatgccaaccaagcattaagtacatccaatggaaaggaaggtgaaaaaagacagttcgcatttacaaatttccagtgactttggtttgatttgataacaaacattcacactgttgcttagaataaaatgccgaagaaaagacattaaagagaagaaacatttctttatgtagttaaaggtctttaaaaaaacctctttagtagggagaaaacacaccattaaaagagagttaatggtgtgttttggccttcattattttgagtgtcaaagtaaatgaaatacatatgaataaggctatgataggaaaattaatccagagaaaagcttaaattttaactaaaaaaacaaacaaacaaacaaagaaaaaccatggctgtgcacagaggtgcacacctgtaatcccagcactttgggaggctgaggcaggcagctcacttgaggccaggagtttgagaccaggctggccaacatggcaaaaccttgtctctttttactaaaaatacaaaaaattagccgggtatggtggtgcatgcctggaatcccagctacttgggaggctgaggcacgagaactgcttaaacccaggaggttgcagtaagctgagattgtttcactgcactccagcctgggggacagagcgagactctgtctcaaaaatataaaaagaccatgaacttgccaagtcatccttcccagtagatcttccaatgtctaagaagaaaagccaaatatatcaattaaatacttaaaatagtaaagagcatttatcagtagtttaggtcaaagtcatgatgcagtaggatcagattttgatgagatttttaaaacactttgcatcatacattgaagattccaaaagtagagcacaactgtatgagttttacagtttgtacaatgggatattactttctatttcatgtagcaatttagaattgtagtatgtcttctctttgtctcatatagaagggttttcattaaactttaatagctttagcattaagccaccaagagagtccgaaaaatctattatatttccatacagatgatatttgagcctattttcactacatgaaattgtgctcttcatgagaccagagacagaaatctcactctggtctcaacaccaaaaaggactatgcatttcttctcaaagaaacaaaaatatttgttttttagagttatagacaggattatgtttctatttactcttttccttgggtgtttagaagctagggttaaaatgatggctcttctctagcaacattaggggacccacccgcatgcattttaggaaataacttcatccctgccttgatcttatttttatttctttgatttttccctttcctccaacatcttcacctacttaactgacattttgttgcactgctgaaataaaataacagctggaagagtccctggcacactctgggcattcactaaatatttgttgaacacatgaaacatatcttactttttgtttctttaagtctttttttaaaggtgaggggaagcacaaaaattatctttaattgtatggcattattggtcatatctatgatcatcttgcctatgaaaaagacttctaatttaatattattgttttatagccatctattttttttaactctgtctccaagaagacattattgtgaaaatcaagaactctcacacaagaggactgaccctataaacaaaatggaaagacactctttcttgatcataggtttacctgatctcggatctttagatctaacgccacttcagccaactgaagggagagttcagaaggtaatatggtataaagacctaagtacttctccttctgttcttctgccattttttcaatgttctgtcggtgatttgtggcttctgttaggagaatctgaagaaaagatcaaaataagaaatttctgggaaccttctaaggggactgttatagacaaggctgtatatttttcatcaacatataattaagtgtggaattagaaaaatatcttaatacaacattgttcttttgtctctgaatataaagtatgttcactttaaaaaacaaaggaaaatcccatgaagtaatactaaatatcttttatataacacacttctgaaattttttaattcaatattcaataaatacaaacaagtatgttcaactaaaatcagggcaattgtttttgaaatgatgggtaaagagaatgaggagacttttttgtacctgaagttcttcaagttgagcatctatttctattgttggattccctaaatattctttcgtttcctgaacccaacatttcacagaattgatctgagtctccaccatttctcggtccttcagctcttgcttcaccaactttccattagtcttcactttctcctgcatgcttcagaaacattacagggataaaacagaagtgaagtgaaaggaaccccctaatacttggcaacattttatccaatacatatatagaaatgggaaacctagtatcttttttgaaagaaaagacacttcctcaacactgttaaataacactgcagttcatgtataaatgtcatataaagtaaataatttatccttgaaaaactgagagttgactgtctcacatgccactaaattgcaatcaatttcctatttaaagtagcctggagattatttcattatttacttcctctttggaaatctcctaaaatggtacatttaaaagtaatgtgtaattggaatatatatagctatctaatagaaagtagtctttaaagaaaaaaatcaagctttggaaatgtcataattaatcacgttaataatgtacaaatttcaagtctttatttgaattaatgtaaatttggtaagaagattttaaaaagtgttaggttaccttgacatcacctataagggaaagaggtgaaatgcaaggacatgaatgaggtaatatttgtaaatgtagaaattaaattatcaatgaatatttttttctctggcccaagaagtgagtcagggctggttatacatcaggattaacttgctctttctactaaattcactgctagtcgatggctattatttacctggactgcgctcctatatccctgtcaccccagatggccaatgagttctcaagcttcatcaaatctaagttcttaatagctctcaatggtttccatctcatgcttcatttctcttgaatcacccttcccctccccgcatcacccaaggagctccttgaaagtgacacgtttattcctttcttacatgtcatttccctgtttgcaaaactcaatgcctagctccagcccgctcaggcttctgcttcaattccccttctgaagggatgccttctttgacccctctcctcggctgcttgtctctgcttcggattccctcagctcccttttcacacttgactacaaaggctgccttagttgcctagctctctgcggcttgactgtaaacggcatgaaggtagacactgagtctgtatggttcaccatcgtatctctaagtactatcagatatgtatttgtcagacaaacgattgaagagttaaggaaacggaaaagcaagagtgatgggaacggatccccacattttcaaggtggtgtgaaggagcaccttcatacttcataacctacttatcccaaggccaagttcagtaacagaatgaaagtaggggccgggcgcggtggctcacgcttgtaatcccagcactctgggaggccgaggcgggcggatcacgaggtcaggagatcaagaccacggtgaaaccccgtctctactaaaaatacaaaaaattagccgggcgtggtggcgggcgcctgtagtcccagctactcagagaggctgaggcaggagaatggcgtgaacccgggaggcggagcttgcagtgagccgagatcacacatttgcactccagcctgggcgacagagcgagactccaaacaaacaaacaaacaaaagaatgaaagtaggtgcttaattacttcaggcaccgatcttgcatggcggtgatttcctgcatgagcggaggctcttccccaggggttggggcggctccatcctggagcatgctcagggtttgctgccgcagcatgcccaaggccgactgctgctgctccagctccagaacgaacgtgtcgtggtattcaagaagagttaagagctctgctttcgatgctttctctgctgaacttccaggtaacttatcttgcagctgatcaatcatttcagtggcctttttaacctgatgacaaatgtacatactatgaagttcaataataaataaactgaaaaaaatagggtaactcccataaaagccacacactagtgtatgaagccaattaaagatgatgatataaattccacatgttaggaaactggaacctgagcaaccttcttaacatgaaaggagatatcacctctatacctctgggtttaaagctttaatctcaaaataatattaggacaatcagagactatacttaatacagaaaaagctttaaaaaaaaactaagcaaacaaaatactctttccaatatttaagttaacataaatgagtgcctttaaatcataaaggaaaataatggcttaaaacattaaacctttaaagatggaaaaagctgccaggcatgtggtggctcgtgcctgtaatcccagcactttcggaggccgagacaggcagatcacctgaggtcaggagcttgagacaagcctgacaaacatggagaaaccccgtctctactaaaaatacaaaaattaaccaggtgtggtggcgggtgcctgtaatcccagctactcatgagggtgaggcaggagaattgcttgaacccagggggtggaggttgcagtgagctgagatcacaccactgcactctagcctgggcgacagagcaagactccaaaaaggaaaaagttgaatatacaatttgggtaatgagtcaaatttctgctcattttcaggtttcatggtaaagaaaaagtatctcattctttttcaaggccgttaagaaagcaaatgggccgggcgcggtggctcacgcctgtaatcccagcacttggcgggggctgaggcgggcggatcacgaggtcaggagattgagaacatcctggctaacgaggtgaaacctcgtctctaataaaaatacaaaaaattggccaggcgtggtggcgggcgcctgtagtcccagctactcgctactcgggaggctgaggcaggagaatggcgtgaacccgggaggcggagcttgcagtgagccgagatggcgccactgcactccagcctgggcgacagagggagactccgtcaaaaaaaagaaagaaagcaaatggggcaaaatgggcttgttctcctttcacaatttaattgcttggtttttctcattgaaataatttgactgtgacttgggactaaactgcacattgcattttgtactttgtttcataacttaatttttatgtcactgaaacagattttaaaaagcctttattactttcataaggctgacttcaaaaaggggcaaaatactgtgtttcaaaatacattataattagtgaggaaagaaaggtgagcccatggacagtggaaactaccttgttgttaaagcccgtccactcatccactgcatcttccaggatcttctcctggtcctgggccacagctcgaaggcgtgtccagcgctgccagacggtggtcattgacctgctcagggtggctttgctggcatcatttccggttttctccagttgtgaagctttttcctcaagggccacaattttctcatggaaagagttaaccactgacactaaagcctagggttgggggtggaggacggaagagaggagacaagggagagatcaatttaattttataaagttctatggatcttggtaaagcccaaaattcctgcaaaaggaaatgtttctacatacgtttattctcctctaggtactcttacttttatgtttattttttaaccagagtgagtcttaaagctttttaaagaggtaaggtgaatattatttatttattaaaaacaaaagtgtattttgctacttgagatgacatttttttcatttttaaaaagcagcacaaatgcaagtgaaccaaatgcaatattttagtatgttacattttttccttatattgctctgataaagggagactcagttattaacgttttagttttatttaatctgttatcaacaaaaagtattcactgacatttattaagtgccacatcttatcggaagcaaattgctctgaacatcttagctatgcatttccaatgggaatcctaaaaggtaatagcatttaataaacttaaaacttctataaaatgttgttaaatgcatccttatcacattgaaaaaagtccaggtagaaatgaagatttattgatcatgttgcaaagactcattataattatagaaaaaggattttttttaaatggcccaaaactctgaccttgtgttctgacaatttttcttccgcttcatgactagacgaagtcttcaacaaagaaaactcagacaatttcttttctgtatcattcatcaattcaataacctcttcccttgctttctggtaatcgtgccattgagctgtgcatcttgaaagagtccaacagaaactgataagtagcacgaaatcacgtatttctacacgaagctctggtgtcagtatgtctaatgatactcagggaaaaatgaatttacgtgctaatgtatatcattcgtgtattactactttcagtgtggaaattcatttcactaaaacataaaacacaaaacatcctgaaatacctctgcaagagatccacttgggcaccagagtcccggctcatcctctggctcctgagttccagagaagccactttctgttctaggtcttctttgccggttggcttgatgagtgggtccagggtggctaccaggctgtggagctcctccaggttactatggaactgatcctctgtactgaaaaattccatgtggcttttgagattttcctctgcgctctccacgtctaggccattgcctgccagctgtaacaattcttgggcatcctcaagccagtcattggctgcttgaaatacctgataatacctttgacactggctatatatttcagtcaaggtagcctgaaaaacagcaattgcaaacataatcaactctcctttgcaatgtgtttgcaggaaagagttttattcactcatttgttttccagtccttagtctcatgggcgtatgtgtgtaagtgcattgataagttagtggaatatttttgtggtgccatcatcattatccttgatttttccttctgctattcttgttataattttattactgccattaaattaaataataaggacagaaatgggatagaaatttatgtcagtatcttgactagttctgaaacttccctctctaagaaataatatgatgcttagtaatatgtggcagactggatgtttatcaaagtgcagtaatgtctccgttggttagaagtataacaacacggccaggcgtgctggctcatgactgtaatctcagcactttgggaggctgagggaggcagatcacttgaggccaggagtttgagaccagcctggctaacatggtgaaaccgtgtctctactaaaaatacgaaaattagctgagtgtggtggcacatgcctgtaacagctacttgggaggttgaggcacaagaattgcttgaacctgagaggcagaggttgcagtgagctgagatcgtttcactgcaccccagactctgtctctcaaaaaacaaacaaacaaacaaacatggaaaggaaaagaaaagaaaaaaaaaagaaatatagcaacatcaaacttccaaactggcatttaccagaccacagagccacagagtaatttctggaagcgaaatagtaacctgtgagtcttgtatacagactaaaatagaaaagttgaaaagtttaagtctggatggctggtccattcaattccagaaggaaaagaaacactctaaccagccatcaatgactagacaagataagccgcaactgtgcaagcgaagatgcatagaaaaggtagagaaagtacccataagatgagcaccaattagggaaagaacagggacagcaaagcatagaatcagcggagggaataagaaatgccccaggaaccatgacctttagttatttggaccaagataatcaataagacaagatggcacaagcagagacatcttagtagatttaagagtttggttcaaaactcaccaaaagaagcaagcttacctgacaaatgtttttcaagaatgaaaatttctgctaacttctgttcttactctacattctagattctatatctctatttatactaatagcgctagaaaaatagtttaaaatttgtataagcaatagccttgaatcaacatgaaaaggttaaagtgtactagtttttagtttaaaaagtcagaattttaagaagtttattatgattttatccaatattaaaatttttactatttaaagtgttaaccttaacctctgcagaaaatatagttaaatgagagctaagattcatctgaggttacttcgtgtcagacccaatgctaagaagataaacctaataaaagaatcattaatatctctcttctacaaagagggacagagccttataggatgtcattttcctgagatcaaatagctgccattaaaactcagatgtgccctcctcccaggctatagctgctgtattatcctgacgaaagctatcctttacctaaagggttggttgacatctcctagaatcacagggactaaagacagacatggagaaaatgggccaagaagttaaaggaagtaatcctctaggcactatttttctcttcttattttattttatttatttatttatttatttatttatttatttatttatttagacagagtttcactcttgttgcctaggctggagtgcaatgtcatgatctcggctcactgcaacctctgcctcctgggtttaagcgattttactgcctcagcctcccaaatagttaggattacaggtatgcaccaccaaacccagctaatttttttttttttgtatttagtagagacagggtttcaccatgttggtcaggctggtgtcaaactcctgacctcaggtgatccacccacctcaccctcccaaagtgctgggattaaaggcgtgagccaccgcgcccagccctcttcttatttttgaatgcacagaacttgcaagccccagagcaagctgcaattaggccaatctgggaagttttgtacatgctcccatttctttttgttatccccaagtcaagtaattacgagtattctagtctttcttctgctgtgctacagggaagcaggagaaggacagcactcatccccacagagggggtgaagagatggggcaactaatgggataccccacaaaaatgtggcttattggcaaggtcagggctgcattgtctgcctctctccatttagactcttcatctagcaggtgattttagaaataccagccttcacattgtttacaaagggcatcactaattattcatggttaatcagttgtactatccatgtactaatatataatattaattatgttactaataccatttatcatctcttttaaggtgagaaatcactgaggcatcactgttataagcaaagtgaagtcaagatggaaaccacacaaaatgaatatcatgcacataaacaattaaaatcacctggccaggcacggtggctcccgcctataattccagcactttgggaggccaaggcaggcagatcgtttgacgtcaggagtttgagaccggcttggccaacataatgaaaccctgtctctactaaaaaatacaaaaattagctggatgtgatggcgggtgcctgtaatcccagctactcgggaggctgaggcacaagaatcacttgaacccaggaggcggaggttgcagtaagccgagattgcaccactgcactccagcctgggcaacagagcgagacttcgtctcaaaaaaacccaaaaaacaaaacaaaacaaaacaaaacgaaaaacaattaaaataaccatttaagtcactgctgaagatgcttctgtgtagtatttcgaaagaaatatttaaagaagcaattataaccaagcaaacgaatttcttgtacctgtttacaaataagcagagtggaaaaaagagaagtgaagtcctattatacccacctgtctggtgcgtaaggcttcctggatgtctccatccagctctgagagctcagcgaggctgtgttctaaatccgcagaaatcagctccttggcctttgtgaacttctccttttccttgtgactcagcgcattcatgattctcaagctggactggacctcttcctgatgaatttggatttttctgatttcctcttggatgtcctgcaggttgaggtctaggtacaccggcccactgagctctgccttcactctcctcagccagtccagggagcgactcatctcagtctggaagtctatactctgcaccattcggctctcacattctgtcaccgtctcaccaatggcagaagtcaacagttttaactccccttgccaggactggatctgatgcctggctttctcataagccaaggggtcaaggtgtggggcaagatcttcaagatgtatggttactcgtttcagtacaatccctgagtcctggagacttcctgccagggagtgatacattttgagcttctcctctgcaggcagcgtttcctcattcactttggactgctcctcttttacagacttcagttgtctctccagctgttggcacatcttctcgtgttcttggtaagcactggtggtgtcttctaataagctaaccctctgttctgtttgtcgcttcagcctgtgatataaggtgacaaggtgcagcatcttgtctggctgccaaggctgacctgtgctgcgaaaaccttcttttttctggttcagttcatccaccgcctccccaaggcccgccacctcgtccagaatggctctgcaaccatcttgcagagaaagagcctcctcaacggccaggtcggtgggaactttgctcatcctcaagaattgggcttcaagttcactcagagactgggttgtcaactcaatcaaggaagcatattccttccgagcaagaattgcttcctggactttatagaacttgtctttagccaaggcaacaattacattaaattgtcgaggcaaagcatttagcttttcactgaggtaggaatgatcgacttcattcagcgatggtaatatggtctgcccagttctctgcagcgtaagtagaagattttcatattctggagattgttcaagaatgttttggtatttagccagttgtgtatgaagctcagaactctcattcattaggttgatttcaggaaatgtaacaatatctgcttgttttagccagtggcaagctttatcaaaatcttccttaaaatgcttcctagaaaccaaattcttctctagttcttgtaaccggtgactgcacttttgtaaaacactgtcatagacactctgcaattcctgaagcttccccagcacttcactcttttcctgctctgtgacttccttcattagttcgcgaccctgggcccaaagtccagtgacttcattttggtaagtcttgaggctggcttgtgcactcttacatgttttgacttgtttgctcacatcatctggtaacagacagatgtgttcacggaacattatctttcgctcatgttgctgaatttggctggtggcctggaacactgccatgagaaactgggttttctcggacaaggctttgtttaagtactttcttcgctggcccactaagtcactgagacaattcacgtggctttgtgcatcagagagagccttctggatgacctgtcgctcattgagaccaagatctgccatgaccctgtctgcgtcctttataagcgatttcaggagcatctgcttggcctccagttcactgcagatggccaggtgatccatgagaaggttctgagccatatctggaggagggctctgcttaagggcctcggcgatgttgggttgttgctcttctgcccactccattagctcctgaaatctggactgcaccacatttaactcctccaagttggtgactgacacttggattttccttttaatgaggtcctcaagctgaaaccaacgttgctctaaatgactcgtctgttctttgactaactccttgtcatctaaattcagatgctctatcattttctgcttttgatctttcagatcttcaatagcatactttctctcctgcaatgccaatgctaactttttcaaagcttccaggtggacagctgtactctctgcatcagatctgaaaatacatggaaaggtataagagcaaattagctgtagtcaatatcgatgtttgttcatactatgctaaattacacttcaccattttctttttggagactgagttttgctcttgtttcccaggctggagtgcaatgaatgctctgatctcagctcacggcaacctccgcctcccaggttcaagcgattctcctgcctcagcctcccaagtagctgagattacaggcatgtgccaccatgctcggctaattttctatttttagtagagacagggtttcaccatgttggtcaggctggtctctaactcctgacctcaggtgatccacctgcctcagcctcccaaagtgctaggattacaggcatgagccactactcctggctgacacttcaccatttctttaagtggatcttctgagcttagaacaattgagagtagttcaattcatggtttgttgacagaagtgctataattatggaatacaagtctcatcagaagtcaatactagaagttgaatcaaaccaagttgcctacttctttctggctgataatgccttccaatcaaatcagaatatgcttttatcttcctctggctcttatcaactgagcagaatctatatggtaacaggatccttggatgttttgtgtaatgttaaacagtgagaagcactgatctagtgtactctagaaaatgatactgaaagaaattaataagtgatgcatgatttatgtgctttcttttgtgaagagggtccaacaaacaatatagttctaggtagtacaatctgtaaggtataaccaacagatctaatggctacttaattgtgtacttggatattttttgcttatcattagtaatctttagtaataagtgtgaaatgtaaagaattctcatccctttgactatgaagcacacataaaaaatggaatattgtagtcttttttactaaatgatcagttctgaagtatgaaaagcagggttgggaggcagtatgaggagttctgttttggacctgttaagtctcaggtgtctgtggggcctactgtgagccagaaatatgagttgttaatatttactggactaatcccaaagacgagtaaatgttaagtatcaaagaaaagcaaacaaaccagaaaatggtataccaaaaaaaccccaaatccccactatgatttcatgatatctagaacaatatttgcagttttctttgctgtaaactagtaaatcggtgcagaagaagtgtagattttaacaattatagtgatcaaaagtatggaatggtttcatataatgatccagtatgtgtgtgtgtgttcttatttttcaaagaagaaagctaagaggggttcaataactacaaaatcacaaaagacacaaattaactgaatttctagactcttgtaagaaaaaaacctgactgaattacacagaatgcattcattaccttatagacttgataagaaactagggagcatataggttcaagaaggattcatttcatgaattcatagatgatatcccataacttgtaattaaacaaaattagaaatatttttagaatattctttgaggtcacagagaaaatggtaccattttcaaacatttctcttttacccactggttaaatcaatatcgagctaggaaaaccatgactctatatccatttgaaaacgttaggttcataatgatgttctacttaccaatattaataataataaacaatagatgttatacctaagacattttattttatttttttgagacagggtcttgctctgtcacccaggctggagtacagtggtgcaatcttggctcactgcagcctcctcctcccaggttcaattgattctcctgcctcagcctccgaagtagctgggattacaagcatgcaccaccacgcccggctaatttttgtatttttagtagagatgaggtttcaccatgttgtccaggctggtctcgaactcctgacctcaactaatccacccgcctcagcctcctaaagtgctgggattacaggcatcagccactgcacctgggcacattttaaatttttatagatattaagaaatgtctggcttagcattttggtgacccatgggagaatttctgttacctggccaagttatcccattctgtagtaaatttttctaggaacacttcaacaacattcatacagtcatggtaatctcttgttctctgaagatcctcttccctttgcaagcacaggttgttagactgacggcacaaatcgagccactgatcatttaaatgatttatttccttgtgttcaggcgattcctccttctttgttaacttattcaccttttctattatggtgttcacggatgcctgtttgctctgtagtttcttaacaaaatcctaaaggataacagcaacaaaaaatatgtaatgtgttaagaaatgcccaaataaatatagagagcaacacagacataagacctttaaacactctaagttccttaatatgaaaaaaactgaagaatgtataataagttatgggaaacaaagagaaaatctaaaaatcaccatacctctttatgaacgttaattcccacgtgtgcaagattcagggtagctgtggtatattcttttattgtactattccaagaggcataaagaaaaactaatacatgtgaaacattacagtcattaatgaaaaaagtcattatcttaccttgaagtgcggcctttgttttctaagaatttttaaggagttcatgtttttcaaaatttattcttaaactaagggtgcttttattctcaagacatcaggacattaggacatttcctaggtctgctaagtcctggatctgtcaagttctggatctgttcagtaaacattattaacctgttcccttaactaaatatcctgtgactaagaatgcctaactttctgggaatgcagcccagcaggtctcagcctcattttacccagcccctattcaagatggagtcgctctggtttgaacgcctctgacggaaaccttccaaatgtcagagacaaggcaaagtagcttgggtcaccaggtgggcagtggtgttatgtacagagttggggaaggctggagtacattcgcaaagtggaaaggcaatggtttagattcatctactccctgcatacacagcaaaaagaaacctctaagataccatctctgccagcccaatatgtggccagaggatcatttctttggatagtgtttcctccaaggggttggttcatggacttccatacttccccactgctcactcccattgccatttactcccactacccaaaaaacacctcttaaatcccctgactgatatatgaaattttgtccttaaagctaggttcaatcacaattaaaatgttaacaagagtatcatcttgaatgtttttattatgtgtatatctaaaacaaatacagcaaaatattggcattgtttattatctctgaatggtagtatcataagtgattgtgatttaaatttgcttattaagacatttctgtattttctaagccttttataataaacaaaacttttcttataaaatacattttaaaaaattaaatttctaggatggttcacaaatttttttaaaaaagagttcatgcttctgagaaaaaataaatcttattatcccgatccctattctcttttttctctgtacttgcaaacagcactccagtagacaatatattattattgactcataatcacagagaaaaaacatctttaagtttatttaaaatctgacccaacttccaattaagttaatacacttataattttcttttttcccttttttttgagacagagtctcactctgtggcccaggctggagtgcagtggcatgatcatggctcactgcaacctccgcctcccaagttcaaatgattctcgtgcctcagcctcccaagtagctgagattataggcatgtgccacgcaaggctaatttttgtatttttaatagagatgtggtctcaccatgttggccagcctggtctcaaactcctggcctcaagtgatctgcccacctcagcttcccaaagtgctgggattacaggcatgagccaccacacccggccacaatttcctatatattttaaattatttaaattatatataaatatgtaatacaaactgcatttatattatactttaaattaattacatatagctcaaatatataactaatgaattgataagcttacagtcctacagttttagcataatatggtgatgaaaatctaaaaaaagaataatgttccatgtttgcttagtcacagagttttctgactaagcagtctactctgtagactaaatcacacctgcttttctcaggaataatgtagagtatgaatgtcttctgatgaaagtggccatctgaagcttcagtaatatatttgaatgtctactttataatctgttttccctggcaccaaatgatgtttgttcagatttgctattccttaaagcagcggtccccaaactttttggcacctgggatgggttttgtggaaaacaatttttccgtgaatggggctggagggggatggtttcaggatgaagctgttccacctcaaatcatcagatattagttagattatcataaggagcatgcaacctagatcccttgcatgcgcagttcacagtagggtttgcactcctatgagaatctgatgtggcctctgatctgacaggaggtggagttcaggcattaatgcttgctcgcctcccactgtgcggccaggttcctaacaggacatggacttgtgcttgtccataacctggggcttggggacctctgccttaaagagttgtattaatgtctaaggattgacagacactcaggcatattgaagtgaatacactgaacacatttcaggttttctactctgttggcctcttttatctcccttgggggcaaattaattcccaccttaacttgtgaaaccatgttctgtgcaatgttcagctccagctcagagtgcctcctcttcatgttctgcagttgctgatcagcatcttgcaggtaaatccagagctcagacttcaggtgcttgatctcttcccagccctgagttaagttctgggcctggacaagcttttgttcaatcttgagaaaacacagagataaaagttagcaaccatacatggaaacatttatggttaatgaatcagagatggaactttccagctggcctgtgcactcatttgacacacacatacacacgcaaactcacacacacaaatacataaatttaaaaagtacttctttatttgcttcaggaaaagcagattttttttaaaaaaatgtagggttcctaaagactttaaatgtctacaagttatgctatatggttttaatcagtgttgtgaaactctaataatttttttttttttttgagacagagtttcgctcttgttgcccaggctggagtgcaatggcacgatctcggctcacagcaatctctgcctcccgggttcaagtgattctcctgcctcagcctcctgagtagctgggattacaggcttgcgccgtcacacccaactaattttgtatttttagtagagacagggtttctctacgttggtcaggctggtctcgaactcccaacctcagataatacgcccgccttggcctcccaaagtgctgggattacaggagtgagccactgcgcccagcgaaactctaataagttttatcaatgtattaggtctaaagctgctctgatggtttttcccattgggcatttcagtagattcatctgtatgactcatgaatttggtgttaaggttaactagaaaagacttctgttattctctgttgcacatttgttcatctgtcttacaacatgctgaattattaatgttttggatatgtctttgatctgcttcactggtttttgaagctgtgtaatttgtttcaataaatcatttctgtaaaaataaatgggttacattggctgggaatggtggctcgtgtctgtaatcctagcactttgggaggccaagtcaggtggattgcctgagctcaggaattcgagacccacctgggcaacacagtgaaaccctttctctactaaaataccaaaaagtagccaggcatggtggtgtgtgcctgtagtcccagctactcgggaggttgaggcacaagaattgcttgaatgtgggaggcggaggttgcagtgagccaaaattgcgccactgtgctccggcctgggaaacagagtgagactctttctccaaaataaaataaaataaaataaatgggttacatcgtcttttgtaaggatttaaaaacagatttgataatattaaagagaaaaaccttattattttgacatttttttcctgtgaatcattttactgttctgtgaatatttaataaattaaataccaaaactaagtcttatttttcttttaaactcaagtgtgggccaggcgtggtggctcatgcctgtaatcccagcactttggtaggccaaggagggaggattgcttgagcccaggagttcgagaccagcctgggaaacacagcgaagccctgtctctacaaaaagtataaaaattagctgggtgtgatggtgtgtgcctatagtcccagctattgggaggcggaggtgggaggatcacctgagcccaggaggttgaggcttcagtcagtgatgataacgccactgcactccagactggttggcagagtgtctcaaaataaagaaacaaacaaacaaacaaacgagcaaacaaacccaaatgtgtttcatggaagagtttaaggctgcagtggcagcagccgggaaaatacgcctccagtgctgccatctgtctgtgtgggccggtactgctagctcatcatagcccagacagtttcaaaatccttctgaacaccacactttaccaatgaactagaaggattgtgacagatggcatgctctttgacatccttgatataataaagaaagggtcaagagcccctttcatattaagtattgcctaaagaaaaaggtggaaaaggagaaaagaacaaaaaaaggtgtggcaagataggaaaattgagagaatggtcattaaggaggagaaaaaagaaaggttctaatgggcagcgaatgaatgggactaagtgattcagtcccaatctgatgtcatcaatgtcaggatgtgcttaattttctatgagttagctgaaattcaaatatctatttattataatggctgtagaaccattacatacagcaagaacaagccaagagctattttctttcaatctcacatgaaacattcaagcaagagaatataataaaacaaacaaattcaatgtgatttttcattttcttaccgtttgctctgtttgttgaatgtcttttgctgtggttttcaccgaagcatttgacaggtcacacatggagcaaaggagatctaggtaggtccttgcctgctcttgcaaagctctgaagtgtttgacctggaaaaggcagttatcagagtgaaagagatgcatcagctatttagatagcaaatacttgtatcatttggaatattctgttgacatttcaaaaatagtcttgctatgctcagtgttttcaccattgtgttcaagtgacatatattagtgactcacaggaaaaaatttaaatcaccaatggggatttatttgtccaccatttgcttctccttgtaagtaaagtattctgtatggtctgggaaaggggaaaacgcaagaaacttctataatctttccagattatttgctcacatgccagcttattttccattccagagaaagaatttgtagcctacgctgtcctgcctcttaacatgcttttgcatatcttagagacagaaggcaaaggtccgtgagttggtaggtttcattggagtgaggttaaaacacagatgtctgggcttctttactttgcaggagattcatcttgtattattctctttccacaagcccaagaaaggcttctccaggtggatctttaatctatttatagaaacaaagaaatgtgtttctttgcagatgcgcagattctactcaggctccattttagatactgggcatagagcagcccataaagcaaaacccttgctcccagggagttgacattcttaggaaggagataaataatatataaataaacaaacttgcactgggatgtttagtagttttaaatatcatgtgggaaaatcaaggtgctaagcagatagcgtatgaggaagaaggactgccacttcagggacagtgtatctcccaggcccctctgaggaaacgacctgaatgcatggcatggcataaggtaagaacattccaggcaggtggatgtggtgggtagagagacagcaaatgcaaagccctgaggctggagcagagtgaatcaggtgtgagcagaggtcggagggtgggcgggggcaagtcatggagccccttacaaggagagctgaccatacatcccaatttgctgggttttgtctctagtctagagtttctcaactcagaactattgacagttgactccaaataattctttgttgtggggctgacttatagcttgctagaacgtcagcagcatccttcgcgtctacccacttaatgccagcagtgtccccaccactcccagttgtaacaaccaacaacgtgttcagacagtgccaaatgtcccttgtaggagcaaagtcaccatctcctccaccccagttgtgaaccactgcgctagtcccattggattatgtaaagcagactctgtcttatcaagaaggttccatttgagaaaacaaattctataatcagcctgttcataagccgtggtaagaaagttggaatttaagtgtgatgggaaaatatcgggagcatcatgatctgaaacaggctttcaaagactccctccgaacatcacgtggagaacggcttgccacaggggtggcaggcagctatggtgtccaggtgttaggctactgcagggatcagatgaaccatgaagatggcctgacagggggtggtggctgaggtagtaagaagtggttcttgattactacataaatagggataaataaggaaggcagtattgactacaagttgcagggataaagttgacttccaggattttcccaaatcatagagtcaatcatggtgcctgattttgtgactccaatctgagtatttttcctctgcactgtgtggattacctagacatgctgtgttcctgtggatataataaacacagatcaatttcccattaagtcaggagtagcaccttttcaattgaatgtacaagcgaactatggtattgtgagtcatcagccactgtgcacaagtaccacatcatgcacctatgacccagagaaagttatttgtctcaaacaacttttggatatgagaagagaataagttgtcagaatttgtattttatgaacatatttaattgaaaggaatgatggtatgatttatatagttgatctgattccgaaagcactggaagcagcatatagagtgttagtgaccacacagctgcaaacgatgtttgctaaaatcaactttacagaaaaatcttatagtactttttcccattccctaaagttcacattttatgccttctaaaaacatatagcactctgaacggaatcgaatccatgtgccattttcttgtggcagcggggagtgtattatcttcacatatgtattgagggtttattgggtttactagacgggtggtgttggggatacacactgcatcttggtaccatgcccattgtaagcggattctccagtcacatatccaagctcaccagccactaagggcctggtcaattttacatgaacacagtaagtcctcatttaatgtcgtcagcagattcttggaaaccgtgacttctttaagcaggaagttgtataatgaaacaacttttgttctcatcaatgctataacaaagctgcatattgaaggacatgacattatttgaggacctgctgtacatggttttgcttacagtttcagtttctaagacctaccgatggaattaagtgaggacttattgcacttgccaagggaaaaactaaaacaaaagaaataacaacaaaaaataaaaaataaaaaaagggaacaaaataaaaaacctttcctcctcagagtgactgtagtccaagtgtctccaccacctcgaactcccttctctggctacttccaaagaccattttgagagacatgtgaaagaggcagaaacaaggaaccatacagtcacgtaatctggaagaaggatcagtatcctcctgtgaccacggcttactctggtatgtgtaggaaatctcttcctgctctagcaaaacatcactgccattaatactttcttctccctttatctcttttatttcttttttggtaacagaggagaaagattaagtgttggtctgaattgttctgaataaagtgcattggaaacaaacagccacaagacaaggtggcttgtgggtcaaggaaactcacagtctaataaaaaagtagaatataggcagtctttaattcatttttcttgattcaaggagaactatgtttcatttgtcctgattctattcttataaagtaaaatatgaacacttttgtgaaccattgaatgacaatgtaaatcattttagcctttagaaagtatacttcgggggacaaattaactagacacattctttatgtggactcagtgatcaaatacattatgctattctaatttgtgctaaaaaattaaattattaaatactgttaattcgtatctggcagcaataacctttataactaaattcctctaaaatattttcccacggagtcaacactgcatacaaaagctgcttagtacaaaagtttaaaaaaaatatttcccacatattctgattaagtctcagcaataacattttcagcatgtggatgtcaaattaatatggaatagaattcccttcacatgataaaaactaacatttcattcatcatccattcaataattatctatgaagcaccttgtttttgccccaaaactatgcaagaagctagtattacttttctgtttataaatcacgtttatctgtagtgtgatatttgcatttcattataacttttagaagtaagtatacttataaatgtcacttttgatagtaggaaactatctcgaaggcttggagaaattaagcgacttacccatggtcccccaacagaataaatattagaattaatctttggttacagtgcccattctctttctttcgttttcttttcttttttttttttttgagacagagtctcactctggtgcccaggctggagtgcagtggcgcaatcttggctcactgcaacctccgcctccacctcccaggttcaagcaattttcgtgcttcagcttcctgaatagctaggattacaggcgcctgccaccatgcccagctaatttgtgtatttttagtagagatgaggtttcaccatgttggccaggatggtcttgcactcttgaaactgtgtggtcggcccgccttggcctctcaaagtgttgggattacaggcatgagccactatgcccggccccattctctttcttttttttttttctttttaatagtttattttcattattcttttattttattttttatttttattttttaatttttcaagacagagtcttgttctgtcaccaaagctggagtgcagtggcatgatctcggctcactgcaacctctgcctcccaggttcaagcgattctcctgcctcagcctcctcagcctcaggcgggtaggtaccctgctacctcaatcccagggtagctgggattacaggtgcacgtcaccatgcccagctaatgtttatatttttagtagagatggggtttcaccatgttggccaggctggtctcgagctcctggcctcaagtgattcgcccgttttggcctcccaaagtgctgggattgcaggcatgagccactacgcctggccccattctctttctagtctaccaagttggcccctcagtatcatgtccatcttctggctggcacatgaactccactagagccaacctcagaccttcttcctacttttagattcccaggagtcaatacagtttggcacatcataggtacttcacacattttcactgacgctctgaatgattcacaagaataacacaaactttcaggagtttactacctgcttaatggcttctgccctactaagaggtggttgaggacttggctctaaatccggctggactgcagaaagccaggcctggcactgctgcagggtgtcttgtcggctgacgtgcttctgaagttcgtgttccaaactctggtacatctgagacaatacaatcatgctgagattatgagaactgctttctacctctataaagatcattcaaattcaatgaaacatgaccagtacatctaaatggattttccccccaagattctgcaatttcatctaatatctaaggcagttgtatgtctccccagatgttgcaaaatgcaatgcctataccccagttgataacttctcggaccacacatcacagtgtaatatccggattaggggaagagaacatgagcagggtaaatataaccgtagaggcatgctagaatacataaaatcattgaagttaattgtcataaacataagtcagaggtttttgcagcttctcttcctatggtataaatattgcactttttgtttaagctagcaactaaaagtaaaaataaaaaatgatctcaaaaaaagataaccaatgtttctctaactgagatgcttctgcaatagagatagggtaaaatttgaactaaattataacatgaggagtggagaggtggatgtcctcacttcatcttagaagttatgttccagggcaaaaataatccagaataattcatacattttctgatatgtctatttaattaattaatccttaacaagccaaccaattttcattttatccataagacatattaagaaaaattatgtgtctatttgagatcaagagaaaatatatctgggatgtttccatttaggaaaaaggaaaaaagaaggaaattagtttaacctggcatttctttcattattgagacaatagaagcaatcattgaattctgcttttctctgtcatcttttaaattcatcactttcgtctgacattgggtttatcccttatttattcttattccaagcagaatttttaaaagaatggtgttttgttctctttatcacttttgcaaactttaattatgaagttctgattatgttcttagaatttcatccactttttaaattttaaaaattatgttggcttttccaacatccaccaattaaaacaaattaaactgtatccctaatacaaagaaaatgtccactgtgaaggaagacagtgtgcaagaaatctctgttgaatgagtgaacgaatgaactcaccagaaagttctatgtgtagcctcattttctctcttcactcccccttttctccccttgtcatcattttcaattatttattagattcttgtagtcctcttttgttaacctttgaaggtgatttttttttaagtctaggaagttgactaatgtcacccagaattttttttattattatggtgaacacggaccattctaaccacatcactgatgtatcaccagttctttttgttaacctttgaaggtgaatttttttttttaagtctaggaagttactaatgtcactcagaattttttttattattatggtgaacatggaccactctaaccacgtcactggtatatcatcagttcttactggctagtccagtaaacaaaaatacacagaatactaagtttaaaggcttataaaaactctttttagtgtcatttaaaaattctagaataatagaaagcaatttacctattttagtaagtttttgttaaaatagccattcttacccctcttacacttatttctaaaacattaagaattctgttttagtggaagtacacccacttaagtgtaagtcatatttgtcagttactcgtttctcaaattctatatgaatgcaaacaaatattgatttagattagaacccaggctgcatacagttaaaaagaaaataattattgtgaaaaatatgaaataaatttacttttgtgctacaaaataaatggaaaattagaaagtattgatcgtgtgcaaagaaaaacacatcctctattcaaacacatcaactatttttttcttttttaaatttcctcaaattccttttaccaacaaacaaattaactttatttatttatttttatttagacggagtctcactttgtcccccaggctggagtgcagtggcgcgatctcggctcactgcaatctctgcctcccacgttcaagcgattctgctgcctcagcctccggagtagcggggattacaggtgcttgccaccacgcccaggtaatttttgtatttttagtgaagacggggtttcaccatgttggccaggctggtctcaagctcctgacctcaagtgattcacctgctttggcctcccaaagtgctgggattataggcttgagccaccatgcccggcccaaatcaacttttaacaaaccttttcacaatcaactcatggaataaacaaattggataaaacaatatctgaaattcgctcacacctgtaatcccagcacgttgggaggcagaggtgggcggatcacgaggtcaggagatcgaaaccatcctggctaacacggtgaaaccccgtctctactaaaaatacaaaaaattagccaggcgtggtggcgggcgcctgtagtcccagctactcgggaggctgaagtaggagaatggcgtgaacctgggaggcggagcttgcagtgagccgagatcgcgccactgcactccagcctgtgcgacagagtgagactccgtctcaaacaaaacaaaacaaaacaaaaaaaccaatatctgaaattcactgcttagtcacatcaatcaaatacaaaatatgttagttttgtgttcacatagcaactgtgaaatttatcctcgtatttcctgtctggcaacacaccaaaacgaatccaaagatttgagcatcgattctatttgtaaaaagtctctagactgcacagcctctccccataattccttgtcactgtggaatgttctgggggcactcaccctctgagctgtgctgcagatcgctgagtagctgtcctttgtgccctgcagatgagcatgcacgttttgtttaagtttcgcttgcaggtggtctgcacattggccaatcaaagtatcacctttcatttgaagattgttcaaacggtcttcaaaaccagcaatttcttccatcattgcctgcaaaagtgaaaccaatacagagttttcagaattctacttttaagtaacttatccatcaaagtttaagatagattatttcactgtttaatattgtttttgaaagaatcttgcaatttaccttagttatatattaaatgaaaacaaaagcacatgtatgttttcagggatactccaagaggaagagtcaatgagtttaagagattagttacataaggaatgatgaagtaacctttaacactagaatgtgttcatggctggtctcagagagataatactccatggtattattaccagacaaaaagatgtccctatatttttcaggttaataagttataattctggcataatttttatctaaaacaatctaattactatttcatcaactttatataatatcttatttctataaggttggtgcaaaagtagttgtgttttttgtcattcttttttttttttttttaagacagagtgtcactctgctgcccaggctggagtgcagtggcgcaatttcagcttactgcaacctccacctcccaggttctagcaattctcctgcctcagcctcctgagtaggtgggatcacaggtgcccaccaccacacctggctaatttttttttttttttgtatttttagtagagatggagttttaccatgttggccagctggtcttgaactcctgacctcaagtgatctgctggcctcggcctcccaaagtgcttggattacaagtgtgagccaccacgcccggcctgttattacttttaatggcaaaaactgcaattacttttgcacgaatataataatctaattctagtttctgtaataatgtaatatctaatttttaattcttgtaatatctaacttacatctactactgtttataataatgaaaatagcatttaaacttatcatttattaagtacctgctatagtccaggaattatatataagcctgacgaatgtgtattatcattgttttatagatgaggaaactgaatcacagtgaggttgtacaacacagtcaaggtatggcacagcccccaggctttagacacagctcggcctgatttcacctcacaccaccatgtccacttgcattctttagtgagcattcttatagatgactcagggaagaataacttattttttaaaaatcacgttctggccagacgcggtggctcacgcctgtaatcccagcattttgggaggctgagactggtggatcacctgaggtcaggagttagagaccagcctggccaacatggtgtaaccctgtctctactaaaaatacaaaagttagtcgggcatggtggagggcacctataatctcagctacttgggaggctgaggcagaagaatcgcttgaacccaggaggcagaggttacagtgagctgaggttgcaccattgcactccagcctgggcaacaagagcaaaactctgtctcaaaaaaataaaataaaataaaaataaataaatacataaataaataaaatcaagttctagtgttttttttttttcctgttatatgatgctaatgacaagtgacacaatccaacatagggtagcctgggtaacccatcattatatctataggaaacctgggtggcccttcagcagtccagggtctacaaacagcgctgggctagcagttatcatatatgctcagttgaaaagaaccactctgtctctgagttggaacagaaccactccatcatgaggccattcatggggtagactaccttctggattgtcatctcctcagtgcctaccagaaggtattgtgtagctacttttttattcatatttgttaaataaaatcctttcttatagacagaaatgttgcagcccagaggggctaactggctttcctaagacgcactgtcagacactgaccacatgatgagtaaacttgttttccattaagatcacaaatcagttgctccatgaaattgtgaccataacgtctatcacgtggtaaacacgattactaaaaatacatattattaagttcttatcttgatagatttaaatagtgcttttagcctatcacctatatcaaagataagaactcctcatattagttttgtactttgtgatttacaaaatgtcttcacaaatattatctcctgtgattagcacaacaattatgagatgggctggtattgttatcatcctaaaggagaaaggacagactcagataggctaagttgtctctccaggaaggggaagagtccagcctagaatccagactttctgatgcctttggctgcattttctaaaatagattccataaagactaaattctgagataaaaattattagctgggggaaatgcagcaatgtgttcagaagttcaacgcgaggattcaactcttcttgattcacttgaatatcaagttcaattgttgtcaattgtcagaagtgcttgagactcagaccttcatatggtttggctgtctccccacccaaatctcatcttgaattcctacgtgttgtagaagggacctggtaggagataactgaatcatggggacagctctttcctgtgctgttctcatgatagcaaataagtctcatgagatctgatggttttaaaaaggggagtttccctggaaatgctctcttctgttgtctgctgccatgtgagatgtgccttaacctttcactgtgattttgaggcctccccagccacaaggaactgtaagtccaacaaacctctttcttttgtaaattgcccagtctcaggtatgtctttttcagccatgtgaaaacggactaatacagacctgattctctcagtacaatcattataaaccagagatgcacctgtgtgtgcacccccacacatgcacacacatgcacagacacatgcgtacacacactggtgaagccatcccaaaggcagccctttaaaggtcaggggtaccttgtggtgggccaattgctgggtgattgtctccaggctgcttgtctccaggaggtcaggtgccaccagtctgccagacatctgcagcagccacttttcgacctcttggagctcactgttgtagtcttcatggtctttgactttcgcctccagactgaagacatgctcctgcaaaaccaggtgtccatcagagatgactttcaagtgaaaaacctactcaaaactgttttgtattacaaaaacccagtgcaactcacagggtagttagagctacttagaaaactaccaggaatggaaaacaacatagtcattatgccaattaaatatccatctgaataaaaaaaaatactaacccgtaccaggccttaaaattacatgacagagagaaaggagtcagggcccacattttggaaaataaacccttttacggagtctttcatctctccttacctttcctatgctgcacaggtcctggtaatcactttgaagttgatctattttgtcctttaaagtgacgtcctgcaccagttccaaaagagcttcacccttctctctcactgactttactgatggttcatgggacagcaccgtttgttgaagtgacttgaattacaaagaaaaaaaaatgagcctgctcatctccgtggacaagatgaatacatacatattcccatggtatgcaagagatgatctacctcaaagaaagattgttcatatttatgaagcaataggtgcaagacattaaagagagagtgatttattaagacgaatacagtttctaaatacaacagcagagtcacacatcaaatggcccttcctatgtggagataaaaggatgggaaatagttatatttgtctaaattaaatatagtttatatttctggcttctaccttattcctttcatcagagaaaaaaaatctcaacataaaaaggccactatcttttgattttgagttcatgaagttagttccagtttgagctatttatggagttagaaagaacaattccagttgtgaccttgctgagataggctaaaggcactatttaaatctatcaagaactcagtggccaggaggaagaggttgtgattcttatatggcctcttcaaagacaagttgtcgggcttggcagagaagccaaggatagaaatagacattggctggaagaggccgtcacagaagcttccaacagggaaagctttggggtaagccagcacactgtaatccttaaaaggtatcactcaatcatccagatcaaatttataacacaaattattccacatataagcttgcataattgcttcaaaaatttgagtgggtgaagtacctgtgtctatgtcatgtatagctatagccacatcactatttattctttcaaaaatcagtttctaaggaacttagctcgagtttgttaactagaacttattttcttataaatatgatatgtcattttcaatttaccataggtcagtttctagccttaggtaccagaagatgaagggaagcctcaatatgggaaagatatgggatcctgatgccagcaagattttacctggaggatccaaatacctggctcacgcatcagaaaaggtcttcattgattgacagatacgtacaatcaataaatatattgatacaatctttgagtatcagatctctgaatgcaaaaataactctgaggtagtggatttaacccaataaatctccataggtcatggcatcactggtcagctgcagaacggacacatgcgggatgcattccagcagctgttacgggtgacacccagcaagaatcacctccctcccatttggtctctgtgtgacctctgcatgcatctgtcaatgagtaaacacactaccttgtatttagataactgagcttttttctcatataattccattttgggttcttcaggaacatgtagaatttcctggtattctgctatccactgtgtcagtgctttgcatttatctgagaattcctttgctaaatgaagacctttttccagcgtcatgtgttctttccggacagtgctggtcagttccttcaactgctccatgtgatcatgaatctcctttcttaacctctctgcctcgccttcctccaagtatttaacagccctctctcctttctcccgggctgatttcagcaaactgtgacctttctccatgtctttgagcaaaacctgaaaaagagagtgagtaggagcaaaggtagtcttgtttcttttcttttctttcttttttttttttgagatggagtttcactttgtcacccaggctagagtgcagtggcacaatcttggctcactgcaacttccgcctcctgggttccagcgattctcctgcctcagcctccaaagtagctgggactacaggtgcgtgccaccatgcccagctaatttttgtattttttagtagagacagggtttcaccatgtgggtcaggctggtcttgaacttctgacctcaagcaatccacccacctcagcctcccaaagtgctgggattacaggtgtgagccactgtgcctggccatttcttttccttttaaagaaaggtttctcaaggcctgtttttaagtccacctatttccctttaaaataagttgttgacattcataaccagatttgacgtgccaggaatcaggaaccttggcttctttatttcaatataggttctaaaagtcttgatcaatatatcatttccaaatcagagacttgaaaaagaacttgatgtttctctcatccttagcaatctccttctaaagacctgagtttaaactctttacaagcactgggccattaatttgagagagaaagttttctcttaatattgaagtgtcacactggaattcagtgaagactttcatgggtgtccatgtgtaagtcattctgataacaacacatcatcaataagtgaaagctagcttttggccttaaggagccaacttagtatttcaagtaaaatgatgagctcaggatcaccaatcataatggttgggatgatcacctgtgtttccagtatctatgcaggagaatggggcagcttggtgaacggaaaggttggatacaaatctgaagtatgcgtgcctacctccaacgtcttcaatttcttccccatcattactgtatctactttgtcaatcttggtagccacattcttgaagtttttatgagtagagccataccaatcagaataggaactgagggatgattctgattcctccaaactctgaatctcctcctccaggaattttatttgttcctatgaaagaaaagagaaaattgaatggtgaagtaaaggcctgtgccagggcctttgttgatgaatatgtatcttcactggatgttagtgaaaggaaggctattttggctggcgaagtttgctggtctatgctgagcacctggtgacccactcaccagcacttggagaagcagggcctggtatctggaagtcagctgggtggcctggcaacccattctgctgttcacgtggctctcgtccagtatctcctgagctctagctcccacttcctcaacttcatctctgtatgcagtcacttcttcgtgccacttctgaaatgacaaagtatcgaagggaaagattcaatcttagccattcgaataagccaaatgtatatcttcttataggaaatggtttcagtgtaggtttagaagatgtttattttgagatttaattttgaaaatgccatatgttatcttcataaatattatattacaacaatgtgatacaaactgtacacttgagttggatagttttctgtatctattacacttcaattcaaaaattaaaaatgaaaacaggccaggtgcggtggctcacgcctgtagtcccagctgcttgggaggctgaggcaggagaatcgcttgaacccaggctacagaggttacagtgagctgagaccgcaccactgcactccagcttgggcgacagagcaagactctgtctccaaaaaaattaaataaaataaataaacatgaaaacaaagtggcataattttttagacctcctattgtacctagatcaattttaaaatgggtggataatgaaaataaattcctaaggctcaagcattattttagatgtgtgcactaaaattgcataaaacttagaataaaactaattctcaagtactatttcaatgaactatattggagcaatttcatatcagaaccataaacttaaattattgtaatacaagcattcatgtatcttcacaaaacaaggtaatagggtatggaaagaaaatataaaatggttacattaaactaccttgtatcaaagactaatttatgaaataattgctgtaagaggaatgctccattgtgatttattttaactttctaggtaatcaaaaagattttgcaaagcctaagctttggataaaagttactaaatatcttaatgaaacaaactatgcaaggtaactgtagctttgacaaagatcaggaatctacatgagttgtaccttcatctgatgtaattgtatctccttggttgccctgttagactgacgtctggtcctgggactaactttctcctctgctgttttgagccattcatctacttgctgaaacttttgctccattagcctcaatttgttcaccacgttattgaactgagttcgagtctcggacagcctgtgctggtaagcctgccagtcttgccggagagactctaaagcccggtcctctgcctgtgggatacctgatgggatcacatcctctctggtgtgcagcactgagttcaacagggcctgcccctctgcacagtgtacctgtagctcctgcagagaaaaaggtatggctgtcactctcaatcatatttcacacttgcatgggttagcatgtcttgcccaagccaactgtgcccacttgaacttctcattagaaaaaaatgattttattattatgccctatacaaaaatatgtccctaaccatattttctccgaagtcagaaggattcctaaaactttttcaattaaaataatcaacatacacacacacacaccccaatatttttctcaatcaacagtttcccaaatttgactttttagctaacaggcaaaaacacttgtgaataaagggctattgtttaaaagaatgacctaggcttattatagctcataatctgcttaaagtgacttaagcttcttgctttgacattgaatagctcagtgctacatttgtgactgagaaagaaacaatgaaccttctgcttcctaaggaggaatcttttgccaaagctgtactctaggcattgtggtggccaagaaaatttgaaactggagagtgcagggcacacaaacttgggaaattggttcatcacacctgcccaccaggtgctctgaggtgcaaataaatttcctccaccaaagcctaaaccccaaagatttaccctacaaatttagtataaatcaagttttgaagagcatatgctattttttataggacaaaaagaatcttatatccttaaagatattggtaaaacaacatggcacacttatatttctggtgataaacataaatctatactgtcacttgatctgatcacccaaagtaaaataaatcaagtcaaatcccatcaacaatgttaaaaatatcagtatatgtagttaaaacatagtatttctcaatactatattttaaaaaccacttaagattgctaaaatatttttcttacaaaaataacattctcacatggtttcaactaatagaaaatttttcttcaaatatgatgtcacttcaagcacagtataatgtaaagacatatgcacatggaaggagaagaactatagatatacatggtaaaatattaatcaaattggcaacaaatacataaactttattctaaaattcttagactttttttcaagataattttttataattattttcctaattcaaggttggcaaactttttctatgaaaggcctgatagtaaataatttggatcttgtgggccataggtctctgttgcaatgacttaactctgccattgtagtatgaaaaaaaccacagacgatacataaataaatgggtgtggctgcattccaataatattttatttaaaaatacagacactgtggccctggacagtagttgactaatctattaatcttctcaacatcttttccatagttcataagtaaccactttatctattatccaagttaatattctattaaataaattctcatatatcccaaatttcaagtctgtattctgaaggaaaaaatagttcaatatttaaataaatatatatataatattgttaaatatataaaatctataagtaacataaatgtgtgtatataatatattaatatatattaatatattaaagatattatattaaaaatatataaactatatatatgttctatgacccaaactaggccttcaggttatacaaaataatttctgaatatgttccacattactggccaatccctacaccatgtacatgctacagaacatcaggatcctgaagaaattctgctttgtggttgcagcatcacaattctccaccactgcttcctgccactagcatcttccttcttttttaacctttgtggtggctcacaatagaaaatgtaagaattaatgcatggtgaaatcagggggaggttaggtttgcaccacacgaataccggcttaagtgaaatattttcttttgaccagagcaacagcaacatctgctggtgatgggtaactattgacttagttctacacaaaagcacagggagctcagcatttgcttaccagtgatgttggtagtgtagaactaagaagggttatgtaaagaaaatagtcaattctagtcaaataaattacaacagctaaacctgtggatcctactctttggaggcaggatggatgagacccttaagtaagctaaggaaattgtgacccttctaacttttagtatttacttacttcatgagtagaccgtatatttaaataagattttcttccatttcggttaatccttacaactctgtggatgaaattgggtcagagaagttgtctcttgcctgaagtcacctagtgttgggtcccatcaaggattagagtcccaacttcccaatcccaaccccattctcttgccattatacaatttccaagaactagtagaaaaagccagaaattttatatgtgactgataatcatgatggtccctgattttcccaccttgttcaagctgtaggtaaaacttacccaatcctgaaccaactctgatcaggactgatggcacatttgtaagttccaacacatcactggtgggacataaagtggtctcattggccttcctccatcttctgctgtttgttttgtacatggtggccccttcttggtgaacttccttgattcctacctattccttaaggtaagtttatgggcccttctttgatgctaccataagaccccttacattagtctactaatgtcctcgccatattatttataatcatctttctatgggtttgtgttcctcatcagatttcaagtttcttgaagacagaaatcatatcttaatcatctttgcctgaagtagctagcaaagtatctgtactgtattaagtatccagtaaatactgaatgagtaaataagtatatagattgtgaccactttctccaccatgtctggcatctcaccgtgaattatggcccgctggcctgggcactaacacttatttttttttacttctgtaattccttcttctagaactctgagcccgaaccggtaccatcagcaatgtggcaggttttgcttaaaactacatggttcaagatattgccactagtttgactttgtgtcaccttctaatgacttctgccgctgtcccccagatctgatgtgatcccttagggagaaacaggcaggtaagccagaaaaccccatcaattagatctccagccatttgtcagggccaccctagcagctccatgaatcccccaagtgctagtcctgtcctacctaaattgcctacaaaatgatgtcaactagcgcatactgctgaggtctcagaatgttcttgatcaaaccttatggggattgcacttaatgtgtatcaactagccactggactcaaggtttctattaacttcctattgcctaaaataataattccatattcagaatgaagattcctttgttttaggataaaggaggccttacctgaagatcacgcaatgttgtctcatgagtgtgggcatcaccttcaagaactgaatactggtcgagcttttcttgttcttgccccaaccaaacttcaaatgcctttaggtctctctgatactcttggtgcaggcggacaagtttttcagacttggttacggcttcctataattagcatttaaaataatgaagttaggaacacattactttataaagcatcagtgtgctgtaattcacttttgtaattttagaaaagtataattattgagacattagaatatgagttatttcctagaatcatgaatcttcaatatttatgtaaaaatataaaaacctaatatttcaggaataaaagtgtcattaattattttgttgaattaactacatgatctctgaacaccttataaaatgtaacaggctaagaaatgaattcactttactaatttcataaaaattcacttttgctaatgaagaaaattgaaattcttatattgtgccttaaatgaagatttggacgtactgtggattaaattttccatagtagaatgcgctctgaaaaagcatatttattttctttgtgaggactaaatgaagaatgattaatactatcagtgattatttcccaccttagaaaactctcatcatcagacataataaggcatttatgagtcttcaattgaaggtgtccagaattttttttaagttggtacctttctaggaatttttagttgaaaattatcttactttcatagctttcataatactaacaatatttgaaggtttttgattttgccagtaattcctttaaaatattaaaaattcattttgcttttgttctgttttcccaagcctgtcattcttgaacataaatgagtctttaaaggagcacagctccaaacactccccttttggtgagtctacaaggaaagtgctttgccgtaccttggccctctcttggatggctctgtatcgttcctgtagatcctggagttctagctgggtgacatagtgttctgtcatgccagcccctttgacttcgatggtctccagcaagctgctgtaactcagcacttcttcatttaataactagagagcatttaagaaaaataaagtggccattcatgcaccatcacatcaacgacactgctaaaatcaagatattttaattgtacagttgacaagtgacctcaggttatttattcgtccactcctccatcattttatctatttgacacagatatgtgtgtgaatgcatgggtgtgtgtgtgtgtgtgtgtgtgtattttatgtctggtccagaactttctctaacatatgaattaccaattaactactttatatttctactcttaacatttcaaactgattatgtccagaaatggacccctgatgttcaccctatccctattctaccccagcccccatgaagcccccttctctttccatctcttttcaaacagcaaatgccatgacctcccacccagacggtcaacccagaacatgggaattgttccagcgtcctctctagctctccgtcctctaaaccattaggaaatcctgttagctctacctcctattatactgcgacatctgtccccacatctcctgcaaactccccagcccaggctgccctcctctttcacttggactttgcagtggtatcccaggcagattcctggccaccaattctttccctgtcccttatttcatgctccacacagcagtctaagtgatataatgtcttgcaattaaaagttgaatcgtgtcgcttctcagcttaaaacctggattatcgtcccaatgctgccgggatcaagtggaaaatcctcagagcagctggcatggcaatggaggatcaggctctgtctctccatcaaactccccttgcagcccctccctgcctactctctgctgcaacaacacctgcctgtttcctcacagctccccactgcaccaggatatttccctccacagggcccgaggacctgctttttattctatccggaatgctggttcctcaactcctccccaggctcatttctctggcttaaattctttagtgcatggactatatgtctgctgtttcagagaggcctttcctgtccctctcccttggcctcaaacaagctgtatgagccttttcaaaatgattctctctcacaccacactactttttttttcttcatagtattcagcagttaaaattatttatttgtacatttattactgagtgcatgcatccccactaacatacgcttgactgtttttactgctagaatcgggcacagtccctacatgtagcaatttctcaataaatgttgattgaatagatgaacaatccaattaattaagcaattaattattataacagataatacatgcaggtatttatgaagcagataattataattatattattttatggatgcataaatgagacccagaaacattaagtaccttggcataggtcacataagatcatttagtcatttaaataacttttattcagcgtgtgttctgtgtcagacagagagccaagtgttgaggatataaagaaaattaagcatctctattcactgaaggagagggacatgcaaatatatatgaaattgataaagagctttgaaccaagggctatgagagaacagaacaatgaatcaagcctgagcggtggtggtgtagcatagctaaaatgacttcaaaattcattcagaaagataagtaggaggttgccaggggcagagacagagcaaggaccttctgtaaaaagagaagagattatgcaaagacacagaattgtgaagattgtggcatgttcaggagatagtgtgagattcagcaaggctggagagcgcaagggaggaggctgggagcatgaaggaaaggagcatggcagaggagtttatttccattcttacaaaccaggtgacggagattgagcttatcctgtagacaatgggaagccaacacaggacctcaggcaggaagtgagacattcatctttataggagataacaatagatggaggcaagaaacaaggtgaaaaattaggagtctgttccagttcaggtgaagaggatggatcagtaggacctagtgccagatgcaaagtggcaatgagaaagaaggcactgagaataatgaggtttccaatgtaatatattcagggtgaggtgatacaaatgagcaggaatagagaatgtgagaggttaaaggatttctgtgtagaagatcacaagtgctgtttaggataatggtaagggggtgatggaacaggctgaccgatgatcatgccctggagtgaggctgcagctataaaccaaaggactgtaaaacttcatgtttgaatactactgccaataagttttaagaacatgccattatttatttatttaaaaaaatctttccatgtagtactgtactaatgtaagcattatgacgaatgcacaaaagataacacaaagggatgtgataaaaaaaaaaaaaaaaggaagacttcctaatgatgagcaggctgaagacattaaaagatatttcatggtgctacattttaaatggtttgtatcataaaacatggatctacatggttttcctggaaggaaaaattttcactcactaataaagtaatcacaaatgaaagtccagtttaagaagcctttagagattatactaaaagccccaaacgtaatttgcttatgtgcactgccctagggtacacgtaatcccatttttgtctgactgtggcattctaaagaagcctgtgagaaaacacatggaatctgaaatccagctctcaccttggcttttccgagcatcgttgttttatcccgcagctccgcatgctgcctttctgattcattcaggttggcttccatactatccatccaaccggagaactgtcgaacgccatcctgataacttgtccacttggagagagctccttcgagttggctgaaagggatttgaaaggacaataaatccacattgagaatccttaggagtctaaaatgtcattgtgtctgctccatccactccagtaagcaaggggtcaagagatcaggaagaagcttgcttgggagtgagcaggctgcccagggcttaaggacactgagtccaggtctgaagggcagcctcaggaagcaaggaacatttaaacccaggccaatatgcagaaacatggaactagctatcaactcaagagtcagcggctggggggacacgagacactgggggagcctcaaaggcaaaactgagagagatcccctgagtgggtcttttctggagccaaagctctgggcagggagagaagcaacacttaactctatcaaaccgagcaggacattgagagcaggagagaaaagtaagaacagtaaccaccttacgtgagattaaatatcagaaaatcgtaatgaaataaaaggacaatatttcctgacttggtctaaatagtaaaacttaattatttattttatcgataagttaagcacttcccttgtctcaatacacatgctagttttttttttttaagacaaagtcttggccgtctcacccaggctggagtgcagtggcgcgatctcggctcactgcaagctctgcctcccgggttcacgccattctccttcctcagccgcccgagtagctgggactacatgcccccgccaccatgcccggctaatttttttgtacttttggtagagacagggtttcactgtgttagccaggatggtcttgatctcctgaccttgtgatctgcctgcctcggcctcccaaagtgctgggaatacaggcgtgagccaccacacccggcctacacatgctatattttaaatttcattaatcaggccgggcgcggtgactcacgcctgtaatcccagcactttgggaggccaaggcgggtggatcacgaggtcaggagatcaaggccatcctggctaacacagtgaaaccccgtctctactaaaaatacaaaaaattagccgggcatggtggcgggcgcctgtagtaccagctactcgagaggctgaggcaggagaatggcgtgaacccgggaggcggagctcgcagtgagccgagatcgtgccactgcactggagcctgggcgacagagcaagactccgtctcaaactaaataaataaataaataaataaataaataaataaataaataaatataaaaataaataaattccattaatcatttctgcctaattgtactaccaggttttgggtccttttgtagcagacactgtaagtgctccatccatccacacccccggatcacaccactgcagcacagtccagttggacttctaattgctcctagatctcttagcttgaagacattctctagcccctgatgtactctcagtttgagggcaatataggcacaggggagcctcaccctgaggggcagccctcaactgctcttctaattcatatgagtttgtctctaaatactccagatcccctgcccttggatgggataactggggctcacactgtataccagctcccagcattgcctgactggattaagttgcagttgctcacaacggtgggcaactcgcttgataacatacctgatatggttaagctctgtgtccccacccaaatatcatcttgaattgtagttcccataatccccacatgtcatgggagggacccaatgggaggtaattgaatcatgggggtggtttcccccatgctgttctcgtgatagtcagtgagtgttcatgagatctgatgattttataaggggcttttccccttttgctcagcacttgtctctcttgctgccatgcgaagaaggatgtgtttgcttccccttccgccacgattgtaagtttcctgaggcctccccagccatgaggaattgggagtcaattaaacctctttcctttataaattacccaatctcaggaatgtcttcctagcagagtgagaacgggctaatacaacaccctttacttactgccctccccctgcctgccatttctttcccactcctctatttgtatttcctgggtttacctcccaagtccactacttggttttaatccttatatttttacattatgaatctttttttttttgtatttttatgttagcaacaacaacaaaaagaaacatgcatttttagttatattaccacattggcacagtattcaggtcaatctaaatgtgagattacatctgccagtttcttttgttctaataagaaaaaagaaagaaaaagaaagaggaatcaagagaaaacagggggaaggaaggaagaaaggaaagggagtgagggagggaaggaggaaggaggaaggaggaaggaaggaaggaaggaaggaaggaaggaaggaaggaagggaggaaggaaaggaaagggaagggaagggaagccggccacaggaatggtctgttcagtagtattatattgatcttttagtaatagcttccccagtgcttggctgtagtttccctcaccttttacaacgaatccctgcagacaaaagggatgcccacatatccttcacactctgcagctgctgctgaatagtgggaatgccttctggagaagtattctgaaggacagattctcccctggtcactatcattttcatctgaatctctttttcctgtttgactgataatagagcctgtgaaaacacatacagaagtcctttgtcatttgtatgtttaacattgctggctttaaatattgcagagctcctaaagatcacagaataatatgcaattgtgcccagccctggagctcccagtcggctgagacagagggtggggaagtggcttgctggtgaatgccagtcaccagctacccgctggtttttactaagtggccttggtgttgaaggtctgcagtcttctctgaataatcccttccttccaatgaagttttactttactggttttaacaagggaaaaatatagtacagtagaattcatgatttctcaaaggttataggatgaagagcttataaatgttatggtctctataaccaaaaaaacccatagaaatagattatatatttcatgttcttcataagtactattctttttctatgtgagaaggaagtttcttcttttgctttttttagagacagagtctatctttctctcccaggcttcagtgcagtggtgtaatcatagttcactgcagcctcaaacccctgggatcaagcgatccttctagctcagcctccttggtagctgggactacaggcatatgctgccatggccagctaatttaaatgtttttttttttttgtaaaggtgaggtcgatgcccagcctggtgttgaactcctaggctcaagcaatcctcccacttcagcctcccaaagtgctgggattgtaagtgtaagccactgcgcccggccagaaggaagttttaattccaagttataaaactgataatgttgcctaaaagacaaagcttcatctctttttataatgtggttcttgccaacttccaaagcctcagcttcagccacccattgccaccagtttctgctgtggcaataagcaactggtagaaatttctcacacactacgctgttctttcctctggctgttcctcacacttttcccctctctgccaccattcccaagtctccacccagttatctttgccaaaataattctccctatcattcttaaaaacttggttttgcccggacgcggtggctcaccctgtaatcccagcactttgggaggccaaggtgggcaggtcacctgaggtcgggagttcgagaccagcctgaccaacatggagaaaccccgtctctactaaaaatacaaaattagccaggcgtggtggtgcatgcctgtaatcccagctacttgggaggctgaggcaggagaatcgcttgaacccaggaggcagaggttgcggtgagctgagatcacaccattgcactccagcctgggcaacaagagcaaaactccgtctaaaataaaacaaaacaaaaaccaaaaacagaacaaaaacttggtttatagcagggcgcagtggctcacacctgtaatcccagtactttgggaggccaaggcaagaagattgcttgagttcaggagttcaagaccagcctaagcaagaaggcaagactctgtcttaattttattaaaaaaaaaaatttaaaccccacacaactcgggttacctatcacacttcctaagaaatctctcccaactttcaaccccatcccttctgcacggttccactcctgtgtatgtctataacaccataaatacatctgcatctgtggttgttgtcttctatatttcgacctccaacttcagacagtaaaacccctgaggaaaaagactatgttattcacctttgattccttggtgtcaagacagagtgccggtctcctagaaggcacccagtatacaaatgaatgcagactcattattttcttcacaaatgcgaaaatgaactcataacttgggatgggaggagaattggctaaatacaggaagacaagtgagtggaaaaagatggaaaatgttttgccctataaaatgtttcctcaaaatattttcccataatgaatatgtctgtgatctcatttaaaactagcctcttaacaagtgatcacacaagtaatcacattcgggctttattttattttattttttggaaaacatccggggtcagatgattcaggaattctctggcatgtgcacccaaggcagacagcgttgcactcacaaagcatctgagatttatcatggagagaatgtgacatcatcaccccaggtggatggagacgggaaattttgagaaaaacaaattctgtaggttggagatatttctgtgtaaagatgcacacctcgagcttgagcgtcctgctgtccagcacacttttgtcggatgtcgggtggcagtatgaatccagcatgtgaatcgcatccgtcatccagtcttgtaattctttaatcccaagagagaactgattgtgttctgcaacgattctatccagtcttgacactttctcctggaaatgacagaaatggttttcgagctgtccatcccacagagacaaactgcaaagctaacagtttgtttgaaacaaaggcaatcagtcatggcttcatacgctgcacagatacgaggcaagtctggcctaaatctatgagatatgttaaagatctttctaaatcataaaactattagaataactgggtcaaaagcaaaaaaaaaagttacaattttatgcctctccaattctttatgactatcatgattattttaaatcagtaaaatttctccctaatgccttgtctgggagactggtcaaagtagtttctagttttcacatatcacattaggctcacctgacacaacaacccacatgacctacattgtagccagagttctaaaaaaaaaataatctgagatttttgtaatatctctaaattttaaaacatgggaccatacacatggttttgtttatcaattataggttatatctaacacagtgaagactttgcaagaataatctacagctctcaaaatattcatatatcgattacttttggtatctaagtaaatacaaaggaatggaaagatgttcttcattcattctaagatgattcattccttatcttaacttaggtatgtgccagattttataaaaacatccaaaataacaatcatagaataaaaatgggtgtaaacatagactatttactcccagacctaagctagtgtgactgcttcagtgatgtgtattgaagacccaaatgagcagaccctctgtaaatgcacacttacagaacagatgaggccaaattaaagactaaattataccagtgtccctatattctaacacctgaaagttaaaaacataggaaacaaaggttataagccacataaagctcaagataggtctgcaacacacagttcaaaatgggtctacgttaccatctacgtcaaaatggctgaatgttctaaatgagattgtagtaggattccatttattttcttctaagctatttgaaaagaggtttaatcagttgtctgaaccattgccaattttgagctctgctctagaatctgaactgaaactctcaatcaacacatccttgactactatataatgaatgcaaagattcagatgaattttttaaaaatatcattatatttaatctaataaaatttaaactgtttagaatccatgttttttctaaagtaatttaatctgggattatttagaacaaaaactctgggattatttagaacaaaaaaaatcatgtttatgatttgagtcttccaaatcaaagccctgggaaacatatcatttcagtattaaaaggaatatcttgtgcaataatgaagactgaaagtctcctcaatctttgaaacctccttcggccttttcagagagccacatcaagcttatgcaacaacaatgatgaactcagattgcaaggctaaggaaacagcacacacgccccttactgctgacctggagacccacactgtgggcgggtcaggatgcaatgcacaccctgcagaacctgctgcaactccaattttgcgacatcagtatcacactcacacacagcacgtgccaggcgttacctttgttaaattgcttagcgctagatactgagaagacagctgcgacactctgtgcctaaagctcttgctggcagcttgtccttcccacagctgctgagctttctctttcagcctgttgagctgaggctcgtagcagtgtatttcctcaaggacagactgaaaagcacaagcaagttactattcagaggctggggaaaagcacatcgcggacgaagctttggcccagagaacatggaaatcaacactggcaggcagtccgtgtaccctggaggctttattatctccaatctacacaccgtggagcacaaatcatggaaggaaacaaatcatacttccaaggaaagtcagaaaacataaaatccaccagaaatggggaaaaacacactatgtctcacggcagcacagtctaactcaagggtgctgagcatgcatctgtaaggtcgacagaggacggacaaagactaggtcagatggggctacggggaggcgggctcatcacctggagcttctgctgctccctcctctttgctggcagatcatagaggcgattgctgctttcatggaccatcttctcagttttactcagccagtcctggataggctcagcacttacttcaaagtccttcatttggatctttagattctgcaaggttttagatagtgtccaggacaagaaaatattttaatagcaagtccaaggtccttcacttggcattcaaagtccacccaggctgggcacagtggctcacgcctgtaatcccagcactttgggtggccgaggtgagcagatagcttgagctcaggagttcaagaccagcctaggcaacatgatgagaccccgtctctactaaaatacaaaaaattagccagccatggtgggatgtgcctgtaatctcagctactcaggagtctgaggtaggagaattgcttgaatccaggaggcagaggttgcagtgaactgagatcatgccactgcactccagcctgggtgacagagggtgactctgtctcaaaaaaaaaaaaaaaaaaaaaaaaaattccacaaaaaaaaaaccaagcccgctccaaagtctgaaacactccatcttttaccttggcacaaacacaatttttgaatatcctttaagaactttttagggttctccttttgaaaatagaatttttcccccctaactctctggcccacttctgagatcacacccatttctcaacttctagagcatttgttgtctataccatgcctatatacttcatcatagactaggttggattgtgaattttcatctgacacaggtgtgccttgtctccagaactagactgcaagctccatgaggggagggcctgggtctgacacttccggagacacaccatagtaccttacaggaatgtaaagaaatgttagtcaacatttggttgattttcattaatgagggtacaagaagtagcatatccatgtagtttatgtgattatgttgttaataaataatttattctgatttatcaagtgataagaaatactaaataatgttatgtgcttatcacataagaatgtcataatactttcacagttactatgtagtaccctaggtgtaaaatgtgtttgataaagttttatatggtactgtctaactttagcaaaggtgtctgcatctactgtctcttacttataaagtggtaggtggacgtgaatgtgaatttgttatttatgttaccctgtgagtcaactaaaggctgtaaaaacaaccagtactttaggtagtattgtccaagagggagtacataaaggttagctgaagaatctaagtggcaagagctaatgaaacttatgagagaatagttcaaggttccacctgtatctggtctgggtcgtctacaatatggggaaaatcacatctgccttactcacctctgagggatatgggttagctgtaagaatcatttgaaaagttagtatctcacaaatgtaaaataccaaaataacttctggagtattctaccaaaatttaggttgcatgaaggcagggacttggttctgttttattctctgctatagccccagagcctagactagtccttcacaaatagaagatgctcaacaaatatttgttgaataattaaattcataaattcaaggtgtttccatcttcctgttactagagcctcatggggccacttgatatggtttggctgtgtccccccccaaatctcatcttgaattgtagttcccataatccccatgtgtcttgggagggacccaatgggaggtaattgaatcatgggggtggttacccccatgttgctgttctcatgatagtgagttctcatgagatctgacagttttataatggacttttcccgctttggctcatacttctccttcctgccaccatatgaagaaggatgtatttgcttccccttctgccatgattgtaaatttcctgaggcctccccagccctgcagaattgtgagtcaattcaacctctctcctttataaattacccagtcttgggtctgtccttataacatcgtgagaatgaactaatacaccacaaaacagggcaaatgggggaccatgatcaggaatttaggttctaaaaagaaaggagatgagaggggaggggaggagaggagaggggaaagggaggggaggagaggggagaggaggggagggcaaggggaagaggaaggcagagagagaggggaggggaagggggagggggaggagaggggaaggggttggggaagggacgggtagggagagagggaggggagaggaggggaagggaagggggaagggaggagaggggaggggaaggcagggaagggaaaggaaaggataagaaaggacaggaaaggacaggacaggacaggacaggaaaggaaaggaaaggaaaggaaaggaaaggaaaggaaaggaaaggaaaggaaaggaaaggaaaggaaaggaaaggacaggacaggacaggaaaggaaaggaaaggaaaggaaaggaaaagaagagaaaggaagggaaaaaggaaaggaaagaatcaagtaaaacagatagatacctattctgaggggaacagcagattaagaaaacaggcaattcatgacctactcacctactcttgggcatctcttgaactagataaccttgtaatcaatgctaaatatgctacactcagcagctgatgcttcagagctcagaccacatagcattaacgatccctgaaggattaaagaaacatttctaggcacaatggttatcactctgttaaatggaggatgctggccacgaaaaaacagtcaccattacaaaacagagatcaatggtcttggatcaggaaataattgaggaaatacacattttctcttactgaatattatttctctatcattatctttttccaaccttcattaataatggtcacaaacaaatgaaggatctattctgccaaaaagtgttttaaaaggaaaagataccctctatgcctctaaattttcctctgaaagaagagtcgatacataaaatagatagtctcagacggaaaaaaaataattatattgtggcagtaattattttatggttataatagattcatcttctattgtgtgtggagaaaataaaattatataaacattgtttctgcatacttaatgcctaaaaacctactacctggtatttgcattagttataatatacactctcatctgcagcattttgcagcttatgtagatattcctgatcattctcctagaccaccttccagaaatgagacagttcacatgaaaggctaagtgttctgctgaaatgtaaaactggctgttcctgctgggagagtgcaaggccaagtcagtgacaatagaccctaacatgcaggaagctacttaattcttcagggaggctcccacttctagcattgggctattccttactgttagcccattgtcttcttatgttctgagaggggtaaccaaaatcattgacaagggggctttgatatacagaaactgtgatttcactaacaacaacaacaataacaaataacacagaatgcttccatgtggttggctatatatacctctagagcagattctttttggtggagatttgaatgaaaatttttccaatcttcttttgcagctgtaactttggcctggatccctttcgctttctctttggtcagcagggtactcagaagttcccctttagacagcatcatgtttagcttgtgctgtccattttcactttctgacaaaaactcctataaaagaaaatatagaattagccataatgaaaatattgtgtgttgtttctattttttcttttcttttttttttttgagatggagtctcactctgtcactcaggctggagtgcagtagtgcgatctcggctcactgcagcctccgtcttctgcgttcaagcaattctcctgcctcagcctcccaagtagctgggactacaggtgcatgctgccacacccagataatttttttgtatttttagtaaagacggggtttcaccatgttggccaggatggtcttgatctcctgaccttgtgatctgcccaccttggcatcccaaagtgctgggattacaggcgtgagccaccacacccaccttctattatttcttaataaagtcaaagaaaaggaagtaagctctttttactgtatacgttaaatgacccaggttatcctttaatagtcaagttgcaaactactttatttaccaatctaaattctgacttgtctcaaaaaggtggtgagcaatctcataaaatattaaaaatttgataaaaataatcaggagaagaaatgaagaccaagggaagataagagctgtaaaataaaataaactctggctaagactcgtttacaaaacaaatgccttgtagttccatatagttggtggagctggattatgattttggctctgaggatcctagctgccgaagtgaaagagtaaacacaaccagggacaagactcgcagagcctactggataaaaacacataatctgctcagcagaagcacaattctccctaggaaaagacagcagatgaatttccgtggggaatcttattcaaataaatgctattaaatggagcagattacattattagtagcagcttatataaaaaaataacaagagagtgtttcatagggttgtccttatgaggacaagtcaatgacctagtgccaaagtgtagtttaataaagtgtagctacagtatatacttttcctttcatgtggctagagctcaaagaatagtcttcctctagaaaaatgggtagattctgtattctacagtcgattctcaatattttcaagtgctaaagaagaaattgaaagcacaagctcaaagttatttattctgacaagaaacagaagcatagatattttgtcatagattttgattaaagaaactttgccaggacatttgtcttaatggatggccatccctgtccatggaggcatgctgtggtgggagggtcagagaaaaggccaaaggctatcctctaaaacagtactagccatgtgtggtggctcatgcctgtaatcccagcactttgagaggccgaggcgggcacatcagttgagcccaggacttcgagaccagcctgagcaacatggtgaaaccccttctctaccaaaaatacaaaagttagctgggcgtgttgacgcatgtctgtaatcccagatactcaggaggctgaggcaggaggattgcttgaacgtgggaggcagaggttgcagtgaaccaagatagggccactggactccagcctgggtgacagagtaaacacttttctcaaaaataaataaataaataaataaataaaaagaaaagaaaaatagcactgtgtttctccaatatagaaaaataggtgattgagtttctgcagttctacccaccagcctgaagcaaaacgggaagaattttacattttatttttagtttattattttattttattttattttattttattatttttgagacagagtcttgctctatagcccaggctggagtgcagtggcgcaatcttggctcactgcaatctctgcctcctgggttcaggcaattctcctgtctcagcctcccaagtagataggattacgggcgcctgccaccacgcttggctaatttttgtattttattagtagagacagggtttctccatgttggccaggctggtctcaaactcctgatcttaagtgatccacccactgtggcctcctaaagtgctgggattataggtgtgagccgccgcgcctggcttggaagaattttaaatggagcaaattttcacaggcagagttgtcctgttatattaagttattaaccaagaatttaaaaaggtgaactacatatgaacaatactgtttcagagtctgctcctactagagacacttcaagcacgagtgcttacacacagtgttctacatacctgtgccctctgaaagaaactcaaatttcataaccaatcactcagaactgctgctatgtgaaatgagcggacatacaggtacgaaaagcaatttcaataactgtgcttaaaaagtgctgctattgaatgaaggtggtatgtgaattagcaccatgaagttacagttaggttaaaaaaaaagactagaaaaataaacccaaatgaacaaacataaaatataaccgcagctctggctatcttaacacaccagctctgtgacctcactgacgcttttaccctattgtacactgacagtaacaaatttacatacctgaaatggttgttgtgaaaattaaatgagaaaatccacttaaagtgctcaggaacaatgcttgtcacatagaaaaaacgttttattatttcctggatcaccattaatatataaaaatagtgtgcatttatataaatgaactggttcctcttcatatacagaagcaattgttttaagtggggatttatttgaaatttgaatttcttacgcaaaacttttatatgttctgcccttctgaaaagatctagagaagcggtccccaacctttttggcaccagggagtggtttcagggaagacaatttttccacagatggggtggggcaggggggatggtttcgggatgaaactgttctacctcagatcatcaggcattagttagattcttagaaggagcacacagcctagttcctctgtgtgcacagttcacaatggggttcaggctcctatgagaatctgatgctaccgctgatctgacaggaggtggagctcaggcagtaacgctcattggcctgctgctcacctcctgctgtgcggcctggttcctaacaggccagggacctgtaccagtccgcggcccaggagatggggacccttgatttagaggttaactttagttcacatcagcactgctactagaattaattgataacacccttacctgtattttctgaagactagttgaaacttcacttatattttgaggtatatcaaaacacttggcggtagtgatttttgcattaaccaaccactgctggaaatccctgaaggcctttcgaaatctttgctgtaaaatctgttctttattctggcagcccttggatgcttgcaaacaaagactgaaaaggtgacgcaaaaatttaatggcaggaaaaagcgataaagttgatgaaaatcatgtttgatagaatcaccagttcttagaatgtgcacttacctcacttagtaatatatttaatgctgaactaatattattttgaaattacaccttaaaataaacttctagcttctaatttgtataaaaatatcttgaacaccaataaggttcatgctcaccaattatactctttaatcaagccagaaacttttccactgtaggtactcaggtctctggaaaatcgacaaagttcattcagctgagacttgagatcctctgttctaggctctgctttttgcaaagcatccagtatctcctgttcagaaataatgagacaaagaagcgagcacttacattgggtgatctccatatcttcacactatacatgcatcaatcatattataaattattagtgagagaagaaccaacatggtagattcaatgaagaaatgaagcctgttttcaggattcctctgacaaataatagcacctggctcatttgtcccttttttcttgccatggatagacactctagcatcaaatactgcaaagtagttaagtgattaagtggtgaaatgacttaaaaataagacaagaaaaagaaaaaatagcctacattgtctataaatagttggactaggccatcaggagatatgtatattgtttaaaggtgaaaacaaattattttaaagaaaagcaacacttattttggattaaatatatatattaagggccgggtgtggtggctcacgcctgtaattccagcactttgggaggccgaggagggtggatcacctgaggtcaggagttcgagaccagcctgaccaacatggtgaaccccatctctactgaaaatacaaaaattagccagttgtggtggtgggcgcctgtaatcccagctacttgggaggctgaggcaggagaatccctagaacctgggaggtggaggttgcagtgagccgagatcgtgccattgcactccagcctgggggacagaacgaaactccgtcttaaaaaaaaaaaaaaaaaaaaaaaaaaaaaaaaatatatatatatatatatatatatatatatatctccaaaattgaatcctgtttcaattgattttatgttgtatatacagttaacttttacattaaaaatttcttataatccatgagtctggtttaaatagtaattcatttatttcatagtttcattcataaagtcatcaaatatttgctaaatgtttaccgtgtgccaagcattttgctggattctgggacccaagtccccccacgaataaaggtaagattcttgttcttgaagagctcacaatttaatagatgagggagacacatgaatagctacattactgtgtacacccaatccaaaataaagccttaggacttgaaaagtacacctctgaaatcgaggccatggtcatctgagttacacaaggtgctttgcactcagagtgttcctctcataggattgtcacaaggaacaaatgaaatcatgaatgtcaaatacttagcacagttcctagcacactaagtgtctaattcataaaatcagaaggagaatgactcccaaatatgtaaacactgtggataacagtagcactgaagcaaaaaaacaaaataaattaaggaggaggggcaaaaagatgagtaactactcaaatagctttgctgtgaccattattgtctgatatttgtcaagagatggcccagatttgtaaagaaaccacatccctcaacaaaccagccctgtgcttcattcctcgtcctggtaaatggcaccactgtcccccgctgatgtcaatcagaagattaagcatcatccgggcctctccctttgtttcctttctcactctatgcaagagatatccaggctagcttattctgtgtcttagctcctttcatcattcccctctttgcctctgcacgttgactttcacagacccacttacatattcattatttcttttgggggtggcactacatcctcctaatctgattcctcctctctaggttcctctcttgtgttttctgattcctcaatgatcctgcatcttgatgctgttcctctacctcacctgtcaggtcacattttaattatacctcaagactcaactcaaataacaactcctttaagtaccccctgccctccttcccacctcttcgggtttctcatctgaggatacacaggaccttgcagacattcatcacaaggagtatccacattggctttatgcttgcgtatctccccacctaggctgtgattatgagagcaggaatgacattctcttggtttgtcaattctttatttaactcggtgtctgggctggaggagtctaagacatttttatttacaaaaattcatcaacaactaaacaatttctctctgaaattccaaacactaaactaggaccaactattttacaccatatggaaccttttacttaagacagaacattgtaagaactaaagaaacttagcattcaacaaaaacataaaaatactggagattcaagtcagttacttatgaatgggatgacattaaaagtgaaaagtttttgaccaaaacgttacatttaaaacatttctataacttcatcctaaagtatgtcagtagagtcaatatataaatatcagcttatgtatttctgattctgttaagttctagaatgcatctttccaccttatacagcttaagaaaattatttccaaagctaatatcccaaaggatattaagataaatgagtttcgcaaacatagtaaatagaattatttttacaatattatattatatactttatagatcatctgtttttatgttttaaagaatttcttgagtattgtcatctaattgcataaaataaatactttaattcttattgtgatcatcaacaatgacaagtcctccctaaaagcaaaacaatgccctaagaaccctagcatatttactattttgttaacattttcttacatattcattgtgatagaaatatctccacttttagataaaatgccattattagaaataaaagaaaacatgaatattgagaagcaatgtagcattgtcatcaaaagcattgaccctggagtcaaatctggaagcagacatacacagagggctgtcacatttgaactatttaacacaactgaaaacccatatttactactgcattctcatgtatatttttataggcctcaaccattatttttactaataatatcaacgtaaaaataatgaacagaatagtaatgtaatctaggcacagccaaatctttcctttttaaaaatttcactctgtgactggaatagaaagaaagggaaagaaaaaggaaccaagaaagtgtaactgattttttcatattataccatgtagagcaattatcaacttctttgtccctctgtgacagaactgatttctatgctttattctggtacataaatctaaaggacaggaaatggaacagaataacaaaaacaaacccccaaacctagaatcattataaatagagtagcataaagaggtagaaagctttattttatggcatgctgcatttgtttcaaatacttgatttaaaaccagacactgctggaaatactacatgactttcttactggcaggagctattttgaaatgattgtaatataaataggagcagagaagtttactaaatttccttttaaggacatccatgaatcagggcattataaaactggaaatattgaaaaggctttcaaagatactgtttaacagtgaaagaaacgaagaagaggttacactcttgctcattcttcggtctcccttgtaggcttccctttctcacattctaaagaagctgccattagcttcaaaaaaaaaaaaaaagtctcgggaaggtgaccagggagggtgacgtagagttctgttaacaggctaattcaagaacagctgtcaaaaccacacagaggagagctaatcggggagataactatttgctgtgctgtaggagattaccaagtgagtcttttaaggctataaattcaatcatttagttgtatgaaatagttaactggcaagaaaacagctatgactctctgtctatttatgcccctgcccacaggccatttttcagactgaatggctgaatacagtattacagactcttacaccataggaatgaaagtaaaatgtctccactaacaacaaatgtttcctaccgcaaataataacccaaatctttatttttacaaaagtttgatatataagaaaaggaaacaaatcagactttgcttatttaatgagataaatacttcttccaagtgtgcatgttgcgtgtttttagttagcaagattttttttttaaggaatgatgaaagtcaaaacattttttaaagcataaccaccaatagaaaacaggaagccaacttacttgtcctttgtgccagcattccactatctcctcatccgtgttcttgccttccaggagggttaactgctgagcccaggttttcagaagggcactgaactgttccagggcctgctccagttgagccacttggcctgagaattcctgctccgaaagggccatctggctgaccaggttctccaaacagctctgcgtttggaatacactgtcttcccactgcttccagtcggcacgcagggcctgcatctccgtgtgcatgagctcacacccactggcagttgtgttctgtttcacttcgggagccagcgactccactctgctgagacggcttgcaccaatctctctggaatctatcagctcctgtaatggaatatcaccatggtaactgaagagcctgtgagtcacttggactgcaagttttcaactgtgtacacagggggaccctgtcctgccaggaagttttaacaagtgtgccacaaggacccagaatcaattcatctgtccactcttaaattataatagcgggagttgtcatcacgagtgcctaaggcttatggcaaaaaaatcccgagaatcctcaatatcctgaaacagactaaacagagaccctgaaatcaggcattattcgcacacgtgaaaatgtttagtgactcaagtgtttgcctgtggtggattgctcctgtgaatgattaaacccatatttccctcaaagtggatgctcaagtaaataaagatcgtggcagaactgtgttctgctcacggtctctatactcaattcatcttcttcaacagggtggtggcttaaatcacacttccattctactaggaatcaagcagactcatcacagcaaaagaatgagccctactcgattccaaatacctcaatactaagtaaacatttttgtagcatataaaatgaataattcattcatagactgacttactcaaaagtttaaagtaacctctagactgagtacatttattagtatttttttaccttaaaaaagtcactagaaatttaacagtttagctatagccaagttaacaatttagctcgatcttaaagcacacaaatactgtaaaggaaaacaagataaaattaaatcacattgttaaattgatataattgcagcatttctgagaatagattctcttactaaaatttttcttggtgaaataatcatccgatgtttatatatttacatatctattgctaaaggcaggattttgttaatattattacaaaattatgactttactaccggattaaatagaaataaaagataatcaggcacaaaaatgttcaagaagaaaatcaatgaccaattagcaagtaaagaaacattggaatgttaagtatgaagcatgcttaataaattatgttaagcataaagtatgtcttaactagtctatataatatagtttgcatctcattaaattaacttgaaataaatatatctgttcataattatatacaatagagccatattttaatatagatcatttgaaagtatttagtattcagttgtgcagtagtctaaattacaatgacatgaaaacccttacacacagcatgatatgtatattcaaccttctcagcagcaggattctaaaaaccatcactgtttattagtgtgtatagtagttatttgatgaagaaaaaaatctaactttttaaccagtgctatgtctaactaatagaccttaatacttgtaattattttgcctttgtgagcaatttcaaatttgaagtttcccaaaatactctcttatgctttatcccaattttccttagcatgaaaatggaacacttcaatatttgcaatcagaaatctagtcattcagaatttgaataaggacatcatcattgtcaagagttttgaaatggcttttgcatatattttcttatcttgtatttacatttttaaacatatgatatacacatacacacatatgtacattcccgccctcacacccatatacattttgctttagagttgccttttctcagtgattattcctgtggatgtgataggtatggtgttgaaggacagaggaggtgctttatgtatttcctccaaggtttttaaaaccacccacacactaacctacattcaggctggacctgaacttctgagaggcagtttctgatagtcttcactttctccatcccaatttctttctgccaattccttctcccatattccttgtctttatggaagcactttataaaggctttctcaataaaaaagagtatttgtcaacccaggaagcagcctttgtgaaagaattatcttactttctcttatttattaactttttgaaacattagtccatttctgctatctcctcttcctcacttgccatttactcctaaatccatgtaacctggtttctcaccttcccttgctgtgcaaatgtttctcagactggttgcccaacagcctcattgtcaaacctagttgggattctttagtattcctcctaatggcagcctcctgctgtacctgtgatggcgaccaccttctctacttagagcctcagtggcatcacaccctcctactcttccccttcttgtttttcccctcctttttctctctacctttcaaatcattttctcctatggctcattaaatattggtagtacccagcttttggtcctgtgcccattgttctatttgctctatacataggtcttggttttatctgttttagtggctttaacaacaaattagacactaatcactttcaactccatgtcttctatccgtcttcttaacctgaaattcagtcttgaatttacaactgcccccaagacattactactacctggcagttcaaactggatctgatcatcaatgaacagctcatgtcttcacctctatcaccaggctcctccgcatgcaattattttcctcaggtggtaatagtcctgtggattctaggcaaagacttgaccatcatccttgactcttcccaccttgtcatgctatagcccattaatcaatcatttaccaaatccactggattttcttattgggtgtgttctatgtgccaggcatgatgctacaggttttatgtgtatgatctaatttgcttgtcaaaacaactttatcagacaggtactattttcatgtatgtattttttaaccaattgagaggtggaggcttgaggacatcaggtaacttgctgacagacacggctagaaagccaatagaaggaggatgtggcattgggtttctttgattccagagcctgaactctaatagtacagtaagctctcattacattttttgtattattttataaagaccagtttgtggatcgctgttcctcactagactgcaagttccttagggaatgcacagtcctggctgaataaatggatagatgggtagatggatagatggaaggatggatgaataaatcagaatattacgaagaaatgtatcaaagaagaattttaaagaataacacacaaaaaaaggacttaaaaagtggttttatgtgattatctcagttaaaacatacatagtcataagatttaaataagataatacttttaaagcacttagaagcagatcttcagggaccgggcaccatggctcatgcctgtaattccagcactttgggaggccaaggcaggctgatcacctgaggtcaggagtttgagatcagcctggccaacatggtgaagccccgtctctactaaaataaatacaaaagttagccagacgtggtggtcagcacctgtaatcgcagctactcgggaggctgaggcagggagaatcacttgaacccaggaggcagaggttgcagtgagccaagatcgtgccactgcactccagcctgggtgacagagcaagactccatttcaaaaaaaaaaaaaaatagatctgcaaaatgtggttacaattgtaaccatcagctataatttttatgacttttatgttctgatcttggaatcaaaacacaatctgagttttaaattcctggccacaattacactatttattcctaacatttcctcctctaaaactaaaccactgaggatttcattgctccttcattttaatgttaaaatccattttccatgggggaaaatgattacaatttaatatttaagcaactagaaatttactaaaagataccagagtctgaaactcccccagaaaggtaaatttctgttttagaaattgtccttatgcagagtaaacgagatgataattttaaggtcctttgaagtactcccttctattatgttgttggatgtcgtctagaaaagcagaacaaaacatccagaatgacattttcaggttattgttagaatacatttaactaagttactatataaacttttcttctatggtgctaaacaatagtatctggttttgtcagcccaccaaattagccatttcctagcctgtcatattacggcaacaagcacatttgcatacagaaatgtaaagacaatgttacattgtgctcataagtgtaaagtcttttgaattcttctcatgactcttgtttatgtgtagaatcagtgaggcatcaaatagaaaacaggaaggaaacattttaaataacagaatcttatctacaaaatctttatcaaaagtactcaagaaggaatgaagcaatgtagatatagcatctgttcatttcctgaccttaatttttgataactttttctgggtggctgatgaatctccagacatatctgaccaccggtgaagttcttcctttgctgaatggagccaatctgtgaactcgtggaccgcatctaaatacattagatgatctttcacaatctcttccactttcctcattttttcctagtaaacaaagaaaagactaccttaacagtggtccttttgagaacatgaactcaggtaagacaacaggcctgatagaggtctcttaacacatctcagaaaatttcattcttgttcttgaattttctctgagtttaatatcttaagaagaaactatcaaatttaactaaatgtcaaggctttggaaaagcaactattttcctgtaagtttactattttctaccttagtatggaaatcatgcttaattcatgttggctaacatccctcactaaaaatcctcttaataattattatcataaccattctaattaaagcaattatttgttagcttggtgtacagcagtctgttcagcactttaaatgcatttggtcatttaatcttcataacagtcctgtgaggaagatactattattattattatcttataggaaaagacactcaagcttagagaggttaggtaatgggtaattgtggccagtcacacattcaaaagtgtcaaagccagaattcaaacttaacgtctttttgacttgagtcatagctcttaatcattaacaagatgaaaacgaagataaacaagcacatctattaataatcataatgtcaagaagaaaagagtcagttcccaagaaggcaaaccaaagaaaagaaaaagcagcaaacaacaacaactctctcccttaatttctataatatttacaaatatgccaaagaataatcatgaaggaaatgaaagattcatatagagaattggaaagatatttttgatattatataaaggagtttatactttggaaaatagaaaccgtttttactaagatgagagatgaacacaatatttcgtacacgactgaatcttgacggtaaatagacttgcatttaatataacaaatataagtgtagcaaaagaaaaacaactttaacggcgacatttgatgtgcaaagtagagagattaactaaaaaagcggagaaagagaaaaataagcaataaagaataatcccaagattgtagaaagagaaaaatgaataggcattcatagtaagaaatgatctttatgtcatacccatttactgaatgtacaaatagttttagagcagccaattctccaacaatttaatccacagtttcttctttacctgaccttggcaacagtcattatattattaatataaatcaatatattgtattaatgtattataaagcatctactttcaatataaagcactaaccttggcaacagtcattatatcattaaactgtgttttcagctcctcttgagctgtgtccttgaaagactcatcctctgtcttttcgtagagctccctggacttcgcaattagacggtgaagggctctcgtgtgatcttctgcctcagacaggatggactggaggtggtcaagcaggacgaacttctctttcagacctggctgtggttgtaagggatgttctattttttgatccactgattccatccactgctccaactggtttttcctctctacatagtcattccattggctaatcacagactctaaagtgctagaattaatgtcacatattaacaaaaatgaattattttgacatctctactgaaaaccaatcacaaagtcgtgacatccatgccaattgttttattgaatgctactggaagtgatgaaaatgttgcttttgagtgcagggagaaacactacttctctgatccataagatccttaccacaggtcctttgaacaaagtcaatctatattaaaacatgaaataagaagttgtggtcatacatgcatctggaatttgtcttccaaatgctaactattctaaatgagcaatatacatttatatgttatgttgtttaaaatcagcatgggaacatcaatgaaattttatttcatatagatcagttcttaattttcttggaattatcaatagtttatcttattaaaatcagatggtgattatttgttgactggaattcaaaattcaaggtatccttcctgagtaaatgatctatcattaggttgattttcatttggggacacacacacacacacaatatacagtgcttttgtgtcgaatgtgtgaatgaatgctcaagtatttataagaaaaatagtcacaaatataatagctttctccatagtcaaaccaaacgctctccagactggcatttaagaaaaatccctccattattaagcattacaaactattctaaactcatctgcagtgatttccccagctccccctgcatacaagcctatgagtctgaaattaaaatcctgtggtaaatgaacttccagtatttgctcaaactgttgcttttgcatctttgcatccattgatccattggaacctcatcatgcaggctttacagtcctacctgttcctcaaataattttctaaaaagcaccccccgccttttttttttttgacagggtcttactctgtcaccaaggctgtagtgctgtggtgcaatcatatagctcattgcaatctctgtgtcctctgatcaggtgatcctcccacctcagcctcccgagtagctgggactgcaagtgtgtgccaccacgcctggctaatttttatattttgtttctctttctttgaattttgactgtgacttcagataatttttgcatattttgtagaggcatagttttgccccgttgcccagagtagtttcaaactcctaggcttaagcaatctgcctaacttggcctcccaaagtgctgggattacaggcatgagccaagactctgcattcttctacaactccacaatgtgttttgaaaatggttagtaacatagtctgagtcagagtattccaaaatacatcctgtgctggtgtctgagcttttagagggcaaaaacctttctgttttatttcattattttaatgcaataatttgaacattgctatcactcaatatgtcactgtcaaatttaatttcttgctgaaatagtggagtcaaggaccagagtctgcttcctgcatgtaacatcttattctaacatctgaaaaatatctacccatattcctatgaagttttaggaaactggcctaagccaagcctctggaagcttagttcacgctccagcagtctatgatatagagtaagacaatgatagcatctgattttttttctttgctgaccattgtgagttattactaagatgcaaaatcctgctgactttgagagtcactgcctatgctccatattaaatgaaaaaacaacaataataacaacaacaaaaaaaccctccaaattgttagttgtaaccagggatttttgttcacattgccgtggataactgtagtgttatttttgttttgctttgtaatgaacttgaattttctttaaatatttttaaaattttattgtaggttcaaaggtacgtgtgcagagttgctgtataggtaaactcgtgtcatgggggtttgctgcccagatttatttcattgcccatgtactaagcctagcatatgacagttatttttgctgctcctctccctcctcccaccttccaccctcaaggaggcaccagtgtctgttatccccttctttgtatgaactttaatcttctattcatctattttgttatgatcacattgggcacccagtgtgtcaatgatctaacaggatatataaccatcagaatatggctcttttttactgtaattcagactgatggtcatttgtccaacaaatgagccagattatttatggatactctgagaagagggaggtagggagaaatctctcacttataattacaacaaaaacactacctggtataacaatcaaggacttccctgcttcctcatcaacatctggtacagatgattttcaacagaggctctacggctgggctctattctggatggactgactcttggttgtgggagaatgttccacactttgtaggatatgagctctctgtgcctcagtcactaaatgccagggatattccctcgtcactgtgacaatcaaaaccatcctacacatttcctataatgcaaatgggcgtagtatgacttctagttgaggaatagatttacgactaagctcaacagctgccaatagcttaattttccatatgttccttaagctaaaatgtattcaagttattaaagaaccatatattcttgcttggatggcttgaaaggagatgttttgctgagcccatgtcacataagattccagaagagataataggtagatttaaatatttaaaaaatgcaagtaagaacacagaaacaaagcaataacaagcaaaaaccagtcatcgccctatggaaaacacaacttagacaaagacaggcatgcctacaagctacagtaaaatgcttgggaattccaccccaggagacctcagtactgctccatcattttactaagtcactgcattggacttaaacaaactctaaaaataggttctgtacctttgagcgtggacggaggagctcatgatgtcagcccacacttctttaagggtctctaactgagtctgaatcaccctctgaccttctttgttgctacttctcaaggcctgttcccccttgccaatggccatattcaacttaacttccccttcacctttcatcaggagaatatcctgggaaggaagaaagaatactcatcagtaggcatgtaaaaaccttcttctattttaaaaaaatggtagttttccataagaattgaagtaggaatactttacttaccttaaaatgaaaacaacaaactctgggccctattgcaatataatattgactcaaaattaggtatctgggagtctaggagtcaaagattaattccaatataaattcttagaaaactaggaccactagcctagaaagtataattttattgacttcagtttcaaagagtgaaaatacattcttttgaaaatgaagacacatctgtctaaaacccagcagtcccctacattaattggctggctaatttctctctttcaaggtcagcttcattggctatagtctgggttggtgatctcctctgagctttcaatatacccttgatggctttaatcatggcccctacacacggactgtattgaaagtaacaatttacagattggtgtcttccctagactgtgaactcctagaaaatgggtcctaacttttatctctatattcccagcaacttgcagagtgcttggagcagagtagatattcagtaacgcttgctgaatatttactaaatcaaatttaaaattatttaaagctattaaaataacattttcctcttacaaaggggaaaaatgatgcctctgtatccttttttgcccaatttctccattttgcccacacaatcctcatttagaggcttacagaacaattaggacacaacacaagcacttgtgaatctaatcaaattagcattcagcagttgtcagtgtctggctggtgtcgcatgtacctgtatttgtgacagccgtttctccagggtgtctttgctcccaagagtgctctctgcacaggccagtctgtcctgaatggccttcacccagaaccacatgctttgcagtgcttcctccagggcttcgtgctcctgaagggccacctggcagctccggagtttctctttggtcattctaagtaggttctggtggcttgtgaggagctgggaacacaggcggccctcctgcccagcaccgtggccttcttcactcagaagctgccctctctgggaaagcttatcaagagactctctgaaaaaaaggaaaaaaaaaaaaaagaaaaaaaattaattctgacatcctggagtgcaggggagtgacaaatgattgttgatattggagcagtaaccagacacaggctcatagctgacatgccttttaaataaagatgctgggaactgacctggttatttcattctcttatgatctctcctaatgttgtcagtacctatcaggggataacattcagtctgtgctgtgcctgcatccaaatagcagtggtggagcctactgtattacttactgtatttccagaaatttaattcagaaaatggtcccagctgcctcttcaggcttctccgtagcatctctgcattcctatttaatggtcagatgaggaaaagctccctgaaattctcaaaacccctgctgtcttgtatctacatggagattcctcctttatgaaaacccttctgctcagcactgttgcattcctagttgcctgttcaaagctcggcgcaggcatcacatccccaggagcatccacaccaattcagggtgggtggggattgtgggacctctttgtgccctctgctccttgtcttgctctatcgccatgtatgccgactatctcaatccaaaagcctttcactttctaaaagctagggccattatattcatcttatgttcccaagacccaacacaatattgtgcagagactaagtgcaaaaaaaaaatgttctttcgaaaagctgttgtaggagcacttatgagctttcttgttatatcttgtgtattgagctcatcttagtttggagccatgttaattagatcaaggggaaaacgtaagcactatgtggcttggttggttttattcccattttatagagttctgaattcttatctgcacatttaccaggaaaaagcccaggatatcagagggtagcatgggatgtcttaacataaactattgtgactactagaaaaagaacacaaagcaaatctctcgtggaaactgaatgtttcaaatttttttggagtggctgttatgcaaatatatcctatgggccaccctgagatctgctaagagttatacaacaagacacctactctgtaacaaacttgcacatcctgcacatgtgccctggaacttataaaataaaataaaataaaaacacctactctaaaagacatttattatacttgttatctgtttggtgagacaagaaggtggcttaagcaatgatttgagttaaataataattcaagaaaagagatttcccttcttactatgagataaattgcttaatgcatgataaaaattcaatgagtcttaagctgaggtacttttatatagggcatttccttaaaatatttcaagtagtgaaatattatggtgaaaagaaatctagaagactgggaggagcaagcagcaagccagtgagagaagtcaggtggccccgtggagaacctgaatgagcagaacagtgtgttaggattgtctgcagaagtggccaggatggagagaaagcacccagaaacaagcacactaagatctcttagcatctggtcctggaatatcagactgaaactgcaagaaggattgcatgcttatcaatgcgaaaaagtcgcaattattagaaaaacaatgaggaacataaaagaccttgaatttggtgttgaagtatatttgggccactttctctaacgcagttttggtgtaatgatggcaggagaagcagatacagaggaaggtaatgagcagcctgtagagacgaaataaaagctgagactatggaaaaccatttaaaacatctggaagaagggaagtaggtctgggtgtgttatattgtatctagacacgagtcaacatttaaaaagcaaaatttaagtgcaatgtagttttcagaaagttatatggttgcaatgatgctagtattctgttaattcagcaaacattttctattttctggcactatactagataatgaacagaaatgatatagatcttaagtcactgatcttgagaaactcatagctggaaattggggttcatagagtaaatgaagagcttacactatagtaagggctcatagagatgttccaatgtatttcagggacaatttatagcagtcatcaaactagcataccaacaagtagttatcagcatgggttcttttgtgcatttgtttgtatgtttgtttttcaagacaaggaatactgggcatgtttgactaaaaagaggactcagtggaaacagaaaatgactatgatctgaattctggaatttctttttttatttttattttactttaagttctgggatacatgtgcagaatgtgcaggtttgttacataggtatacaagtgccatggtggtttgctgcacccatcaacctgtcatctacattaggtatttctcttaatgctatccttcccctaagcccccatcccctgacaggtcccgttgtgtgatgttcccctccctgtgtccatgtgttctcattgtttaactcccacttatgagtgagaacatgcggtgtttggttttctgttcctgtattagtttgctgagaatgatggtttccagcttcatctatgtccctgcaaaggacatgaaactcatcctttttatggctgcatagtattccatggtgtatttgtgccacattttctttatccagtctatcactgatgggcatttgggttggttccaagtctttgctattgtgaacagtgctgcagtaaacatacatgtgcatgtgtctttatagtagaatgatttctaatatgattgtttctgacttatttgataaagtagagtgggtgctatcctcttctgcttcttatgtagatgcactggctctttaagaggacaggtaatgagcccaaggagccaaagccaagctgcacttccctgtggaaagtatcctatcttccaaaggagagcaagcaaatgaaaatgccaggggtggagcacaaatttgggagcaaagccctcaatgtagggtcaaaagcacagatcagggaactttgcctgggaaaggagccagaaacgttttctcagtgggaagcaatgaagaaataaatactgtagttgggaacagggaccacaaagaaagtcagacttgaccataccttttactttattaagattacaaggatgggtgggtgggaaatggaactggaagctgaaatgtgtgaataacatatggaaattgacatatacagtactcttttttttttctttttcctttttttttttttttgagatggagtctcactctgtcacccaggctggagtgcagtggcatgatctcggctcactgcaacctttgcctcccggattcaagcaattctgcctcagcctcccgggtagctggaattacaggtgccctccaccacgcccagctaatttttgtatttttagtagagacagggtttcaccatgttggccaggctggtctcgaacttctgacctcaggtgatctgcctgcctcggcctcccaaagtgctgggattataggcgtgagccaccgcacctggcaagcactctttttttcttttttttatctttacagtcactgtgaatttgtggttttctttccttcatatcagcttcacattatgttaattgatcctcaaaataacctcagagaggaaagtacagtattattaacacaatgtttaaaggctaaaatcaagagcaacaggagataagtgacctgcccaatttcttgaacaaacaggaggtggatctggaatgcagatgagcttcttacttccatcctgcactctcaccagaatactgcactgctgcaaagagtgcagcatagtcctctgtattccagacattcaaggacagcacaaaccactacccacaaaccaactaactaaccaatcaaaaccaaaccaaccaaccaaccaactagtctaaaacatggtaagaggtaaaggacctgttccatttctggaccataccttgcagccagcagttctcccaaaaacatttcaactttatgaacttcatttttcttctcaggaatgtgctgtttactctctcccaagttttccgtattgaacctttcttccatttcatggatccataagttcagttttctgtgctgatcttcaaagctaagggaaagaaaatgccttagagaaattcttacatgcttgttatgataaattacttttaatagctgaggtcacaatgtcttttaaatggcaattaagacctcatgaatgttcaagtgacaaaaacaaaacaaaacttaacaactaacccacccaaattatcacttattttaataacaaagtgaaaatcatgacaatttcttttgagatccaagcaggaaaagaatcatctcacctagctgaactgatttcatagctggtaattgccaacaagatcacattcccacgtcaatgagcacttaattttgtgtcttactacgaagacccctgaattggggccaatggatatgaattgatttcatagctggtaattgccaacaagattacattctcatgtcaatgtgcactttaattttgtgacttactacaaagacccttgagttggggccagtgaataagtagggcagtggagtccctgggaagagaagggaaagtggcctctgtgtctttgtttcttaagggattttcaaatatatctcaagagctctaagttttggaaacaatgtaagctctccaagaaagctgggcaagagtcaggcaaattattctgccatcagaaagacaatttgattctactgacatcttttctcaccctagtcataggtggctctttctccccttctaatcgtatattcaccatatattacttattggaatctagatccacagaattcaatcattgttttctgctatgactctatcccaaatgaagtggatacaaggaaaaaccttgtataatctaaaaattgaggtgtcagaactttatatattggtgaaccaaataaaaattatatgcatttatataattttcagttactagtaaatatagtttgttttctctatattaaaaaaagccaagtcataacttcagagtccgaaaaattgattattgccctagtatcacctgtatttatgatcaaagcttattataatttaaactcacagtgtcaaacgttatttatttattcacatgactcttttctctaagcctttaaaaacacacttggtgtatgatgaaatctatgtttgttaaactaacctaccttccaagttctgaagcacagtcttgaagagcctgcttatctttaaggcattgtttcagaaatgcttgaaactcttcattggcctttgtgatttgttcttgaatgctactgacaatttgtttagacaaatgtgcatacaaagtttgtccttcttgagtcactgcatcaagtttgctctgcccatcactgactgagtccaaaatgttctgtttcaggaaataaaggtaataggtccatgggactatgcattacaattgtgagctgaagtagtaaagcaggagaagaaaaacagagtccaaaggaaaatggcttaacaaggctggagtaaaaatgatgcatacaattgggcacaaccaaggctcctcattgagaatggtgtcagccagccactggaaccactgaggacaaagtgtaaacaaggctgagctggaaccgaggacgttctcaccaaggtcttgttctcagtctctccccattctcactgtcccaacatggtccaggtccaccatctctcagggttcatgtgagatcctctacctggttagctgcctccagcccctcccctgatccaccctgcatgcgaaatcctcaggccctttcttttcctggtctgcatctctttcttggaaaatctatgcttggacagggctttgacaaagcaaaagaattccagagtccaggcctagccctgcctctccccagagctctagagtggtatgtcacctgttactcaggcatttccttgtggcgtttgctacacctcaagcttaaaaggagacaattctacatctgaattctccacacctcctgcaaaaccagcttcctttactataacgatctttctatcgttaacttctaatctaatgaattttcaacatcatttttatcccccattaggccacaaaatcctcatggttctcattagcttttaaaaatgatttattttggccgggcatggtggctcatgtttgtaactagcactttgagaggccaaggcgggtggatcacctgaggtcaggagtttgagaccagcctggcctacatggtgaaacctcgtctctactaaaaatacaaaaattagctgggcatggtggcacacacctgtaatcccagctacttgggaggctgaggcaggagaatcacttgaacccaggaggtggaggttgcagtaagctgaaatcatgccactgcactccagcctgggtgacagagcaagactccatctcaaaaaaaaaaaaaaagaaaaaggttactttttagaatacttaacatagtgctttactcggattagctgcttgacaagcttggccaaaacctaacttgagcctattcttctgtaaatcatttcttaactctacttcaccatggccttctccttcctaagctcatacattttcagtcagtaaaacctataaaacctgtaatatctattattttagtttgaatatctcctatctctaactatagaccataaattactaaaaaacacaaaccatgtcttcttctttttaaaactcctccacaatagtcatataatacagatacaattattatactcttattgttataaaaattaaaactaggtttagtttagaatgaatttcaaagaattgtcaataggctaaaaaaagagaggaaagggatctggaaattctgtagccccaacttgtttctcaacatacttatcatgttgtctatttccttctgactcaatcagcctaattctgttagggacgaggaaaagattggctcagataagatttgggaaatgagataacttaggtctgcctgcaggcacctgagtacattttggggaagaaggaaaaggatgtcagcttctatacctgaagatcatggagctttgcttctagaactttgctgtcaccggtgcgatctgatgattcttttgctgctgcctttgctcccaaaaaccattcttggaattcctgcatagactcttttgaaagaaaaaataaataaataaaaataaaaaatcagaagcaaatccaaaacattgaatgggctcccaggattaccacatgaattatttctggcctttagctcatctcctcttgccttacaaaatattccacaaagaaaataataatatataaagtaatacagtatgatctacagccatgaatgttcatggtagaattgagaagttatctcagaggaaagactaaaaagaaatgtatgttcctggaatgtctaatatcctgttgtgttttctctttgggtcaagaaaaataattaattgcctgaatatgtaaaaagtgcaaggagagaaatgctccagggacattaaagccattttgatggcacagggaggaaccacctcctcttttggggagtcatggtggatccatgtcaggcacagctgtgtggaaagcagaggcagggccacaggatgggcaatttcctggaccctatggctgccctgtttcatggcttctaccaacatctaagtttattgtgtcacttcatcatagcataaaaaatttcagcagttgtttggacagtggctgctggccacttgagcagtggaagtaattttccacacacatgagctatatatagaaaatgcagatgaaattcagaatcatcaagatggtgaactcttgctttcttgggaaaaagaggaaaaagaaagaaaaaattctgcatagggtgagagcctccagcacagcacttctattgctcaaatcgcaaagcacaaacaaatttgaaatgacaccctggaaagtttcctcaaacttttgctggcagtttctaggcagcatttggtttggattctttctcggaaacaaactactcatgctaaggcccctcagaactcaccactgaagtgtttttccagagattcctgcaggctggcctgggttttggagcacaactggctcacggcttcatgtttctttatcagaccagtcattgcacggcccaggctctccaactcagctgagtggtacttgcggcacaagctattgagattttcttgggtagagctgatgttgctttgttgactttgaagttctttttgtatatcctacagaataaaagtatattatgaaggatattcataacttgagagaaatactccatttacttcactatggtactgttttacaatctgaaattgacattgttgaatccactccatggtgtatacattttggtgcgtttttgagtacttgtactagatctgtactgattctttcagaattttgcccagttctccttgggaacaaacagctgttgggaagtagttaggaggtgaggtataatttagcatttcaagcaaactgaataggtccttatagattccagtccatgatcttgggtttagtcaattgattagagaccatcgcagttcacattcttcaatgagacacttgaactttgtttcagagtcacgtgctcaccaaaagcaccagtagttaatttaaaaaaaaaaaaggaaaaaagacctcagtttctagtacagtaaggaaatatgctaaaagagaacaaattgcatttgttgaaaagtcaactcagtgcttgtcctttacagatagctaattaggaatgttatctattaatatggataggaaacatgaaaatgggccaggtgtggtggctcacacctgtaatcccaacactttgggaggctgaggccagtggatcatttgaggtcaggagttcgagaccagcctggccaacatgatgaaacccatctctactaaaaatacaaaacttagctgggcatggtggtgggtgcctgtagttccaactattggggagactgtggtagaagaatcacttcaacctgggaggggaggttgcagtgagcccagattgtgccactgcactccagcctgggtgacagagtgagattccatctcaaaaaataaaaataaaaaaatagaaaacatggaaatagaatgttttctcaacttcttctttttcaaaaaatatacattatctggatgaaagaagtcacagtgaccaataaatataattaagtgatgaaaaactattggatactcaagtttgaaaatttgtggaagtcacatagttcttccagaggctccacccttttataaaaaagaaaaaaaaactttgaacaagcatagactctgagcaggcactacagcaacacatgctttctattttcaaggtattcatttttgatttctgaacacctgcacccagttcttcacgtgttgcttactttgctgtgttcaatgtcataaataagttggtctggtgttcatatgggtaactgagagcagaggttatattttttattatagtcaccacaaaacagaactacaatcaccatttgaatggaagcacttaatgatagtttattacctaccttgacttttttcaatgcttcacaagtctcattttgggcacagttcatcaacgattcttccacttttgtgaaccatgttgttatgtcattaataaacttctccacttgtgtactttgagccgtgaaatccttcagggttccttttgctacttcagttatttctttggcatgctccagtttctgcattaagtctgcttctataaactaaatatcaagcaagatttcatcaatatctctgaagaccagaagaatactcattcagtagaaattctgttcacgtgcagcttaattgtcaaagccacacaagtctcatcatggaagccagctccaatgttaatatgcctttccaagaaggaaaatcagtggacacagttgccaaacacatgaagtgatgggcaaatagaaagaggaaggattgtgttaacactgggtgggagagtggaagctctaactgaggttccagggaagatgtgagagggcattctgaaagtagagctagacctacccagaattcccaggtggtgaccaaaaatctgctcttgattctccctggaaatacccattgtctgctcagatgtaacactatctggggcaaacatcactgtaggattttatcataaaacaattttatttttgtccccactgttgctttaaaatattgagtggggctagttattctcttttccctggatgatatagctgaggagggtcgacttctatggccccctagttagtcaaaggacatatagtcactatacattgaaaaacaatctcaattccacaattcaaacatcctggcctatttggtaatgaaaactttgaacttaacttaaattgaaggcttctattcttacccccacctcagatctgctgggagcaggagaccaacagtgtggaagggagtaaatatctttctttctcttccttcattttatttctattctgccaccctgtgtaaggcttctttctcccataggctcagactggcaggaggcgggtgaggcattctgactcactggatgggcatctgtgccctctaggccaggcaaggtttagcattcattcctcctcccataggccttggtcttgtgtttttctgacttttttcatgcttggacttcccagtgaagttccctagacacgacagtgcgctgttctttggctctttactttctcattcctcagcctggaggcctttctttaacttctcattgctaaggtctgtttatcctccagatagccttcttaggccacctataatatcctcatatggtggtctcttcctttcttttcctctcctggttcatatttgggccagagtgacctctggcatttacctccaactaactttgaggtgcaggaccccacaagccatcatttatcctttggcaaatatagcagcagttagccagcctgtctgtcacttttaggattctttgggggatagagatcagactcccatgcctgccaaatgcaggggacaaatatcctgttcttcaggtggcactgccggaacccttctgccttgaggtaaggtaagccaccccctcacctcttccttgagtatacataggggtgcatgtatgtgcacacgtgtgtgtgtgtgtgagagagagaaagacagagagagagagaaacagagagagagagagagagaaaggaagaaagagaagactagagtacaccaataactctctgaagatcctgctcaactctgtaaaagtccaactgttaaccattgatatccccaacacaggcggcatgcataaggactctttatcttttttgcatatggatagcacctcctttgtgtcttcttacttcacacgaaacttctagcattcctgtgcatgtatatcatccctaatggtactgctgaacaagcagtctcaggtcagagcaaaagcataactgatcaactagattgattgcttagcccaaagtagcaaatcaaagagaaagcacaagaagaagaaaggaaatgtagagaaaatcaacagaagcagcaacacatatggaagctaaagggatgcagcagaaacctgagcctggagccagtggggctgccagccaaaagagacccaccatgctggatgcttccagggcttgggcactgaagtagcccaggtgttctgaccagtgctgatctaccctggcctgcttcatggttcccgtggatttgtgccatctgaagggccgtgaagggaggtttatagtggtgatccctctaaacccagttattcagtaacagcattaggaaaatatcaataagaacatcaacattcataagaagggtttctaggctgggcgcagtggctcacacctgtaatcccagcactttgggaggctgaggcaggcagattgcatgagctcaggagtacaagaccagccttggcaacatggcaaaacctcctgtctacaaaaaatttaaaaaattagcctgccatggtggcacgtgcctgtagtctcagctaccagggaggctgaggtgggagaattgcttgagcttgggaggcagaggttgcagtaagccgagattgcaccactgcactccaccctgggtgacagagtgagaccctgtctcaataaacaaacaaacaaccaacatcaaaaacaccaaaaaaagagggggttctgttcctgtctagacatgaaatggtccatgaggcaacttggctgaaatgcttccgaaattcagtaggcaaaaaaagaactacccttattataatattcgagttggaaatatgctattaatactggctgaaggaatgtggaaatatattaatattttgactcccatgtctgatacaatccacatgtttccttggaattatggtgatgatgataacatcgaggacatataaaggagatatacatatatatgatatatatatatgagatacatatatagatgtatatgagatatatgtatcagatatagatatatacgagatatagatatatgagatatatatatatacacacacacacacacacacagagacagagaaagtctagtatatggtagtaattacaaaatggatggaagtctagtagttattacaaaatgcttacctgaaggtctggcggtgtttctagatttttagttaattctttcagatcattaactttggaatgcagttcttccaatctcaatgctttgtttttaacttcagactgccaaaagggaagaaacataactaatcaaaaacactgacatgctatatttggcatttaataatttcaagaagagctaactttgtcgaaataccccaactttaagccagtgtaaaaaaaaatctgtttcatttttctgagggctgttatgatgtacaaacgtggaaaatgttacaattaatgttcactgggaatgtgaaggagtgtgcagaactttgtttttctccactcctttgtattaggaaaaaaaaacctcctggaaaaaaattaaacactgacccaaagtcttgagtcagtggggattttcaataggctaactgtcatttattcattaactttaatattactggttactatggcagcatgaaactcttgaagaagcatttcaaagcaagtacacatcaggagtgcctagttattatagactatgtgtaatatgaatgaatcgtttcaaataaaaatttaaaggatattaaagcagaaacagattcattacgatattgatacataatattttgcctttttttgcaccaacagtaacataaagaagaggaaagaagatcaaagaattatgaaacaaatgagatgcttgtaaacttcattagttatatgaaaccacaaaggggcatttaataaactattcctctcaaaaatggtattttggtgctttgtggacactagcaaacctcctgatgccttcaattcagaaaggaatttccttactggaagacgtgatgagctgtcagggcctctggctttctccagaagctggccgagcaactgaggaatcttgctacttacctacactcactatactgcagcgggaatggccctgtgggcactgggctgaatctgattcactgattttattagctagtgtgtcacacagacagtgggtaacataaagaacccatctctgtgagtaactgaacctggtcatatctaatgtggctcggaagcatattgaatcattggatttctgaggtcaatagtagttgattactttaacaactccctctcaacctcctacaaagagccctgatttgtagcatttaccaccatggtaagctacaacatgacgtcacagaacatggagttgaagacatacacagcagtacattgttctaaattatttcaaccatgatacaatagatgtcaataactcaaaggcctacgtaacagtagtgatatgtagaagaataatgaaaagtgatatgtttttagttgtcattacctttgaattcaatggaacttattttgtaaatttagttacaatttaagttttaataatggttgtttttaacagtggctcccaaaattcctgaacatttaacaattgacttttgcaagctggtataagctggatccagcacaggtcactttggagctgtaatgttagtttagcaccagagataacagctgaggacactgcggtatccatcacccctgcctgtacttttagtctggataattttttctccttctgattgccctcagagattggaattagataataaaacatttagaatgttctttggatcagagacaaataagttaggtaatgcaattcattcatgtatatttttctggaccaaagtcactatctccttactctatttctctttaccctactccacttttatcatagcccaattactacttgatattttatatataatatatattgtaatataaataatgcaaatcccacgagggtaggactttctgtttttccattatattttcaatgtctaaaacagtgcctgacatatcttaggtgctcattaaaaatttgaagaatgattaacaaatgattgcaagaaataggaataaaaaggtttaaagtgaattggtgactagaactttaaaaggtcagggactctttgtggaagcctgtgaccctccaatctccaattttcttccatttttgaaaaggaagtggaagaaccccactacctggcataataagagcacatggtaaggactcagtgagcagtttgggatttttttgaataaggaaaaatagatactaaacattactaaattacaaacacttccaatttggttttgaagtagaaggatgccatatcccccgaagaatgggaacaattaacttttacttttctactaatgatttaaagagccctaaataagcatagataaaaatgcaaaaaaaaaaaaacccttttattcataacctgttcaaattaaatagcaaaagatagttaagagttctctaatgctcttctatgtctctaaaaagaagaataaggtctggaacagtggctcacacctgtaatcacagcacttcaggaggctgaggtgggcagatcacctgaggtcaagagttcaagaccagcctgaccaacatggtgaaatcccatctctactaaaaatacaaaaattagccaggtctggtggtgcatgcctgtaatcccagctactcaggaggctgaggcaggagaatcgcttgaacccaggaggtggaggttgcagtgagccgagatctggagcaccactgtactccagtctgggtgacagagcaaaactttgcctaaaataataataatataataataaaataaaataaaaaataaaagttaaaagaagaataaacttttaagaaagactttttttttttttcatattctggtcaacaatatgccaccagctgccatatgtcaacacagtcaatttacctcaaattctttaagcagttcttcagctctgaggtggttatccaggttgctgatgttttctgccatctgtggaacgcagttgtttgaccatccctcaatctcatctctagttgacagtacatcatcccaaatggacaggcttactctcagcctatccatgttttcttcaagtttctctgatacctaggagagaaacagaagccatggcattcatagtcagaggcgtaagatgatcatcccccaaccaaagtaccaatgcttcttttatcagaaaagtatattctgacggacaaacagttccacaaaaattattgtaatctaataagtgcacccaactcacgtaaatgctaaccaatacatagattgcttctgtcattgggagagttgtttgaatttctgagacattgcattttcatttgtaaattgggatactaacaacaacaggtccattggaatctactataactcaatataaggttgaattctacaggacaaaggtccatcaagaacagtgttgtatttatttttgaaagcattaacaataagcatttttatttctaatgctgaggtataattagcattaattagattcaaacatatttataacataacgcatatgaaagcaaccaattttgcacattaaaataaaatagtattgcttatcactcttcctataatgatatgcactaaaatcccaaaagctataaataaaacaaaaatagcatgttaaaaaaaataaaagaatgttctttttttttttttttttgagacggaatctcactctgtttcccaggctagagcgcagtggtgcgatctcagctcactgcaacctccgcctcccgggttccagcaattctcccacctcagcctccacagtagctaggattacaggcgctcgccaccacgcccggctaattttttgtatttttagtagagatggggtttcaccatgttagccaggctggtctcgaactcctgacctgaagtgatctgcccacctcggtctcccaaagtgctgcgattacaggtgtgagccaccacgcccagccaaagaatgttcttttaaaagtggaagcatgtagggttttctgcagtccccaaattattttattatattacacaaatatcaaagtctaactggtaaatttagcttaagtaggggaaccactgtacatctgaaactagattttgatagaaggagggcaacagaatcactgaattttttagctggaaggtaatgtaaaatatttatggcttgatatctatatttccagaaaaatcaagtgacttgttctgtggtcacgtagctagtaagtgacagaacaagaactaaaacccaaagatgtaaattacaagtgcaatgttttccaatgcaaaattatagccttattacttaaaattattatatgttatggtgtaatattctatagaatgttcataaattcttcttttttatctataatttcatagtttgggaaagaaaaacattcagagttataacttgttatgactgaggctatcaagtgaaattcccaaaagtctgagaataagtttttacaaagcagatacatattttattatttctaaactttatgtgagcacggtttttcctcagactctcattttgcatttagtactaaatgttaaaagtaaaattcagctgggtgcggtggctcacaaatgtaatcccagcactttgggaggccaaggcaggcagatctcctgagatcaggagttcgagaccagcctgaccaacatggagaaaccccgtctctactaaaaacacaaaattagctgggcatggtggcgcatgcctgtaatcccagctactctcaggggctgaggcaggagaatcgcttgaagccagaaggcagaggttgcggtgagctgagattgcgccattgcactccagcctgggcaacaagagtgaaactctgtctccaaaaaaaaaaaaaaaagtgaaattcacatccttgaataacgctttgtccaaaaatttgattggggaatgtgaatatttaaatagttcacagaatcccaggtgattatcttacatccagccatttgtccacggtgctctccatgtctgttttcaccaagctgaaatcactactgtgaattttcttcagctcagataacaagtgttttcctttgctggtaaagttatccaagtctttctgtttgtaattcattttgttcttggcagtttcatgctgtggataaatgatttcttaattaataaaatagtcagtgataagtcatgagtttaaaaccatttgtctctaagaaatttaattcataattgaccttatgcagaaattagtgatagtgagattaattaactatatgaatatatataacaccattttcttgaattgctagaatcctagaatgtcagcattcctaggggaaaaaaagttgagctcattagcatgaattacccacatctaagtatactgataagaatagtgcagataactgctttatgagtaaaaaccagatctactaaagcagaataccaacataaacacattttgaattttaccttggaaaaagcccatttaagatcctcctgatcttttatggtagttctggttacaatcacactgctggcattttctaagactttagatacagctgatttcaggttctgatattctctcattaagtcaataagtccacagcactgaccctgactgtaatgattaaagaaaatatattatttggtgtcatgtatcaggaaaagggagagttgcctgcaattggacttgatgtttcactacgtaaaggtattaatactcatagacggattcctacatactgtcctcaaactagtgctgctggttaatcctacttactccaatgtctaaaatattctccgtgaatgaggtatgcacgcaaccactgaaacaaaatctatgaactcaatgaccattgaaacaaaatctatgaactcaatgacaaagaagcaatatatgttcttgccaactcaaacttacatagatgagtcatccaaatatatatatttttaattgtctttttccatgttgttttaattatttcataatggcatatgttgtgtgaaagaaaacaacaataaaacaaaacatagcccaaaactaacaaataaaaagattactcaataattaaagtatatatcagattttctcttccatctcaatgtaataaattctcattggatatgactaccctgaagactgtcaaaaggagaagatagctgttgtttataaaaataaggtagtctgcaatcctatcagcctgaatgcactttctctcatttgatcttgtgaaggtaagcagggtccagcctggttagtacttggatgggagaccctctgggaatattggaagctgtaggcttttttttttttttaaacaaacaaacaaacacacacacacacacacaaacaaaaaacagctgggcgccatggatgatgcctgtaatcctagcactttgcgagtgctcaaggcaggctgatcacttgaggccaggagttcgagaccagcctggccaacagggcaaaatattgtctctactaaaaatgcaaaaatcagcctggcttggtggcgcatgcctgtaatcctacttaggaggctaaggcatgagaaaggcttgaactcgggtggtagaggttgcagtgagccaagatcacaccactgtgctccagcctgggcgatagagggagactatctcataaaagaaacaacaacaaaagaataaaatgcctttgagcaagcaagtttacatctagagattttccaaagaaataaaattatgtgcactaagatttaggtaaagtgatattcttcataccattatttgtaataggagaaaatatagaaataaccaaaatgttaaaaacaggtcaataattaaataaatccagatatattcttatgataggacactgtgcaacctctaagaaatcacaatgtaggataatgtttaataatatggaataaagtttgcacaacatgattcaatttaaaatgcctacagaaatagtctacattatataatgtgctccgaattttgtttaataggtctttgtacatgatgtaaaatatatgttgagggtcattttttaaaatgcatatgaatgtccaattgttctagtaccatttattgaaaatattattctttctccaccgaactttctttatatctttgtcaaaacaattgactgtatatgtctgggtctatttctggactgtgttccactcgtttatatgtttatccttcagcctgtaccacactgaaactagctagtataagtcctccaatcctttttcatttgttatttatttatttacttacttatttattttaggtaccagagctgccagcaaagtcctccaattctttttgaaaactgtactggctattctagtaggtcttgtgcttttatgtatacattttaaaatcatcttgtcaatttctacaaaaagtctgtgggcgttttgattgggattgtataaaaagacctcaataacaaaaaaaatcacccaaatcggccaacttgaatatttaaaaagacatacagattgcaaataacttaacaaaatatgttcaacgtcagtcatcagggatatacaaattaaaaacaaaatgtgccaattctgagcacagtgcctatgagttagttagtcctgctccacaaggagcacttaaagtcacacacacacacacacacccccacacacacacacacagagatggctctacacatctagcagaatgtcaaccaagcaaataaacaaaaatgtcacaataccaagtgttagaaattatgtggagcaactggaaatcttacacaagactggtgtgagtgcaaaatggtgcaactacttcgaaaaatagtttggcaggttcttataaagttaaacatatattttgctatacaatccagagtctcacttttagattatttacccaaatgaaataaaaacttacgtacatgcaaaaacttgaatgtgaatgtttataaatactttatttataatcatccaaactggaaagaacccaattgtccatcaactagtaaatgaataaactgtagtacacccattcagtggaatatccagctataaaaaatgaatgaactggatgggtgcggtggctcacacctgtaatcctagcactttgggaggctgaggcaggtggatcatgaggtcaggagatcgagaccatcctggctaacacggtgaaaccccatctctactaaaaatacaaaaaaaaattagctgggtgtggtggcgggcacctgctatcccagctactcgggaggctgaggcaggagaatggcgtgaacctgggaggtggagcttgcagcgagcagagatagcgccaccgcactccagcctgggcgacagagcgagactccgtctcaaaaaaaaaaaaaaaaaatgaatcagctattgacgcacacaatgacatatgttgtgctagataaaagaagccaggtcacattctatgtgattttgtttataaatgattctaagaaaagacaaaactatagatgtggaaaactgcttcctggttgcagggggcctaagggcaaggggaaaagataaggccattttttaggtggtagaactttcactgtgaaatttaatagttacacaactgcataagtttgtcaaaactgatagcattgcgtatgaaaaaaagtaaattttagtgtgtttaaattatacctcaattacaaacaagtacaacaaaacaaaaaaaagtagaaaattaaaagttaaggctgtcatggtagtacttcataactgttgacaactcctgctttaagcattcaatttcacatgtaatttttttttttttttggtgagaaggagtcttgctctgtcttccagcctggaatgctgtggcgcaatcttggctcactgcaacctacacctccagggttcaagtgattctcctgcctcggcctcccaagtagctggcattacaggcaccctctaccacactcggcaaatttttgtatttttagtagagatgggatttcactatttggccaggatggtcttgaactcctgacctcaggtgattcgcctgccttggcctcccaaagtgctgggattacaggcatgagccaccgtgcctggcctataattgttatctcaaagcaaccttctcaataaagttctgtcgaaataagtaaattttcaatgttatgaaagtgacacagaatatctaaaatggtaaaagatatttaactactgatcacatcaacacaaaacaggcaatgtcccaatgtcacataataagtgggaagctaaaaacaagaactgggtgggttttgacttacttttcatgaattagtcttttggtatcatcccaggtgacctctaagcggtttatctccctgtcaacttcaggtgcaaaagctacatctttctgggcaatttgcttggctttgtctttcaaccaacatagttcatgctcgtgagaattcaattcatcttctagctgattaaacactcttaacctgtgaattaaaatgttattttcctattaatttactaaaggtagtaaatgaatatttcttctccgtaagtatatgatgagtccataaagcactcatttagacagctagaaaaacttttaacacagaaattaaattaatgtttatcaatggaaaaagtacttttaaagttaattttgcaaaataactcagactgtacctcagaaaacattgaaagtcattcttactactcaccatcaaccttctattaagtttgtattttctttctactttgctttgatggtagaagattttcaaaactaaggctgatctcataggctaactaggtaaatacttattgtaaaatctttggtaagaaatgtttctgggccatgaggttcaatccatgtaaataatagtgtttaaggattacagttgtttcattcaatatcaaattagctttactgagctctgcagaatatatatatatatatatatatactttttttttttaaacttaaattacctactttgttgaaaagattaccataaggaaatgatcatttttgtccctaatctattagtatctcagcatttataaaaagtggccatatcaccagccacagtggctcatgcccataatctcagcattttgggaggccaaggtgggagaactgcttgagaccaagaattcaagaccaacctgggcaacagagcaagaccctatttctacaaaaaattaaaaaaaaaatttagctggctgtggtggtacatgtgtatagtctcagctatttgggaggctgaggctggaggatcatgtgagcccaaaagtttgaggccgcagtgagccatgattgcaacactgcactctagcctgggtgacagagcacaaccctgtctcaaagaaaaaaaaaagtggccacaaagaggcagccatttactcttcattcttacagtttggtataggactgtagagttcacacaatgagtctacatgctttatcccatttaattcctaaaagatggtggctgggggcaggtgttcttattatccccaccttacaagaagagaagaggttttcccaaggtggcacagtgaagcattagtatggctggaatttaaataagtccattaattcaatacaacattttctgcacccgatgtgtgactttggtgagtgcagtgttgtgggtactgatgtggctcctgagctcaacctgggttttctactctggcaatttgaggatctcctgtctgcttggtctaagaaggccatgacaccctgcagcaccaatgatactgctggcatccagggtgagtgacactaggcaccttgttctctctttattctggaggctattttttcttcccaagtatcattcccttttgtaaatttattcttaaactaatcagataatttattgcctataaagggtataacctcaggagcccagtcccaatattgactccactatcatctgactaaatcctcgacataatggttgattctggttaaaaggaaacaaccagcaatggtctttcaggaacaacataatctttaccaattatgaataccttggcatgaatgcatttcagctgtttctttgcccactgaaaaaaatggaagagcaagtggccctgaaaacaggagtcagaaggttctattaagaagaaaaaaaattgaaaagaaggctacagttttaagaaaacagttacttttcaaatttactaagggaacttatctttgacccgtttgcttctcaaatgaactcacctgacaaaagctcagctttgcttacttaaacccactcctctgcctctccatacctctaagcaaacagttaaaagcagttgtagaaaatgactctgccaagctgattggtttcactttaaatgaacacagagctcaaatgacagttcatcaccttcctaagctcccctctacaagagaactgtttcacaccattttctttcctccaacatctgccctctcctctgaactaatgagcttgcaccagtctctaccaagaggctctcagccaccaaggaggaatttcctcatactttttaccaccaaaactactaggatcactacctttctcttctgccttcattcttgttatagaagatgaatcccttctcccatcagtaaaaaaattgtttaaaaacagataataagatctacatattctttgctcataaactgactttagggaaatccaaagaaattttagtacgtctcaagtgtcaaattagtcgttaatcttatcttcaaagtggtaaaaaaaaaaaaaaaaaaaaaaaaaagaagaggaagaagaaattgctaaatatggtactatcaaccaaaaagtatctgagacaggtctcaatcaatttagaagttgattttgccaaggttaaggacatgcccggaagaaataaatatgaaattacagaaacagtctgtggtttatacctttctccaaagatgattttgagggcttcaacacttaaaggggaaaaatgggctggaggggaaagagacagaataaggttaatccatgtgttgcaagagaaaagaagcaggcagggaatagtcaattacgaattcatctcgtgctcagtaaatcagcactttacctaagacaaggtgaacatagagtagctacctatggaattatttaatcttttctctgtatctatctgtttaggaacaaaaggaaaggcagctgcttgcatgactcaactcagcttaatttctttcttttggcagagtgaattggggtcctgagtttttattttccttgaacagtactaataaagttttgcataaaagttaattccagaacaaatacaaaagaaaagagacaagtggccgtgacagtttcctatttacctctgctgaagagcttggcgggtaggttctttcaatcgctctttgtcagtcctttcttcaatgtcctcaatgcttttcagaagctcctctttctggtcttggaatgcttttttcaacactgccagagcatctgcctcactctgcttggttcccagaaggttctggatcctctctacctctccacagagctgatcagccgtggctctgcaggaagtcctttgctcagagctcccgattttcagatggtattgggctttggaaagaatgccatccagactgacggcagcagattctaatgctttagcattttgaagagcatcattgaggtccttttctatcaaatcagactcgttcttattcatactgttggttgcttccactgtttgcctcagctggcggagaatgccggacagagaggcatggctctggaggaattctgccaaatgggacagggcaagctgccgcctctccacaacctggctggcctcctcaaacagctggaagcagtcctcagcctttccctgcaggaggtggaggtcctcagcacggcccagagaacccaactttgctaagtgaccctgcagactctgcaattcgccctttttgctctctacttctgctgcgtggtcctggaagggaagagagagttattgattcctgagatacactacagtctatggcagaggtattttacaggatttgtgatgtgaagatctattttaggtgccatggatagtatagtacttaaaggtcatctacagtgaatcttagaaaattcacaaaattttctgttttgctgatccacatttgttaaataaaacacaactctgggccaggcgcggtggctcacgcctgtaatcccagcactttgggaggccaaggcgggcagatcacgaggtcaggagatcgaaaccatcctggctaacacggtgaaaccccgtctctactaagagtacaaaaaattatccaggcgtggtggtgggcgcctgtagtcccagctactcgggaggctgaggcaggagaatggcatgaacccgggaggcggagcttgcagtgagccaagattgcaccactgcactccagcctgggaaacagtgtaaaactccgtctcaaacaaacaaacaaacaaacaaacaaacacaactctgttttggaactatgtaattaattctgtgaaaaaaatttctttgtggatagaaattgttagttaaaagaaataaaaacattggaagattcttaaagatgcttacatatattttacattttaattttaacattttaaagatgcatatatgtatacatttatatacaaatatttgtatttagatatctcatatttttaatatttcaactttaaaaattttaaattttagaagatgcatgtatgtgaaaaaattttaaatttaaaaatttaaaagatgtatatgtgtatacatataaatctttaaaaatctaaatgtttaatttttttaactaacaatttctatccacaaaatccatgaagaaatctttttccattaaattagttccaaatccgagttgtattttatgcaagacttctgtataggaaatttgactagctcacaataaatcatgtttaaaatctagcagaaaattggcaacattctcagtggtttccattaaatagaaattatcacctatcttaatcttgacaacaatgactttaagattcctctgtttgactactaaacttcagataggttcctcttgactgcagatcctgaccttttcttttttcttagagcatttactttagaaaacttgtaattgtaaatttattctctgcccctttgagatgtaactcttcttaaagctctggccagttttttctacctccgtaatatttttctgaaggacctgggagccatctctttgaaatgtaatcatcagggaagatagctgctctctctcagtctgtttggatggtagagcctaaattcactgagcaccttcccccaagatgtaaaactatctcctgtcctgaaggtaggagaaagttgcttttccctgccacagaaccaattagtcaacccagcaaggagtgaacactcaataaatatgaaatattctattgttaaatgttgctatatgcgtactatgtagcttatctccattatttcaatgctttatgatcaatatcggaatttttgaatgttttctggtgccaggatagatataatgtgttggggagtcagaaaatgataccctaaaatatgtcactttggactttaaactgagagaacctgaggagcagcaaattcagagaagagcttttcctgatgctcccttatctgactaaggaaagttcctccagaagaaatataatcatcaaccagggaggaataactcacaggaaagtcccttaaggtctgacatctcacttggaaagactgttagcacaggctgccatctgtaattctgaggtgtgctacctgagaaactttttctgcataataagacagcctttgttcacagtgcatttcctcccctcaccctcccatagcttgtccctactaccctcctgaagccccagcccctatttctttctgtataacataaaaactttagtcatctggttattcttagagtctcatattttgtgggactcccatacaatatgcacataataaatgtgtttgccatttctcctgttaattggtctattgtcagttcatttcatagactcaaattatttgaacgttcagagagcagaggaaagatcttttcacccctccatatgcataatttataaataagggaaataagctttaaatcattttaaagctgaatagtaattcagaaaaactatatccttaaagtatttgaattcagtattagttttcagttttgaaataaaacaaactgggaagcttaaaaatggacattcttatcactttatcctagcaatcatttgctccactatgaagagaaagtgtcttaagatggttgccaattttatctgaagtggctttatctgcttaattggtctgcataattcattgccttaactcatatgctcaattattaaaacattttcatataaataaaaagttaaattctcaccatttaaacttttttaaaatgttgcatctctttttaattcaagaacttttttatgaagaaattcttcttcaatcttaaaaaaaaaaaaaccactttaccttatgccgagtaagggctacttgatggtccattatgctaatctcagaggtagtttgtaattcactgagaaacagtttaatccagacagaaaaggaaagcagcagctcatcaaattgctggtgttcagcaaccacagactgaagaaaattaatcctatgtagacaaagtattaaagttaaaatgtcccataagtaaacagaaaggattaatgatgtattttgggaattaagcttacccaagggcaaaagcaatgttgtcacacatgaacactctatacctcttgatattttttacttcccaaaccctgctttactcacaatcttccctgtctcagtgaacattgccaccattcaccctgttggtcctatgaggcactcttcatcttgtcctttctttacgagtgcatctaatctatggataccctctcagcataacatatgttccaaaattgaatgaaattcctgtaattctgatgccttagtatatgttatcagtaataattatcattatgttcaattgttgtgtgccacagaagtaaccaaagtttttaatcgtgtctttaaccatggctagcctatgacttttgtcatccatagacaattattattttacttttattcttctcaaaaagtggtttacagtcagctgcaatccaaaatttgctttttctttaaggaaattcatggaaaggactcttgcaagtattctaaaatacagatttctgataactttggagactatactattgaactaagaaaaaacttccatggctaggtgcagtggctcatgcctgtaatcccaacaatttgagaggacaaggcagctggatcacttgaagtcaggagtttgagaccagcctggccaacacagcaaaactccatttctactaaaaatacaaaaattagccaggtgtgctggtgcacacctgtaatcccagctacttaggaggctgaggcatgagaattgcttgaacctaggaggtagaggttcctgtgagctgagatcatgccactgcactccagcctgggtgacagagtgagactctgtctcaaaagaaaaaacttccaggactctaattaaaaatacattcgtgagatttgctaacccaacattaagcagaacaagatttaattacataggactgaactaacagaggcctgaaatactttttttagtggtgttttgtttgaaacattgctgattctttttatgttttcctttccaagtcaagataacttttttttctttgaattgtctatagcttacaacaaattgggcaaactacacttctgtgagcaaaatttgtagtatattttttctctctacttgatttttccagaaattggagactatttgtgagcattcttaatgtatggtaatatagttatttgtataagttcaatatgttttgtcacaggacacaattggaaacattggttattttaccaaggctttgactggaatggcatattttcagatatgatcagactgctttgaggaattcagaaaaactttatagaaccaatgaaaagcccttgggaagattggccttatacttttctatgtgatgcctttataaagttcctgacctgtggtaagtaaagaatgtcactttctgacaggcccaggaatctcaagttatattaggacctttagaagaaaggaattcacccaattcatacagattatctgcaggcacagataaaccttttgtttggttaatgttgagagacttttgaaagtctaatctgagatttcttatgaaaaacgtagcagcaaagccaatttttaaaaagcctgtatggccaatcactaatcttgctgcactttatatggataattaggccaagtataataagactaaaatttatcttgcaaataagttgatcctactgtgatttgtctttggtagaaattgggggctgaagagagaaaaattatgttttaaaaaaaactacagtatgtatgttactagaatctaactttgttcattgtttttgagtttttattatgttcccataatttggactgaatcctgaattgtttcctggccgcaagtttccaaactaaggttttccaaatcttccttccattttccttattttatttatttatttatttatttatttatttatttatttatttattttttggagatggagtttcactcttgttgcccaggctggagtgcaatggcgtgatcttggctcactgcaatctctgcctcccagattcaagagattctcctgcctcagcctcctgtgtagctgggattacaagcacctgccaccacacctggctaatttttgtattattagtagagatggagtttcaccacattggccaggctggtctcaaactcctgacctcaggtgatctgcccacctcggcctcccaaagtgctgggattacaggtgtgagccaccatgctcagccaaaactgctttccttaatgccccacaaactgaagctaggcaactaaactttgggagaaataacagaaacttgtaagtaaacaacctatgtgcctgttgatgtattgacttctcagaaaattcactcgaccattcatctgaactgaactacaatccagaaaaatctgttcagattgctactgcaatctgaagatgcttcacaaactctagaaaaacaagtctatagactactctagatattaaactttgtttttcttctgtttccttagaaatgtctcttattaaagatctgtttgcctgcatcatatgtagaggcccagcccatttgcaatgccactttctggaatgggacacagctatttaactgaactgatctattctcaggactaagagactgactaaagaagacatgcaacaatatatttcagtttgctttttttctgtttatcttaatttgcttttccactcctttgtctatctctatgaaatagcctttttttttctttttattttattgagacaaagtatcactctgttacccaggcttcagtgcagtgctgtgatcacagctccttgtaacttcaaactcctgggctcaagcaatcctcctgcctcagctttctgagcagctgagactacaggtacatgccaccatgcctggatacttttttgaaaaaaatttattgtaaagatggggtcttgctatgttgcccaggctggttttgaactcccagccttgagcaatcccctcaccttggcctcccaaaactctgggattatgggcatgagccatcacacccaatctctatcaaacaaactttaacacaaatctcttcaaaactttccatttagcatttcacattaatacgtgaaatgttttttaagtttcaaaatgggaactgaaggaaatcaaaatattttactccaaaatatatttctttgacaaattctgaaatggccctgcaaagctgtcttttggggaataaacttgcttctgtagatctgtagagaatctgcactaatgcagctagccctgcctttgtccagatctaggaaagatgaactgagagtcaaacaccataaagacctgaaaaagacctttaccatgtattctctttgagggctatacctgtgaggtttcatctacataacaagaccagctttgctagccaagcctcttcctttctccctccaataacctgtcttaacatgaaaacctgttttgggccattttctgagctcacaatctttctgtaacctcaatatggcatatattctgtatgtcaaatgtatggagtttggatctccatcctgaaggctcctgtgtatatacattaaataaatttatatgccttttctattaatctgcctcatgtcagtgattttctaacctctagggggccaagggcctcagccctataatccccccactcctccctccccaccaacacacactatacattgactctgcactcttctctccatttgcactgctctcatcctggtctaaacctcttcagttcttgcctgaccttcaacagcctcctaactggcttcctccctcccacctttgcctacttacaatatactctctagataataagtaaacatgatttcaagtgaacagggcattccctgtccttaaacactaggtggtttcccattgcacttaagaaggcagaaccccaaactccttactgtggtctacaagaaacctcacatcatctacttctctggtctcatctgacacagctctgccccatattcccactgacttcctctctgtctcccaataaaaccaactcattactgccttagagcttttgccatttttgctccctttgcctgtgtgggtctgtttcctgcacagcccacagatcttaatctgatgtcatctccccagagaggtctcgcttgaccaccattctaaagatacaccatcctgcagtccctgccatgctaccctgttttgttgtcttcataatactgaacactgcctgaaatcgtcttgtttgttcacttgcttagttatgtatttattttccgcccagttccttcctcccctctctccacaccatggacctgccttgcttactgctgtatcctcggcacctaaaaaggtgcctgggatatcatcagggaccaatcaatgaattagttaataaataataggtgattggagatcagaatccaaacatattaaaaataatcccttaatcaaaactagtatttattaaaatggtttgtatccaaagttcaactgttaaatcagctttcacattttaatacttataaaatcttctacacattatccttatatgcatacattatattttcaatgccttcacacattggtatcactttaaaagtcccttactttccctctaagggataggcaaagggcagctactgctttgttttacagaaaattgctcacctttcaagaggtggcatcaaatctttccgtaaatttctgaaaccattcaaatgtccctttttttgatcctataatacttcgtgttcacccctcattattcccacactaatctgtcaattatttggggttaggttttgttcatttttatggcttttggtgtctgatatggtaccttgtactcagcaggcacctgatatatatttgttgattgattgaatacaggaataaataaataatagaataaatataagctccatgaaagcaaaggatgaaactctttattgctgctatttccagcacatagaagagtatgctactcattgtggaaagtcaataaatatttgctgaatgaattaattttttaaatggtcagaaaggttaaatgcctaagatcacatgggtgatcaataccaatttaaagagaaaatttgttttctggtatattggaaaggtatagatgccaattgttaatcacctagttaattaagatttaatccatttttgcctccatttatcaataatctcccttgctctctccagaagatctatattaaaatgaaatggactagcatatgtgtataaaatgcctctggttgagaaatgtcatgtgagataaaattttaggtaccatttttttcctatacaaaaacagcttaagcaataaataatacatacattagcaatcctaccgtctttaatctatttcaactggtttaataacttgcccttattttaagactaaattttgtattgggattcatcagaaatgctcagttttgtggaccttgattttcaaaataaaagttttcttcccttctgtagttatcaggtgagtagttgagttaaataaaagtaaacaaaactatgctttcttaatttatatgctcatcatttaaaaacaaatgaacaatattagaagatttatcttttagaaccaaccttttgttaatgatctgtggtaaatctctccatctctcatccaactgctccaaatgtagtttcatcattttcacatcatctttggaggctactgagaacaatgattccttcaattgcaaaagtttgctatagaatgaggcctgggatacaacttcattttgcagtgcctgaaaaatacaagacattacggatctcatcctaacaggactgaaaagtaaggaccatgcggcacaggcggctgttgtccaaaggattcgcattcttgcaaaatgcaagtcattcgggacaggctgaagagagtttttattacttgatttagaaatggatccacttaaccttttaaaggaatttggttcatccacttaacctttaggggaatttggttccattccattaaaggttaagtggatccatttctaaatcaagtaataaaatgcgactaaaacctgaataagttttctggagtctgagttctaagttaggcaaatctagaagctgtagaatttctttcacgatgaagagactgagtaggcaaagagaatcaaagaaaaactattgccggagagactcagtgcacagctaacaataagagagatgcaattctagcctgggacatgttctgcctttctatttagagtctagattaggccaaactggagaacttaagggctcttcattttacttttaagcaacagaactccttcattttaaaaatgtaatcagtcaacgaatctcttaagtgctgtgaggtgcataaaagttgtggctcctacctaacaaaagataaaatataaacactccaatagataggtaataataataaaaaaatattaagtgaaatgataggtatggcacagcagatagtagatacttgtcaaaatgctctccttcccttcctagtgaggccacataggtgatacaagcaagattgctaaagggattagaggaaggaatacacagcctgtggatgacaggtgagatcataaagcagaactgcgacttatgctgggtacaagggaaagaaacagcgcagggtgcagagccaggaggtaggaatgcacaagtcaggtccagcccacgaggcgaggctgccttactgacgcaatgtcaggatgcaggagtaacagagtctgcagtcctctcagtcatatggcacttagtttccacgtggagatgggcagcaacagttttacatgcccatgtagccttgagtcagtgtcttcatttataaggaaaagagctgtgaagtccctcccctctgggaataccccacatgtatttgcaagaagacaggaaccagattgtagatcaggattgccctttatggtcagggcgggaaacagtcagtacaggtttctgagaagggactttgtggaagatgagtgcagacaccagtgtttaataaaccagaaaggcaggagaaccagaagaatggagtaccccccaagtcaaggaaggagaacatttaaaggtggggccacagattccgatgctatagacactggtgacagagttttcagagaagcgattacaaaaggcaaaagaacgtagcttcctcttaaacgtcttataaaagttgatgggagaaagttggagtataaatctgtaatacaataaatcttttttgagaagcaattttgactgttgaattttccagcatagacagtatcatttaaggcaagttattaatctctagaaatcagtaacattgcctttagcttcaattatactcaacgattttctttctttaagtttaaaaaattggcttcttcaagtatgaaataaactttgtctttctacctattacctacatttgtgctcattcatttttttctgtcttccataagaataatcattactgtgacttctttctacattctattacttatttctttaaaagaacaccctttattgcccaaacgtcatataattacaaaagtagagagattatacctatttccagcctcagaaattatgaactgatagccaacctctttcatctatattcctacccatcctttcctcaactcctttgccaaaccatgttattcagatgccgggcattacattacaggattttctaacacatcatggaaattgatcatcacaaagttctcattgttagtttctctccctttcaggtcatggttgctttcttctttttggaacaccctgatgtcaaatgatgcttcaggaatcacaaaaccaaagcaagaagggaggtacaagtttatttattttattattttaaataatgtaactgtaacaaaaagcattttattttttccttcctcacacttccttgaacttgcctgtattaactgaagttcaccttccactttgactctgtctgcagaaatgtccatttctggggaactggctttagcttcaccccgctctaaccaggtcaaaaaggatgatagttctttctctagcctaaaggaagcagagagcagaaacaaatttattgaaaattatcatgctagcagattaaacctttgtgaagttggagggtccaacacaaaccatagtaaatacagcctcagttatctcagtcttagatatgccagcacaaaaatccctccttttattttcatttgtgtccctgcactcacatttatattggataatatgtaaagacccatatatatcctctccactctcaggaatctttgccttataacaaagatcaagagtttcctacagtagacccacaagttcacgtcttttgcatctgggataactactccccatcactttaagaactgctaatccagaatttcctatttagtagtgcagcaactcaaggaaaagtgctgctcacctctgccagtgggccagcagattctccagcgccgtctgtctctccttcgccctccttaggatgtcctcgtattgctgctgtagagccgcagcctcctgaacacaggaatctctgttcacaaccttcctggcactggctgagaaggcagtgatcgcgctgctcagtgactccagggcctggcagagatcctaagaagagtgcgagaagaatgcagtgaaagcacaggagccaacgaggcctgcatttttctttgacaccgatcatcgcaaaatattttccctcagtcataataaacaggaatagcactaagaatgggtacaaatatacagtttgatagaagaaatgagacttagtgttcaatagattagtagggggactataggttacaataatctatcctatatttcaaaatagctagaaaatagtttgaatgtttcttgaataaataaaacacaaatattttaggtgatgaaggtcccaattccactgattttacttttacaaattatatgaatatattaaattatcacatgtgcacccccaaaaacaaataagagttatatctattttaaaaggtctgtgcccatgatttgcagcaagacatagtgaaaatgagaagaaagtgacttcataaatacagaaatcaaaaacgaaaatggagacacttcttcaaataagaatgcactgctatttatctaaaaactttcaactttcccttaacaatttaggtaacttgtgaagattattagtcattttatgctaaatacgtatttaaaaaccctattcttaacttacaaaacccacatgtaacatgctataatcactccaaaaaatacatataaaaagaattatggctgaagaagctactgtctatctcaatagtaataataataataataataataataataataatgacacagtgcctcagaatgtggcaggccctgcattacctgcttcccatgtattgactcttttcatcttcctgagaaccctaagaggtatgttatttcattaccttcattttacagattaggaaatcaagacacagaaaaacaacttgctttaggaaatctaaatatcggaaaagtagaatattagcctctttggtcctccattattaacttagttgtctataaaaataatttcatcacactgaattctcctacttttcctcattttttgtattaagaaattacaaataagtaacgcaaaagtgtattctcattatcaatatttaaacaatagaaatctcactccctcttccagatggcctttgtcaatggcttgttttctattacatacacctttataaatgttcgtgcacacatgaacatgcaatatgaatcatatttgtatttttgtttattaattaatgtacggtagtatttctttgtacgtaattatccccctttgttcctccccctaaattctgccagagccatctgtctgtagccttgcagaagattcgcaatgatgagaaaaaccaatcattggaaacagatcagtgaggatatattccttaaacatctgagtacagtgggttaaaatatgaagacagctatacacatatatttttccttgcacatgtacttttttataatgctggcaagaggtaacagggttgttaaagctaagctctaaaaatgttactcatcctaattaaaagagagaaatgtatttgaaatgaatactcctttaatatacatctttaatgaaaatttattcacatccttacatgtcttggattatataaagtgaatacattagatctatataattactcaactaatataaacatttttccaatttcaattctcttaaaaagtttactgtattttcttttcaagtgggaattatcaaattttaagttggtaaatagtagaaatgttgaagcatactcttaccatatgttcttgaagaactttgtatgtttctgtagctgaagaacatattttaattggaacagcaagtttatcttcaaattcagacacagattgctggatctaaaacattggtgcaatataaaaataacagtgggaaagatacatagcaagacaaaaaaaaaagttactgagaaaatggcatacctaccttttatggataacttttaatgtaattataaaatgcattctttaaacatctaaaatcaacatgtcccattatttcacaaattatgtctttctcttattccactatttgtaaagtatttattgcacttacccacaaatacaatgtgaaatatgtaaacttaagtataggtggatcaattcttacctttctaaggttctcttcaaacttttgctgctgagataaatgtcccaggattgttccttccagacactgtgcatgctctcgaagctcttccccgtatcttcttatttgtgtcaacttggctttaattcgagcagattctccagtggtaacaaactgagcaaaagactgggcttcttcttctaatcctacaatgctgctgagcttactttctatttcctgaattgtgacctaatagttaaaacaagaaaaatgacaatgtaggctgagcaagcttgccttcctgaaatgatacaattatctgcaaagagggaatattttcttaactgatatttgaagacttggatggttagagcgcagctgtgagcaaacaccatgtgtttggggagatgagatatgccgaaaatgtctgcaaaatacagtgatgggttggggggtgcttgctggatagagcatacggagaaatagctactcttgcttgcagtgaagtaagcaaggagatgtccctgggacacttacagtatctctgaaggtacagagaattatgtttacgttatgaattaggcgttttaattaactgagctggggaagcattgtgtttcagtaactcattagaatgctaaatactgacattcacttatttttctaaaattcagttgagtattttatatgttactaaaaggtttaataactgcacacctacctaaaagtagttttcctttttcaaacttatcatctattcttgatgccagtggtttccaaagctagaatgcactaggaccatctggtccctattctccgggattcagacttactaagtctaaggtggggctcaagaattttcatttctaacaaatctccagctgatgctgaggctgctgatccagggacctcattgctatgtacttgacagagaaaagcccacatactgtcatttcaatttatttcaactgggggaagaaaggacattttacatgttaaccaacatctgaaaaatactgataactattaaggaagtgtgtgcatgtgcacatgtgtttatgtgtgtctgtggagtgtctctcacaaacatagaagcttgtttgtatataagaagatgaaaattatttctctgagaaaaagggccaaattattcaatcaaaatacatcaaaaattcagccaagtctctgtttcagattatttaaatggaaaatactattgccctaggaaaaaaataaagttttgacttctgtctagatgagacaccatagtcagaaataatttctgcctagttgaggcaatcagaaataatttacataaatgtcggatatgcatcatttttatttttcatatgaatgaatgaagtggtatatctcatcaatatttgttatttgagcatttatacaggcttcctttgttttgctgttttttaagattatattttttagaaaaattaatcataaattcaaaaaatataggttgtctacaaagcactaataattgttctagttgcttgtaacacatcggtgaaacaaacttagttaagaaccgagctcttagttattagagtaatacttgccatcaacaaattcatatatacgaatcactcaatcatattgttggattgtggtaaaaataaatccatccaggagaagaagatggaagacgaacccagcatatgttcttatcatttatcaattataagttaggaataagaactcagtcatttgaaatggcatgtaataatgaacaaaagtgggcttagtgtatttatcttccaacaaggcaaatgcttcattacttttaatcctaagatcgttttaaaggaaaaatattacaagtgttactatattttaaacctttcctataatgtagtcttatgtttggaaataaaacatgaacctaatagaccaatttccataggacagtgtattccactgtaactttgcttatttctagcaaatatctttttcctggtattcatattcacttacatattttagatagttttaaaaatgccttattggacgtattgaaatgtatttctagtctgataaaataaaaatagacaattgaatatatattttaagaaaacatgtaatctttttttctggagaataacaatgagatgacattagatagttgatatattccagaagctctggaataagggtggaaataatagtaaatgaattatagaaaaaataaatacgttgaaaaatgtgtgttaattttcaaaaggggacatttttgagacaaaactatttaaatgtgctattcttttttcttagaatttagtgaaaatgattaaatgacaacttttaaaaacaattttaacaattaaaaatatttaatgaatattcttccatggcctcacatctatttttcctggtataccaaagaagacatagcagactgtgtatatgaaactccatgtatgcttgattgcaaaagatgtgtgagaagcaaggatgatctgcacagcgggtaatcttatctgagcaacattgcaccctcccaccctccacatggtaacgacttgttctgagccacagtgtgaaatgttccctcaccttggtatttattttactatatttaattgaatgaaatagcagagggttttcccattccaaaaaaaaaaaaagctgaggtagaaaaagtggctgaattttgaaaatgtgtggtataaaattgtataaaagaaagagaaataaacactccaagcccctgtaagcccatttttcttcttgaactgtctgaatgaagtggccaatgatagtctatccacctggtcattttagagctgggagaggtaaggaatcagaggacctctgtccatgctccaaggtcataaatgaaaacatcataaccatggagtagaactgcttcacttaagaaagatgcttttcaaactcctccttgtgattggtgtgggtaagtaccactaatacttgaactagacattgggaatgggattttagagttgtacaggatgaatacatttcatgttgtataatgaaccggcagagcattctattgaggttaattcaaaatcaaggaaaagaattaatgtaaccataaaaatattttaatgatatttcacacaatattaactttgaatgcacaagtcagacaatgtgaatacataattccaactataaatgttgcccagtattaatccagacctcttagcttgataaaatgtatgaatttaattttaatagtcacattgcaatgaaagtcttgtcctgggaccgaacagcatttgatgaaatgtaagaaagtagttcttaaaagctagacatggattataaatataatgtgtgagcaggtcaccttaatttggctgatttgcatgtccatggcagatgacgaagtttccaaggcattgagttctttttctttctcagttatccagacggacagagtctcaaaattactgccaaaatgatcccacttggttttcaccatttccatggttttaatactaaaattaaccaaattaagtaaataaaactcagtattttaatagagaacaacaacacattttccttgaaatcaccaggtgaagagataatgaagacatttgtgaccatttcaaagttgaaactattcacgctaaaaaaaaaattgcacagttgttctgagtagtttatcaggttttcctatcttctctgagaatgaacatttaatgaggcagtatctacactttgagtgaaactgcactttgaacaaaacattgctgggtccaaaggggtttgaatccaggtagaatctaattaaactctgcatgtgaccagttgttgccaggacttatttttataaactatgccagaaaagatttcagtgtacacagcttttcaatagtcctatttccaaagaaatgttcttcttacacttaaaggagagacactgcagtgatgctttctatagaaatacctttataaactgcatcttatcaatcaagacagagctcgtgatctcaatcccatgctgccgggcaagaactgtttctattattagagctaatcctgcgatgtataatctttgtgacttcagccattttcataaatgtcttatggtcctgattccaaaagacatttataaattattgtacatgagcaccctaactacttttagacaacttataggttttatttgtaacaaatctagtgaacagaatttcaactatagatttctaatttgtattagctatgcatgtataaccaggtgactatggctttcagtttagaaaaagactaagaaactaacagtatataattgaactagtaagtccttgggttaaaaaaaaaaaaagtgaaagaatgtccctgtttaccaaaaggcacttgaagacatcaagaaaaatagagtggcatcattgactgtcaaattaaataatattgcagtctcaaatttataccctgaatgtgcctaatgctgtcagcagtacaggtaatgcaagctgtgttatattgcaactttttaaattaaataaaggttaaaatggctattcttaatagaagtaaattcctttctaataaactctgttttactatttccataacttgatagagaatatttaatgtaatataaagtcctcaaaatttcaagtcataatttgttttaaataaaatatgtatcaaattttaaagtttaggcaaatgtaaaatgttaattttaagctgttaatagtattaaaaacacattttacattttaaaacccaccttagaaatgatggcctgtcccttaataataatatgctattatgtatcattgatttgccactaaattatgttaaaaatagaaatgtttagccatattgttttgaataatattggctgtatcctcatatgtttttcccctccaaacttttttgtatattttgggtatataacaggatatcaataggccaagcagtttttttttttcagataaacaaacattaaaagtttaaaaataaaatattttaaagttaatttctggaaagagcatattagtcaggataacttgaataccgaggcactgtaaacaagctccaggagcttcttcaggttggagatatatggtctatgtgatgtgtatttaggcctggaatctacactaacaaaatatctccttttcgctctaaatggtgacagcagaataatatagtaaaaaaattattttaaatattagttctttttcaagattccctctacaatgtacaaaggccacagaatagaatagatatggctttctcatgaacatgatcagtttaagatgcaaaacccacatcctttatattttttgggctctgttatagatattggtttctgtattagcgatactttcttttgaactgtgagttgtttcctcaaaacatgctgaaatacacagacactttgagattttaaaagagtgttttgaatacaaggtacaggaaagattgtatgaaactttatctcagagaagaaagtttaggacttgtcaatcacatactcttcttcaagcgtgtcttctaattttttgacttgttctttgattgacttggcctgctgttgaagcagctgcttattttggggcccaagcggtatctctgaagcttcctttacaaggttctcagcctggactgcaatactttctgtccgtttagaaaactcctagaaaaaatattatgatcattaggtaggcactttatattatttatctctgccctcaaataaagtgcacatattgcatacagaacagatgggtggatgaagacatagagtcatacatgtatggatcttacattgttcttaacaataaatctgacttatttccatatggccaaaatagacactttgctaacagttttttattttatttctttttttttgagatagggtcttgctcttttgcccatgctggaatgcagtggtgcaatcatggctcactgcagcttccaactcctgggtttatatgattttcctacctcaacctcctgagtagctgggaccacaggcaggcactaccacatctggctaattttctgatttttgtacagatgaggtctcactatgttgcccaagctgatcttgaactcctgggctcaagtgatcctccagtcttgacctcccaaaatgctgggatcacaggcaggtgccaccatgcctggctaactttttaattttctatacacaaccagctatttgccttcatagttttccaataatactcacaaaaattgtttctcctttgtttcctggttttgtctcattgtttagaattcttagatccattataataattaatttattcacaaatatgcttacttattacaggccagttcacaaaatcaatagtgattgatcatagacataatagatttctaggccaatgaatagaaacatttatttatttaatgtaatatcttagtcaaaagagactatcaatgatctttggccaggcatgacggctcatgcctttaactccagcattttgggaggctgaggcaggaggatcacttgaggccaggagtttgagactagccttggcaaaatgggaagacctccatctctagggaaaaaaaaaaaagtgaccaggcatgatggtgcatgcctgtagtcctggctactcaggaggctgaggtgagaggagatagaggctgcagtgagcaggcataatggcgccactacattccagcccaggcaacagagcaagaatttgtctcaaagaaaaaagagagagagaagtaatcaagccattttgttaactagttctctgaaaagagctataatctaatcttagtgctgttaaatcttatttattacatacacatgtatcacatgatggaaagagaatataagttttgaaccagtcaagcctgggctagaatccaggatcactagttgtttgactttggtgaattattttcaggctctttcatgtaaaatgcagatgataatccttttcttagaaggttactgttagcattctattagcaatcttacttttaaagtgcctaacactcttggagatactgattattgttttttatgtctctcatacaaacttgaggacaaaatgatttattaagccaatatacttattttaaatattttaaaatagttgaaaatacttattttcaactattttaattgaaaagttgatttagtatgtatgtggctggtaaatattagatgttacctgaattttgtcaagtaattatattgaatgctgaattagaaaaggtaaacccagtaataacctaagtgaagaaaatgtacttggtatctcacttcttctcatgtaagagaatctcacaggaggtttaaattttgatcaactcccttctcctaaatgaataatgtagaaatataagtatttttccaaagtcagcttttcagtaagagcatctcctagaacatagtaccatataagatagagttactaaataatactattatatcttcatgtttaaaagacttaatgttctcatagaaatatcacgagttcggccaacaaatatcagtgttggccaagattgtgccactgcactccagcctaggtgacagagtgagactctgtctcaaaaaagaagaagaaaaaatcaatgttacttcagagaactacgttgcaatttaagagaataaaaatgaataagtacagcttccttatggcatagagatttatagtacactaaaatatggtagttgctaatgtcacaacattaaattctttggataaaagcacccactgttactatatctgacagtcatggtagattcaattgtggagattacaaatcaccacatgatctcttagaatcccatgaatataatcagaagtgaaaaataaagtgttttatttttttctgctagtgtttctcagaacccaggaaaaacatggaaaaagtaatgtttgaaaatgcttatatacattcaattttagagctttttatgtgagctatgtatggaaaaagcataatgcagagaaatcgaaagagcagaatgatggtgataaaaaaacaaaattaaacaaaaacagaataacattgtaaggccttatctctaacttcttagaaaacatatgagtggcaggcagcaggatgcatcaggtaaaaattgactcacattagattgatctgggatgaaacctaggctccaaccttcattagctgagtgacctttggccacatctctctgaattttcctttcttcatcactaaagccatatcttattttcaagattaaacatgacattgctatgaaccctctatcacacacaccagtacacagaggacactcaagtcccttagcataaccattccttagcacaactactcaagggctatcaacttgaataaaggtttgtaataacaaagcaaaatgagcaaagaactacaggagaacaatgattctagattggcagtgagcataggcaattagtaaaatggctctgttttttgaatgaaaaaataacgtagtgactaaagatgtgggctctggaaaaggaccttttggattgaaatcccaacctcactatttagtgatccgcagatcttgagtgagttcatcaccaactttgtgccttatgtgtccttcctcatataacacgattgataatgatacctatttcttaggactgttttgaggattaaaggcgatgataaacatcaaataattaattcggcatattatatgtgtttgataaatgtcacctcatattattacatcaatcccaaagcatagaagaccatggacaaaggagaatttgaataacaagactcaaaagattccatttgtttcaatctacaggtacttaaactgatccaaaggaattagtgcaaatggaatcatagggggtcagaaactctggctggaacgtggtcagaaacatttaggaaattaacccaataaacatctttgtatttataaaaggcacctgatacgtttttaatacacgaaataatttatttattttttaaaatagagatggggtattgctatattgaccaggctggtctcaactcgtggcctcaagcaatcctcccatctcagcctcccaaagttttaggattacaggcatgagccatcgtacccggccaaataatttaaattaaaaattaaaataatgttctatttaaatgactgatgaatatcgtatagacttgaaagagtctgtggtcttagaaaacttcaaaatcctcagtgagtttttaggagaaacaaaaaattagcagtatgggagagagtgaagccttttgcaggtaagaaaacagaaacacaaaggttttcttgctaaaggctagggaagggtgggcacaaggctcttctttctaagacaccggttagttcatttctctactaattcagtctttctataaaccccaaagaggcaccacaggaacttcaatgcttggtacaaattggttggtctgcttagagtgtccaaggtgtttgagcttgtagggttgggttcaccaagtacacctactaaatacggtctgtttgatgccccattggagtctcaaaatcgctacctccaaaatgaagttggtcatcttttcccatgaacaacttctcgttcacatcccccatctcacttccattgtctccgtcagactcaaaacctcaggtatcaacattttcgtcactcactctgtctggttagtttccctatcttcctgtgaactccacatcttttgtatctgtttctgtgtaacacctgccaccccaccgcccttatttatgcccatattaactcccatatgcccatatgcaataacttaaatggatcccatgaccccagtctttcacactttcagtcacttttctacacctgcctaaaaattcatccaaagcccagctctgatcgtgtggcttttccttttaagccttcaacaagtctggctccatgttgcctagaaagtaatgctttaggtcttcaagactctgaaatatgggccaaatttcctttacaaattcatttcccattgttctattttacaacacagaattcctattcagaacacttgtatgctctatgccattccaccttccaaagaatgtctgtattttgctccaaactctactaagttttactgacctttaaggttcagttaaaaaatattattgcctccagatttttttttttttttttttgagatggagtctcactctcttgccaggctggagtgcagtggtgccatctcggctcactgcaacctctgcctcccgggttcaagcgattctcctgcctcagcctcccgagtagctgggactacaggtgtgtgtcaccatggccagctgatttttgtatttttagtagagatggggtttcaccatgttggtcaggatggtttcaatctcttgacctcatgatctgccctcctcagtctcccaaaatgctgggattacaggagttgagtcacagcgcgcggcctgcctccagattttaaaaactctatacacatctattagggaactaaccattttccaatttgataaaaatctttgttttacttcttgatgtttaatcctacttatgttttcattctccaatatgttgaaagaatgggtcatcaataaatagtaagtattgattaaattaacaataacaattaatagtaataatggaggagaaatcattttgtttgttttgctttgttttttctgaatattgggtaccaaggagccataatatacctttgtttgttccagttctgaagataaactttccaaactgctaaaactcaagaagcgttcatgactggaacctgtttgaaaaaggtatcttactactgtttctttgtttgtttcaaatcgctcccattttcttaatgtgacctaaatttgaaaaaataaacaacaaatgggttacaaatgtcacacaatactatcatattttcattcgtttgcaaaactgtcaactttcagcgaattctcatttcaaatttcacacagtcacaatgaatagagatgattctagtatcttctgtaagaatttcttttctctatgttaatgttttcatctacaaaaagagaggacacatggactcagatgatttctgagttttttataatttgtaaagtcttagaaatgtaaagatattacttaaaatgtagataagtgacaaaaaaataaaaaaggcctctcaatctgtctcaaacaagaaaggaagcacagaagaaggtagggagagggacaaggagatgaagagagagcattaagcagttggcaaaaactcagaaacatttttaaaggtaatgtgtcaacatcccaataaagcataaaggtggcataaatgtgtggctgcatggcttcctggaaaagtgaaatggcatgatcaaatttctggattcagaaaagtgtggatgaaatcctggctttattattgatcagtgctgtgtgatacagcacctagtcctcaaactctttcttcttaagcatccacacttgcaaaatgtgcaacttccaatatccatctctaaggctgatgtgatgattaaaagatggttcatgtacagaatttaacacagggctgaaacatcagaggcggtaacaaaggttcgccttggtgttatgaggcacaaccggaagtgaacactgcccagcctctgtttaaatggcccctaacttccggctcctacctggatgcggcgttcctgcctctcccggctgcgctccaggccatccagtgtgctctccagcttccgcagctcctcgtggcctcggtcaggcagccccccttctccctgctgcgcctgcgcgatctgctgctgcacatctctcttctttgctgagatccgctttgtcttttgctagaagcatttattcaacagatggatataaattgtgctctctaaacagctaagtagggacatcaacacccacgcttaacagaagtacagaaaggtgggcccgaaatgtattttaaagctaagattaacagttgaaatggtagtcggttgctatattagtcaaagatgaacattatttataaatattgtatgtttttaatggtaaacaacataaataatttggctttcgtgttttgtgtgcaaatttggagaatatttagcattttgtgcaatactctaggaagagtctggcaaaacaattcatctgacatgattcttcttaaataattattttctgcttaaaaacacaaagtcccaactccaatttttaaaaattatttattttattaaaatgcaaatattaagagatttatggccaggggcggtgcagtggctcacacctgtaatcctagcattttgggaggccaaagctagaggactgtttggggccaaaagcttggaacagtctgggcaacatagcaagaccctgtttctacaaaaatattaaaaaattagccaagtgtggtggtacatgcctgtggtcccagctactcggaaggctgaggtgggagggtcacttgaacccaggagttcgaggctgcagtgaactatgattgtgccactacactccagcctgtgtggcagagtgagacactgtctccaaaaataaatgaataaatatttatttcctaagtatattcggaatggttaatttgctgagattttgtggggggaaattgtcttaaagtaaactttttattgaagtataatcttcaaatagaatagtacataaatctcagatatgcagcttataaattttcacaaagtaaatgcacccatataaaaagtacctggcctaagcattttaaaatattaacataaatatctataatcttaaatttattggacctaaagtaaatggaaacccaaaaaaccatttcacaatgattgagaacaatgtaacaccaaatattaattttttatactcagccattttttagacagagtcttgctctgtcgcccaggctggagtgcagtggggcaatctcggctcattgcaagctccgtctcccgggttcatgccattctcctgcctcagcctcctgagtagctgggaccacaggcgcccaccaccacgctcggctaattttttgtatatttagtagagacggggtttcaccacgttagccaggatggtctcgatctgctgacctcgtgatgcgcccgcctcggcctcccaaagtgctgggattacaggcgtgagccaccgtgcccggcctatactcagcctttttataattattaagtaaatctagaaatcctgaaggctgggattttaaacatacttttaatgcaacttccgtttttatatattacagaatatatatgtatataatacacacacaaacatattatataaattagctaccattttgctactgtgtatcaggttagctagaatttttcattaaaatattttatttgaatcaaatttccatttatattgcgtttaacaaggtatatattccttttatgcaaacatttgtaatgtgcactaccagactatcagaaattaagttgattaaaatagcttcttatcagtatatataccagaatttctttatttctagttctaatctttataagagtgtacactccaggaaggtctagtacttcaagtaagtcatcatttctcaaactaaagtgtgttcagcgttgtaagttgaagagaaagattttaatataatgacaaaagaacagtgatctcaaataggaagcaattggtccatctatgcctttccatctgttttgaaaaggagaatctagcacgttttgtgcagtttttcatagctaaatcaattttctctccacagtattccttgaactttttgatgtcatcaagtcactcggtctggaaatttatgttgcagaatatcctgaaatgtttaatatttaacagagaaagcaaaacccagaagcgccaaattcttttagccattcaactcttccttcccatgccccctcacccactctctcaagccagtggttgtattctttatctctctggttctttcagtagcaaatcaactttacataatcttgttggaagaaagaggcatttttacctggtgatgaagaagtaactgctgtgcttcaaacagattttcagtatccaagatcttctcagcttgttcctggacttctttagagccagaaattaattcttcgagagaatttttgactatttctttgtactggacacagtccccaaaattgcttagcatcttttcaacctatattttcatgaaaaaaaaaaacacgtaaatcatatgctacttgttgaagtttgtataatttttttggtaaggtatgattgacaaataaacattgtacatatttaaggtgtactacgtgactgtgaaatgattctccacatcaggctaattagcctgtcatctcacatatttctccttttgtttttttgtgagaacacttaaggtccactctcgtagcaagtttcaagtatacaataggtaatattaactgcagtcaccaccagaactttttcatcttagaacttaatgtttgtactcttcgatcaaaacccccctgttgaagatcatgtaatcttacatattttaggactgtgcacaaagtctacctcaaccacttgacatataaacacagatctttaacttttattctttctcatattactcagccttattccattatcattaaatttcataatcatttatggggcttgcaggttttattcgatatggtgctctggggcatattaaaaacccattcaacctggtaatcaaggaaggataacaaaactgcatatattatatatatatatattgccttttaggtctctttcattataattgcgtgactaaaacctaattataaaagtgccttacaagaaagtgagtccgtattatttaaaacaaataggaaaacatttgtagagttgaaaaagagaataaaagagtatttgttataaatgtgcttccaatattcctacataaaaataaatataatttacaattttgtagtcatctaatggattctcttccttatcatttccctaaattttgaattttcttgtctaatttctgcttcctctatttcagttttaccaacatcctttgttttcgaagcctatcctttatcttcactaagatcctcctttttacatgttgtcatttgttttccacagaagccttccagtttcttcttcttttatcctatcttttttctttgactctcttctgatctaagtttttccaaggagagcaatctgttctccaaacaagcagcaatgagaccttacgaaaaccacaaactcccaatttcaatataaatcagagcaaatctattgaaataatgactcttcactgtatcttgtgcatccacccacagtctttttttttcttacactggacaattgcaaacacattgtgttcaacattaatttaaatactaaatgaattattatcaaagaaaggggctgaatgtgccacatccatctcttcatacaaatctatctgtaaacaaaatgtgtttttctcctttcctctctttctgctttcactaagtaagtgatcaagtagtggaaaagggtattaatataaattatgcagaagtttaaggcagatgagtgtgtaaaaaattaatgtctgtatgaacattcattagagagagattcttactataagtcctggggcaaaatcatgacagtacttggaagataaagcaaatggccttggtaaatgttagggaaactactgacttctaactttaaagacagtcaattttttttttttttttttttggtgagacaaaatatattacaagcttgtctgtgaataacgacaagtatttgtttgatcttggctcaaagatcaccttcatgtacactaactttttagaatgttgtttttgcttttcctgtcaccaaaagagggaaggaaagagcaaaacaggcaactggctaaatgtggccgttgctttgaaagatggataatcaaaggattgaaataggttatgttccaaaatttgattaatcatagaactattttcaatttgtcaaaaactcatagggaaactctaatttatatataaaaattctcacataaaactaaaatcgtaagcagttcagagtatttttggcttatgtaaattcagcactagagtctcaagcagatttaaatggattaaaaacatgaaggttaacagatgaattgttagatgagaaatctctgtggagaatttcagattttcagaaacagagctttgtggtcattttcttgtaatccattaggccatttttccatgcaagtttctacttaaatgatttcaagaaatactggtaaatatctattctactttacgttcttacattatcttccaaagcacaaacttagatttatataaaaacctggtcagtaaaaatatttttgctgatggtggaagtggccctactggaaatgaagtagatgcgtttgtatattttaatctataaaggaatatagaaaaacattaaaatgcatatcaaagcactaggaagagaatttcactggcctgctgattaaacactgaatattttattattactaagaaccagctattgagcatttactctgtttcaggaactacactatgtgcttaacatacattactgcatttaattcatgatacttctttttagagtgagtatttttaaccctgtgttataaataaggaaatcaagacctagatgttacgtaagttgaaggttacctaggaggtagggtatcacatttaaactctaatcctggatttctttgaccctaagccttattcttagcctccatgatttatcttaagctgaccataaaataacaatgctttttataagagtaaaaacagtggatttgacaagttttatatttcagatataggtcatgaacctgaactaacatttccaataatggcacagaccatacatcaaacatcctcttcatctttcccaacaagcttcatacaaaaaaagcataacaacaattctgtttcaactatggtttctttataaaattacttgctaaactacaaccagaagaaaaagaaccttccagatgcctcactcagaactgtctgtttagagtgtgagtaaatgctgtacctctgacagcagcgtcacaagagccttgaaagagctggataattttgccagctcatctccctgcttttgggcttcattctcagaagaaacttctgtcaaaactttcagcctggatttcagccagctgagggtctcaccccttttggtaacaccatttctgatctcctgaaatgagagaacacttttgatgaacacagtgcaattgtgaaatcataactttccagcaataaaggactcagcctaaaaaggtttgcaggtggagcagaatagagccagacatcattcagcaatacagtgcctgcttagtttactttttgtatgtacttttaacaaaagtccacaagtgcttgaaagaaaactgttgtctattcttgaatcagcttcataattagattggttagatacttatagatatgtccttgatgggaaaaaagatgattctaaaaatactgtagaaaaatatgagacgccacaattggcaactataacatacatacactttgttatctcacttcctttgagctggaaagaagatgatattttgtgaaaaaataatgaaagttctttttttcaaccagctgatttcttttattgaagagtctacttgttgaatattgttatggatgctctaaagatttattttaacttcattaacttacattttctgctgaatttttattagcttttagaagccagtatcccatatagcaagaagtataaatgggagcacagctctaatttaggaagcgaggctttattgataagaaaatgctagaaagactccagggcttcagaccttgaagggctgctgactgagggagtggtgactggagcagcctgtcctccctacagcagttctggggtggctcaagagcaggggtccccaaccagggccactccagggctttgccagggcaaatgcacaccagccaggaaactgttggttccagaccccagtgatctcttcattctaggatgtgaatttttttttgtgcgatgcaagcaaccagtagcaaatgtagatatccttccatatgcataccatgatattgagcaccactagcatttaaggggattgtataatttaattgaaaaagaaatgggccaagggcaatagctcacacctgtaatcccagcactttgggaggccgagcagggcggatcgcttgagcccaggagtttgaaactagcctgagcaacatggcaaaaccctacctctacaaaaaatacaaacattagccaggcatagtggcatgtgactacagtcccagctactcaagaggctgaggtgggaggattgcttaagcccaggaggtcgaggctgaagtgagctatgaaggtgccactgcactccaaacctgggtgacagagaccttgtctcaaaaaacaaacaaacaaacaaacaaacaaacactcaaaggacaggaacagaaaggaaatatattctccccaacagcaactatgtggcaactttgtgatgtgcaagggttaaaaatgttcaaagatgaagactttttacaacattatgtgtctaagagtgagagagtgccatttacagaatgcaaactgtgtttgagcctgaggctctgtggccctggtggggtttttcaggctgtacccacactgatagaggctgaaatgaaccaatccagcttaatgtcacatagaaaggatgcctagagaccttgcccagctccctgatctttctgtgacctgccttttgcatggctgaaaatgtattgtataaaagcatacagtgttcttgttttccatgatgattcttaagtttctactgggttatacgcccatgcatgcaattttccactcaggactccccattagttaaagatgcatttgtggcaccacggagcatgactaaccctcaaagctaccaaggattcaataggaaaaaactctacatgctccacagtaatataaggggacttattttaaagacaattttcaagaacttattttttttccagaaagaaaaaagcagagaaccgttagattctctaacattattcttccactatgagaaattttcctctagcaaataatgaccctgaacttacttcaacggcacgtttaacctctccgtggttggcagtatcgatggcctcacccttgatcccctttaattgtgtctcatttgtagatatccaagatgagaactcagagaatctgaaataacataagcactttcttattaaagggagaacataccagaatgatcagaatatgttttctattttgaattcactcatggaaatttaacaattaagtgattaccaaattgattaataacttttctggaaactattcttttaacatgaagctcatgttaaagggcaggggtggccgcctctatgctcagttactaggggcagggtgatgggggagctcagctaaggaaaaagatgtgttctagggaatgagcacctgaaaagaaggaagggaccacttgaggtctggcctcgtgtgtccccaccagggtgagacacgaacctatagaggaagaagccaccctttagggatatgagattatacagtttggctgtgtcgccacccaaatctcatcttgaattgtagtttccataatccccacatgtcatgagagggacctggggggaggtaattgaatcatgggggcagttaccccgctgctgctgttctcatgatagtgagtgagtgctcacaagatctgatggtttcataaggggcttttcccccttttgctctgcacttccccttcctgccatcatgtgaagaaggacatgtttgcttccccttctggcatgattgtaagtttcctgaggcctccccagccatgctgatctgtgagtcaattaaacctcttttctttataaattacgcagtctcaggtatgtctttattagcaaagtgagaaaggactaatacataaggatattggggagaaagggattggccaactttgcctcaaagagataacatctgggtcacttggaaacaaagtgcctcaccctgattctgactaaaatccattccttttattaaatgaaggatttttgtacgagaacatgagcaagaaatatgaaataagttatttcttgttttgtcatgatctccgaactaacagaattaagtttgactacacccctctctggaggccattctgaggctacctgctagtgtagtccttccacttgtctgggtcttccatgagcttcctgtaggtgctgtcaatggcagctctgagctctttgagagtcacgtgacaggttccaggtgtgtcccttactgggtcccgcactgggagtttcacacagagttcctcgatgagctgtaaccttttctcacagagatgatgaggacctttgtcactgaagaaaacctaatgtgtaataaatgtttttataatccctgtgagaagccacacagtacttctacattttcacagaaaaaccaaaggaagattcccacgcagactaccaaggtagagtaattaagctattatttttcagactcaaaccaaaatattagtaatatcctttatggaacaatgtgacttgacacggctatccacattgtggtgtgggagacgtaccctgtgctctttaattatcttttcactgccttcctggggcatcagcttggtctctcgatccagctcagttctgcattcttctacagaggctaagaacctattcttctccacatcaatcttcagatgaagcaaatgataaggggcttctccttgaagatcctacattccataggaagattcagaaaattaggatgaagttcctgattatgtacattcccaattgaagtggcaaaaaaaaaaacaaaaaccataacatattccttttagggccagtgtgaatgggtcactactttccacacctggtctctctactttgtatttttccaagtaccaggaccacagcaaatcctttcagtctgctgtgggttaggtgtttcctcagtgattacttgatttaattttcacagtagccctgcaccgtatttttttttttttttttttttttttttttggtgagatggagtctcgctctgtcgcccagggtggagtacagtggtgcgatcttggctcactgcaacctccacatcctgggttcaagcgattctcctgtctcagcctcctgagtagctgggactacaggcagcaccaccatgcccagccactttttgtacatttagttgagacagggttttaccaagttggtcaggatggtcttgaactcctgacctaggtgatccacccacctcagattcccaaagtgctgggattataggcgtgagccactaagtctggccagtgctgcacagtattaatgttcttattttacagattacatcattaagtctcaggggtaagtacaaaagctaggattttaccatagatttaaatcataccctttcccctgtatgtgtcccttttgattttgtcaatgaccttgtgaggtaggaggggcagctattatacccacttcaaaaagaaagaacatgaggaaagcttattactgaaaaaaagttttaaaaagaaaagaaaaaaaaaaagaaaacatagcccaggctgctgaccacctgccatatcctcttttccttagatcatacattgagaaacaagcaagcaagcactcaaacactacataacatttcatgttcttttaaatgataaacataagcttcatcattacctttagtcccataattaattttaactaacttctatcctatggcattttaaaggattacctttgaaacagaatactaagatgactgatgagaaaaatgaggtgggcctatggaaagtcccacctagattaaatcctagaggtgtgtgtgtgtgtgtgtaataaaatacaaccttcagttatagtctttattccataatacatttacaatatgatatgcttcaaagacatctaacaaagcttggatttctttaagaatcctttttttaatgaaaaacttgaattttcaaatttagtaatatagcaagtaaaaaggatatttctttaactgtgtttttcttgtgcacagggataattatttagcttatgttactgagatcttaaaaatacacaaagtgagacaacctgatggagagagtttcagctgccaatcttctgaactccaaaactcctccatgtagcgcatgtgaaatatcacctcaaggtagtacacactcacctaaagctagagctgtcttcctcctgtctacctcaaggaagacagccttccatgggtctccactgtgctgcagctacttccagaatctgacatgcagtctgaagtcagcctccatgggacagactcagctcatctcccatggttcttccacagcccatgacacaaaagtcagacggaagcccgcgggcccccgtgtcccgcttcacgctctcctgctttctcccttctgtgctgttgtgtcaccccctgcttactcccatttctgcttcttctgtaaagttctggctcaaaactagttacctgattcgctgttttccaatttccaagtggttccacctccctctttcaaagctttcataaatatatgcacatttggatttatcatatttatacttgtattatttgcaactaattatctcctttactgaactcttaagctcttggggggaagaggggtatgctttgttcatcattgaattcttgactacaaaatgttttcatttatattttttgatcatagctatctcaactagatgataaaatctttggggggcagaaactatacatacatgttttatgatttcagtaggtatacctagcaagatttattcagcagagagaagcttatgaaatgttgctagaataagttaaatgttcttgcaccctggattaaaaaaaaatcaggaaaccaaaaagaatgctcgagtaataggataaaattgatgctgataataaataggaataacacaattctatcatatattatcaggttttatttaagtccagttttttgagtttttaaatgagcgaaatagttacagtgactttccaggaatttctaaatttctcttacatttggaccttaacacgctcaagcttctcccttcattgaggatgcacggtgtctccgtcctgtcctgactcaccttccattgtttgtggagctttcgaacagcttcctgcagcccctgctgctcctgctctggaaggatgtcggtgagttcatcacaagctttcaggaaagcattgagcaccctctgatccagctgactgaaaaactcctgacatggaaggggaaagtgggtaagagtgttggacagacgaaaaggcagcaccaggcacaatcagcctctaagcctccaaacaagcctctcagccagctgctgccctcttgcagacttccaggcacccactattgttttttaaggatgaactatgtgcacctatagttatgaatcagaagccatcatatctgaaattctactagtattttttattttttagaaaaattctttgtgattttcaaatttggtagaatattccaaaaggaatatctcatcttccaaggggagatgccaaaaccttgattctgtagcgatagagcttcggttcccctttggtgaagtcagaagaacagaacagaagccaggactaagcttcataattccacattccccaaccacagtgcttcagggcctgatgcttcatcatgagccattgtcacattcacacatgtgcacacagaagcacacatgtgcacacagaagcacacatgtgcacacagaagcacacatgtgcacacataggcacacatgctagcaccaaattgtgttcttcttcagactcatatggtatttggagatgggaactttggaaggtggttaggttcagatgaggtcatggggatggggtcctcatgataggattagtgcgcttatgaggagggacaccagaaagcttgctagctcactctctctgccatgtgagggcacagggaaaaggtagccatctgcaagccaggaagagggccctccccagaaccctactatactagcacctgatcacagatttcccttctccagaactgtgagaacataagtttctgttgctttagccacccgtctatggcattttgctctggcagtcaagtagataaagacaatacacatgcacatattacatatgactaagtctcacacagtctcaggagtagacatgcagaattattttgtaaaaacggtgattcaaaacaagaagtaccatactgtagaggtgaataaactgaatgagatattttgtgttttgtggtcacagacattaaccctaaatctagtctgcagaatcacaaatacattgcatatatcatttgagagtgtggtttatacaaatagccactgaaatgtcaggaaagataactcaaatacatgttctcagagtgctggttatttccatataccattcatgaacattatgactaatattcccaatattgatattgagatgataaacatgaagatggcttttcatgataaacatgaagatgataaacatgaagatactgggacaagttgtgtatcagccaccagacttcaagtgacacagtatctatactatgatatggtgaatgtataaaatgagcacaaaggacttagctagtcacctcgagttatctgtttaaaagaatctttagttatagaagaatttgcaagctaaataatgaattagtaatttggataacttgaattattctatgactgtctactattctggggacttaggaatggccaatgacaagtcagctcaccaactctcttgaagttctttttgctcaccatatctttgggtctcatacctaaaaagtctctgcttccctgactcatctgcccgctctccttctgtatcagatcagcatgccttttttaagctttcctccaaggttgtttgtccatgtattcaggtcaagtgtcccctaaagggtggactcacagtgtgtctccgcaggagctcctctggatcccccttttcctccaggccctcctgagcaatccgcagtaccttctccaactctgctcgagactcctcaaacttcttcatcaagcgactgttggtttccacatgcttcttccaatctccagttttctttaccatactcttgatgtgaaaaacaatcataatgtgatgctgctttctcattactgaaaggatcattttgttagagggtattattcatttaaaaagcacttggaaaaaagacatttcatcatcatgggaataattaactcttttcaatattaattaatattaggtaaaaaagtaggacaatgattggcttccaaacaccagcaggtaaggcgttttagcaagaccaaaagcacgagtgatggtttcttgtcctcactctgcattttccctggctcacagctctaaagcagggagagcaaattacctgaaaagcaacatgaatatctgcaatctgtctttgtagcctcgtctgatcaaaatgctttaacacgttgctcaaggtcacaaacttttgaacactttgactgcctttctcaataagtgtcaaggttttcttacagttttcttgacaagctaacagttcctataacgaaatgaaaccccacaacaatgttatttacaagacagagtgagagagaaagaaagagagtgaccattacagataataagaacaacattatatagcttttaggcttctaacaccaataagtaaaaccaaaagtatggtggaacatttcaaaagatctcaattttaaacaatcactgaagtcagtgctttcttatataaggcatttaaatgttacaaagagtttttttttttgagatttttaaatacctcatgtacattttattgtcattaagaaaatgatagagcatcaaaagttgtctaggtctgcattcctctagtaagatgataggcctgttgtttattgagagaacaatcatgaaatcaatgaatacatatcaggttttaatgtgactaaacaaattgagcatcaatgcacattcactttgctgaaagagatgcactatatatatatatatagtatatcctaaatttataatatttgaaggtgtacaacctatcagccttattaatgaaatggtagggttcagatcctaataaaaaaaggcagcagaccgatgcacttggggaagacttgcaactgctgcacatctgcaggacaagatgcaatggtgacttacagacacctccacctctgacttgtagcctgcaattgtgattttggcagtagacagcatggaaatcattgagcccagcacaaggcagagggtcattttttggcttgaattacaccatttgcatttcagtatcctcaactgcgttagaaaaatacttcaaactgctcatttggatgccatttttggatatccagatgcaaatatcaagagcatggtttttttgtttgtttgttttgggaaaaacagaataaagacatactttttccttttgaaaacttaggagataaaagggtaatataagtccaaaatgtattattagattttattattaataatgctatgaacattattttaattatggaaagattgtataatgacaacttgtacaaatttagaaatgtaggagatatcaccatgtctaaaaatgaaagataatctctatccaatacaatgagaatgcagtttggtggtataatcattgtggcttcactacagataataataataataatgctatcagtcatatagtgccacttattatatgctagtgacattatggtgtatctaatgtaatatctgcaataagctttacactcaggtattgtagccttcatcttaaagtgaggaagttaaagctaatcaaagcttcctaatttgcaatattagatctaagatctgaatatctgtcagactcatttcagacactctcggctctttctactaatgatgctaccttcctcccatgaacctatgtcaattaatgcagtggcaaaccttttgtacattagtgtctctctcctctgatggacaggttcattataataaaccaaataacccaattaactacaacactcagtaggagactgttatgcatacaatctgtttactaaaaatgagacaaagaaaaatgattatcacatcaaacacatttccagagtttcaaggttgtttaaactgtcatatttcaagaagcaaagtaaagatctcataagtcagaggttatggatactggatgaaaatggaaagcaattgtttttattatatgtatataaatatatatcaaattatctgtctatctatctatctatctgttttcaaagtatcaagaaaagaaggcacgtatgcctttttaagtgaaattaaccatttcgtcaatcagcaaggcagcaggtaatgcctaaagctatgtgtgggaagcaacagtaaatgattctccaaaagaaagtcaatataagaaggaaaatattatatctgtatatataatacaaatatttatatattttatataaatatcctctctgtataagttttatacatataaaatttatatatatttatcttttagttatgtaatgtagagacaggatatttatttaattttcttatagtgtctttctactagcaaacctagggatcacgtttcatgaacaaagcccataaaaagtttaatgtaaataaattcttatctgtatttttaaaaggatagactatatgtggtctattgctagtaggcaggaactctaagaaaagtaaataaatacaaagcagagaaataatagaaagtcctttgattatgggtacccttaatgtttgaagttagagtggcggatttggctccatctctataacacatcccttatttcacagagacattgtgaactttgcactttctgtagttggggctcaggatgcatggcttacgcgtgcacacagcagatgtttataaatgcttgctgagtattgccagatcacaatgttgctccattgatagaaaggggagctgggtgctcaaaacaaaccattttttctaactttgctcaactcagtgaacttactgattcagatgaatgagcctggtttgcacctgagtccagctagaccattccctggaaacaaacagctcacatagcccctgcactgacagtgaatggattttcatctttggacaagacatgtatttttgttttgagttagtagtactattctagaaaaatgtttcttgtcctcactgaatttctattcctgtaagcaacaccctggtcttgttacacatgctttagaataattgtctcctgaaaaggattgttctcacctgatgtttttgtttaaaaagggcactcgattgtgcctcacgctcaagaactgtgataatttcattgattttcccaagtgagtcataaaaggacgtcatctgcttttctaattcctccaacggaatcaacagctgctgagactcataaaggagtggggagtaacattctttgacctttaaaaacataaagacaaaaattccatgaaagaccattaagtgccactagctcagggaacgttcatagctctgaggaacattttctttagtgacatgatcatttggtgcttacaaatatccaaagacatttctttaatgatatttcctctatattgtcaaattttgctgtgaaaaataatagtgctgtaccactgagacaaataaatggctactgagttttctcatgaaaattcatctaaatcgtccatctggatagcactttctcatctaaatgattgtttttagtgagccagatggcatcaaattatacttcataaaccatgcaactcattttcactttggccttgaaatctgacctaagacagtcatgaattattattatattacctagaccaacctgtgtcttccagctttgttttcaagagatcgcctacttgaacccttgactgctgataaacttagaaacctgttgactcactcttcccagacaggcctgtgctttcctgcctcccaccagctccatgctttgctgctccctgcttatcaacatcctactcatccgaagcactaaagtcacaccaatttattcatgaagcttcccatgctaggggagggctctgtagtccaaactgatgcagcccttacctgtcacttgtcttgtaaaacatgttttagtttatagacctgcattgtcttaaagatgaggccactagctcctggaaatcaagagctccaggaggtgtctactcttcatcctccaagaacttcccacctcttctcatactttcagataaccagggaaaggaaattaatcagtatttgttagtaagccattctttgtttttcatatagtataaagacaataatgttctaaccagatgaggcatattccaaaaagtaatccttgaagaaagtgggagagggcaacattttgctctactgttaaacatagaattatgtatgaagaaacgtttttatgttctaggatatactgcctgaagtatacactcatcaaaagaaagttaccatcctgctactgcaacaagactctgatataattaccttgaacaaaaccaagagagtctactaatgtgtatacaaatcagtgtgttttattgatctctcctgggtagaagagaaaacctatcaagatgctgcatctgaaacagtaaaaaggcaaatgacaatttgctttctcaggggttgtcctgaacacctaagcatggctcaggctaagatgtgcaagcccagctatggccctgaaagctgctggggagttatcaaattggaaatgttgacttcaaattgtacttattgtttagcagcttttactagtagccaatattatcattattgcccacaacctttaaattataaataattctaacttgaatgttaaaataaaatgaactgaacataaacattctcatacataccatattgatagataaaattttctcttttttatggtcatgatttttcctattttagctttttgaatgcattctttttcattaattccctaccactgatgtcacagaggttattctcttcctttctacctttctttcctatttaacagggtcttctactttgtttctactttgttttcccattcttcattttaaaatatttccattcatttattataatcacttctctcttttactagaaattaattacccaatctaggtggattttgcaaacaataccatcttcctaaaattcatatttggatagataacaaatcccaatggaacttccaaagctcttaaggaaaatcactgaatagactagaaaatgcttatgactagtgcttacatccatctagttccctgtacagaaaaggtataaatgtatataatctttttttttttttttttttttttttttttgagacaaagagtctcgccctgtcacctaggctggagtgaaatggcgcgatctgggctcactgcaacctctgcctcccgggttcaagtgattctcctgcctcaggctcctgagtagctgggattataggtgcacgacaccatgcctggctaatttttgtatttttaagtagagacgatgtttcatcatgttggtcaggctggtctcgaactcctgaccttgtgatctgctcgcctcggcctcccaaagtgctggattataggcgtgagccactgcacctggcctaaatgtatatattctaagcctaagtgagctccatgagatgaggaggtcagaatttccacagctttgtggctatgcttgcagaaaattgcacaaataagtttggagtggagatatatcaaacaaatcttaaccaattctcatttaaatttatgatcccctcttcttcctcctcctcatctcctttttctctttatctctctttccctctcttggttttatcacatgtaaccgttccccaaaagtatctaactttctattaaaatatagctataatacttctaaattaacagaggtaatacttggtatcagcatcatagttttattttttttaattcatgacaaagttactaaattgagaatcccaattagaaacaaaagcatcgttaacaagtaaacactttgcccatggggagaaggaggtagcaagcaagctgaaggcactgttggtgtcacacagcctattgtgcattaaattattttcgcaccttggttagctgctctttgagctttgacatggtcgcaaacatttcttttccttcttcttgggggctttctttggtaatgaggtgtgctgtctttgtaattatcttgtattgggcatccatcacaggcaccctctgctcaatatcctgcatgaatcattgaaacagccagattcatacatgacacatttcctcttaacttccggattccacagaaggcagaacaaaaatcaatatgcactgtataaaatccaatacttacactaaactttcgacgattccagtttttgcttcccttcattactaataaatattggtaatattatatagttaataaaattttcctttaaaagtgaccaaaacatcaagattagctgaaatgatctttgtactttccaaaacaaatcccatgttaatgtagtatggaaatataaaataaaatgtaaatgtatatttaaaatgtgggggaattctgactttaaaaattagactggttttcgttaaaaaaaaaaaaagtaactcattgccattataaaaacttataaattagaaatattaggataatgacaatttaaattacttatagtcttctcccacagtaaaacccaaagccaacatcttatctatacatcattaagtttttttttcctgtgtttacacccattttaaaatttttacaaagacaaaagaatgatactgttgtttgcttttctcatgtaacaatatattgcaaaatcttaccatgtcattaaaaattcttccactacttcatttgtgagagctgcaggctattcaaaatatgcaaataccacagttcatgcaataaatcctttattattgaaagtatttaggtgcgggtgctatctatagatgtctcctgttttttcctaatactttttaacttggttgtagaaaaaaaaaatctccaaactgagaaacaatttgaagttactttatatgatcaagtcatgtcttttttatgttcaatacatttttttctgacaggtgcaaattgggacatacagacatgtcaaaatgatgcccaggagacacagaaacagcttttgcaatgatctgaataaacttgctgatctttcctctcacaacagagtaggcttttcattttgattcagaaacccctcacctccaagtcttgaattaatagcttgacattcataaaagagacttctaagggttcagaaagtttcttatgggcttccgttgcaaaagcagacagggtaacaacacagtctgtgtattccttcttcattctgtccatctcatcagcttgagcatactgttaaggaaagggaggagggaacatcgtgaaagccatttagctgcgaccactggaaccacaactttcactttcacatattcgctggaattgttatccggtaagaaagactctaatctttgattctcattttagataaatttgaagtaagtccaattagtttgaaagaaaaaaagaaactagcatgaaaatgaagaaatatgatttgaaacgagaatcattccatataagtaggctccatatgtcaacataatccttaatcaaactaatgcatttgtgtaatattcctccattatacatggaaaagaatgaagaaccaaccataaaacacaccggttttaaacatatctatgctttgccttaataaacccgtgctctaaaaatagcattctctctaaacagactacttatcacatttgtaacacatacacgttgaggtgtatatagacttgaaagacatacttgcttgacttccataaacaactccctccaccgcccatttagcaacagtaattgctgcttcaggtcacgggaaaccatctcatcacaggtttcaattagaaaattgccagcatcgttcatggcagtatgctgctgaatccaatgaggtaaatttcgaaaaaaatcctaaacaataaataatgcacaatatcataaaccataaaccaaatatcagtgactgatatgaaagtgactaaagtaggaaaaatatttttgttttaacattcatgtgaattttaagataaatcacaaatctctttaaaatgcacatttttgataaaaagtttcaaaatgtgagctagagatactgtctttttttataagaacaattgtgccatatcatttgccgaagacaaaacaaaacatgatgaccattttctgttatttctgttttacagattaaaaagctgaatttctgtaagtgtaagagacctgtgcataaccttcaggctagtaaataccagtgccagagtcatataaaaggcataatacattagggaaatatatagcttccttttttatttgtataaattgatggggtatgagtacaattttgttacatgcatagattgtgtggtggtaaagttggggcttttattcctttttaaagaaagaatagctttctttaataatttctttttgacctgctacttttgatttttaaatttcagtgtagtacattaagataattagcaatcatggagataaaccatcgaagcaaaaaattttaaattaaatatctgagtcaagagcacttagtacaataacacactttcttatttatttaagggttccctcttggcaatgaaacagtttccaactcattttaaataaagcgtatgtgtgcacacgcacacacacaacacacatcacagtgaaaaacaaggataccaaagataattcaaaatccatttcgtaagccttgtgtgggaggactttcctacatatataaatagattagaacacttctgtttctggtggttatatttcttttgatcaaattaacatgtatgacatccactagggcactgccagtctaatcagaaaagccaaaatctgtatgggtacatagttattgcctccctcagctacacaagaatagttgatctacatgaaatatggaatggtaaaacatttaaaagtgatacatctacttgtccaaacaataatagatgaaccaatcttggatggcatgtggtaattctaatgcatgcatttttagtatcacttacatataaattgattttccatgtaaaaatgccaggctcccattaggaagtatataagcagaaatcagtccatttcatgtgacatttacatataagtgacattaacataaaacagtaactctcacaggcacacacacatacacacttataactggccaaaaaataaatcactcctacccagaatgagacccttgcttgaaggttgataaaatccaaaacagaatatctaacgagatacaaatgtcatggtccagttgttcaactggcgtatgctaccacatagatccagtagtatgtgtttcagcactacgtgaaaacaaagttgttttcatcctctcttaaatcaggaaatccatgaaggctggggccctagacactccccttcatagacagacttcagggtaatatagtgccctcccctttgctgcccattggatttactcaaccctccatcagcttctattaagcagtgtatttattggtctgttgctaacctgaaagtgcaacttttcaggcaaagtcaagattcttgagtgacacttgtaaatatatgcgaccccctagtgagctacgctgtaaaagtctctcatttttacatacatcaaacgtcttttctttttgcatgaaccaatcttacctttttggcattttctgattgattgagcattttttcagcatcctctagccaggcttgcagactagccactgtattgccatagcgatcccagttagagatcacttcttccagcatgctcctcacactcctcacttctactgagagattcctccactgagcggtggtttcattcatgaatttcatcacattctcagcttcttccactgaaacagataaaaccaattataacccttatctcatattttaaatcctctacacctttttttctatggtcttatacattggtgtgcaatagtatccatcacaaatgccagagttcatttccaacaaatatgacagacataattacaaatggaaaacaaatgtattttacaaattgtgtctttacactaattaatttctcatttacttgattggtaatccttaacgtattctatgcttttgcctttaatccttagatgcaatttagaaaatgaatgcttattttgttctctcttagaagaacacatacacacacacacacacacacacacacacacaatgattatgcaggttaggcattgtacaaagccaagggaactgaatccagtatgtgttctcctggccaatggcaaggtcactcaaaaattccacggacagaaagaatgatctgatcagatagaaacctgcaggctctaaattctactgcagtctacgttgcaacaaattctgtagtatgttttacctgaaccatctgctttgacatacatctcagctgtctgtttcaagatctggtatgtcacctcatattgttcaaagaacttgctattttctataaaagactagaaaaggaggaatggttagaagatagcaaacattaggctcatgtagaatgccaaagtcaattttcttcagtatagctataagcacagtttacccaaatttgttaatctcagtcttcttgaaaacataaaattaattccactgctacaaattacctaagatcattctgaacacataaattgattccacgcttttgattctaacccagtacaggactgagaaaatattctatttcttcaccaaccaagggtttgctttttgaagagacagaaatttctccagagaacttgggtctaacatttagaaagcactaaatttagaagaacattttaaagtgtcccactgtgtctcagctgcggaattctgttgctctttgaacattaatcctggtgaatgactgctctgaggaactccagattataaataaatgacggtgcacaaatgcttcccttaaaataaaaagtcagtagaaaaattggaaataattacatattctatccatgttatcaatggtctcacatttcaatgacctattacagaaaaattgcagtaagacatgtttatatatctatttgtaatttatatatataatagaatcactactggaaagtgaatactataaaattgagaatagacaaaaaagttcttaggtaaatgttattattgttcatttttaggaatataaaataatgtgcgtttcaaagattattattacttcttgaaagtagaaaattaatgcaattacagttaagaacatatcaccaaaggctctttaatttcttgcgatagtataatgagttcctatgatttgaatctattaaaatacttgataaatgtcacggtcataaatacaaaattagccttcaaaaaccagctgaattcttgtatagcacgctgatgaatgcttaatatagagatgcaagacacttgtgtgcagaggaaacattattcatgcagcaatttcatagaaatctctggatttttattgataactgttttgagataacattttaaaaattgtatctataacatatttcatatcattttatgtttataaagcatttacttataaattaactattcttcagggataaagtgaatagagaaagctggaatgagaggttccatgatgaatactacattcaataactttaattggctttattttatttgtttgagaataaagtcagacaatagtattctgattaattcactatttagccttatatcttcttattacaacccagttgagaaaagaataatttactagaatttaaattttgaataatttaactaaacaagcaattcattatttgatcaaaaatggaaaattatacctaatgttcaagatactgcgtaagaaattgaagaaataattatatttggcaaagtttagaaaagaatctgcatttagtattggtacaaatttcaagaagctaatagcaaaacaatttttctaagtgtcaaagaaatgggaaatagtgcatgtggttcataggaagacttaaatatgcttttcctagagaagtttacaaaataattaaaaatgaacaagtgagaaaatcttatttccaatttaatttctggtccacgaggcaggaaagaggggagaatgttttcagaaagaatgttttataaatgctgtagacactcattaatgtatttttgaatttggctattaggaagactggatgattaatttttaaagaaagatacctattttgtattttaaatttgtattggtccatttaatttggtcctttttttctgaacatggagtaaatgcatttagcaatatggattattttatctattgaatcactttggcagaactgctaaatctccattttactgtaagctatttagacacacctgtcagaaaaatacaaatgcatgtttaaaataataataacaagattcatttatttctttcaaaatgaggttgaaacttggatcccaagttcaacaaataagccattttaatcaggggacttttaaagttgatggtgcttcaagaaaagtaaatggcatacttatttttggtatttaactttagtgttagtgaccgcatttctactttcacaagatgagtgtaaatataataaatatgaagctcatcaatttcacttgaatgcaactatgccagattattcgagatatttaaaattaacattgaggagaggtttatcaagactatttacattaaaatataattatgaataataaaatgaatattcacactatgttgcattcacacagtccacaatttcaagagctgtttttttttctttcatgtgaaagattgaaatattagcctcttttttccatggtgaaatggaagcacatgttttggtcattgtcaacaattctgacagcaaggactaaaccaattaccttttggtttgcattacagcatgcaatcacttaccaatggcatgtggcctaaattaatgatagaaaggatttgtgaagtattttccaagaattctttaagcactcagtggctgcatatctgagttggatgtacattctctttctctaacacttaaaaaaagtattctttcttttttgcaggacggataagtctgaattgagaattatgactaaggaaaatataattacggaaaatttatggcctgaatattactttggttattagatgatgtagaagcatgtagcttattataatactttatttttatttttatttttttgaaatagggtctcactctgtagctcaggctgaagtgcagcagcaagatcatagctcactgcagccgtgaactccagggctcaagccatcctcctgcctcagcctcctgagtggttgaaactacaggtgcacaccatgacaccaggctaaatttttaaaattttttgtagagacagagtctcactatatttcctgggctggtctcaaactcctggcctcaagtgactcttcaacctaagcctcccaaagtgctaggattacaggtgtgtgtgagctgctgcccccagcccttttttgggggagtgtggggggtgtaaaccaaggaaagaattgcacttacaaaactgactttggtgatttgtgattttatttgaaagttttcagcctctttgaaatagcctgttctataatgaatgattttccataacactctaaaaggataagagaggctctatgaggtgttaacatagaataaaaacagtatatgtcagtctttgttccctagaaaaattcctaccatttcattattattattattatcatcatcattatcattattaaacactggggaaagactaagccttctagaaattaagttattcacagacacatgggtgctcagtagctaaaccatgaccaaacacagttctagtggctggtatctgcacttcatcagttccccaccactacaaccatgctgcctcatatataactaatagcaactatgaggctttcacagtacacttacaggtatgtaagtgtaaaatattgtcaggtatggaccaatattaaattgaactgatatttatgtgaattacattctttagatcactaagacgtaagataccatatcaatgatttggtctgttaagttaaaaattttttttacaattttttttagattgtgatattcagcacttaagctcaagggcttttgatttggaaagatatggattcaatttctgattccacaatttaccacctggagcgtgtgccgccaggagcaagtgacttgagtctatggaacctcagtgctcctgcactggctccttggtatctaaaacaatgtgaaacccccagtctgtagggccatcactgagatgaaaaatgatgcatgtaaaacacttggcatgtgggaaatgctccatactccacggttatcaaaactattaaacaaaattaccttaaaacccttcacagaaaagaaacacgagtgataagtaggtattcttcagtagcagatgagagtactaggaaatgttaattaaagcatgctacgtatgtaggataatcagcaattttatgaatagttatgaaagttacaaggcagtttggaattagtagctgagtgaacttgatgaagtaggcagggagtactaacgtttttatcattaataattgtttattcacatatcatttgagaaaaagagaattattaatatcattgtgttggaacattaacctggtggaatagtcttattagctgtttaaatctgattggctgttctgaaatatccagaacaaagactgtgtctggtataaataactactgggctgagagggtatcatttggcatgactaaatctgaaaatatacatgcatatttgtatttcatatttgaagaactaacgtaattgcttgaagcttaaaatcaagtttttcataactttccaaaacaactaaaaatgagtaaaggaacataacagattttgcattttggaacaaatgtttcctagacaattttagtaaatctagggaaagattttactgtaaagcagttaaatcatttttttctcaactgtatgttgttcacccgtcacagaaaatgaaattaaaatgtagcaaaacagattatagttctaagatgcttcagtgaaaatatggtttcaataagtacttcaagcagaacatgttttagagtcactgtgactaatcaagttacaaatgggtttatattttaaaagatcattgatttatcatagtatttgtgtttaaacataaatgaaacagtacaagactaagatactctattaacattaattttatgagcaaatttgcattgaaaattaatttgtaggatggccatgtttaattaactaagaaataacctgtctttagtatctataatacactaattacatgtaagtgaaaactgctagttacagagcaaacaaattctttcatcaatgcaggtctatgattctagtaaacatagaattatctatattgatagcccaaaatgtgagataatccttaaaaattaagttggtacagagattcatagataaaatgttactcttccagggtgcacacaagaggcaatgaagcccagggaattacggtaaaaaaagacacagtggacacaatctaaaaaaaatagatagttcccatttggacacttgagaatggttctaaactagtcatagttgaattttaaaagacatgaaggtaatctttaagtattttaatgtagttgaaatggtgacctccaataaaaaatgtgggtatgcaatacaaaaactttttttaaaaatcaataaagccagtcaggatggtcccatatgattaatgcagcaaagcattaaactaaactgaactaggggattttaaataatcaaattccaaagaaataggtttagatttcagataattctgaaaagctcataaacttgtatctaacccatttaacacacgctatctttatgtttaaattcaagaattaaaataacaacatcaaagaaactgaactgtgttgctaaatccatggctcataggaattctctgtcaaagcacgggggactcaccacgtagttttgtagaagctgctccactgactctctcctcccgtacttaatgatccaagacttcagctttgactctgcaagaaccagcagtgagagcagacggtactttaattctaaaaattccattttcattaggtgtagctctgatgtggaggaaacaaaatgaaacctagaaataaaacagggagaatttatagaatgtaactaatagtaacagaactgatgcttacttaacctgttacatgtcagccttaaatagaatgcagccacaagctcttctaactctggctgatcattttctggaaatccgattccttttctagctctggatttaaaagcaaagcatgaatgattgaagtcttcgatttagttctttcccctgccaacacatctctcgtctgtttcttttataagctgtttttgcaatattacataatgttccttacagtactgaacaaaaatacagcctctgaagaaaccatttctgtgatttctaggctgtggataaattcagagtcactcttttcagttaataatacattagaatggtggcattcttagcatgtcttatgggagcccgctttctatttaccaaaggtaggcgcctctgttaaaaaaaaatcatgaaaaaataaaagaaatataaaaagcgtccacctagtgttttaaaaagagacttcctttaaatgcagatattctcttacctctcggccatgtcctctaattgatcaggtggcactggaatcccgttaacagacctggtccggtagatttcatggaatgctcttttgtgggcatccgtgttttgaagcagatcctaagatacagtttaaaaaaaaataaaaaatgaaaaacatgtttcacagagggctaagaagcataatttccagcccgcaccgatgagtcaatgtattcaacaatttgatcccgctgccacattcagaggcagcttggtgcctgtcaaaggctcttaccttgaataggagctgggtgcttgtacttaaaacactatgctggaactgcatctaataattatgcatcttttaaacacacatgacacttgcacagcaatgcattcagacgttttaaaggcacatgatccaaaggaaaatgtaattactgctatgaaatgattttagtattttttgcctttctggatatgttggtttttaaaagcttaaaactgagcatgacaaattgaaacctttaatggcaaaagagattaggctttctactgttattttactttgaatgcatgcagactattataaagtggtatttgcttgccatctaaagtaaatcaatcatattacaatatattttgaaatacccttttgattagaaaatttcaaacaagtgcagggaataccccataggtaacacagtgagaagattaaatgtgatgttaataaatattaattatagactgtatagaactccacaggtttgattcatttatttaggttaatttgaatcttctttgatttgtttgctgtgtttttcatcatttacaaactaatttctaaaaagatgtacatgtattttacactccctcaccaatttctcacatagaagcaaggaagaagtcaggtgaaaggagattcatgccttaatttctagagcttagtttgtgtcttgattgcagaataaatacagtacttaaaaatgtgtcactcattgaaaaagtaagacatattagaccaccaaaataatacattaaaattaatatttttatctcatactaaaatttagcaaattagagaaattagtagcaaaaccagcctaaaatcaagagacacacttggtgggacaagtgaaaacttttctattataaattaaaatgttcaggtttgtatatgcttgcccacatatgacattttaacatggtagaaaaaccttagggccaaactatttctaacctgatatattttgctatgatcacattttgacctgctttgactctgaaggtaagtgcagagatactcacaagtcatgtgtgcctcaagggagggtattatgtgaagccaagaactcatcacaggagggtagagaacaaacaggtgttcttagagcagctattgatgatgagtattctagccattctctacctcctttaccacacacagacacattactgtagcttatggttgggctgaaactttcccaagtgactgcagagcacacttggagttatcaccccagctagctctgatttgtgacagtttttaagtatctactatattgaaaaagtctttacaagctacccaaacaaaaacattttcacacatatgataaaagaaattcttaggccgggtgtggtggctcatgtctgtaatccccgcactttgggtggcggacactggtggatcacgaggtcaggagttcgagatcagcctggccaacatggtgaaaccccgtctctactaaagatacaaaaaattagccaggcatggtggcgtgcacctgtagtcccagctacttggaaggctgaggcaggagaatcacttgaacccaggaggtggaggtcgcagtgagggaagatcacaccattgcactccagcctgggcaacagggtaagactctgtctcaaaaaaaaaaaagaacttcaacagttggcatgatgtcactgattcctctgaaaggccatctcactataaagcagctagatgctgggcaaaatatatgattttaattcaccttgctgggttcacaggaagtaaatgaaatattttaggtcccccattcttagtaaaacatgacccaaaaactagatcacagacctgtaggcaaaaaacaaatagacaaatccagattgtcctgggcaaatatctacaccactgctgagagagattgagtcttacaatgtgaacaggatgaggacactgaaatgagatctcctccatttagtcagaaccctcaatgagggctaacatggccaggttattagcaaatgcaaatacaataggaggaaagcagagaccacgaaccacaggaaacaagccaccatgagtgagaaccagcagaaacaacaaacttatcatgctagaaaaatgtcaataatttaatacttgacaacaatgtgtaagataaaaaggacagtggtttggttaaagtattcataattacttatattgattaagagggggttaagatatggctaactttcaattttgttaaatatctaaggtcaaattttgagggcaatcatactgtacaactagagtttataactttcttgctagtagaaataaaaccatggaataagaaaaatgaggaaggagacaaaaagcaaaacctccttaatcaacttataaatagcaagaaagtagaaaagaagaaaaagtagaacagttagaaagcaaagactcagatgctagaaacaaattcaagtatatcaataataataaataaatgtgaataaagtagaaatttactagttaaaagacagagattaccaaattggacaaacaaacaaaacagaactatcttctttttacaaaagatacacctaatcattaagaacatggataggttaaaattaataaaatggaacacatgtcaggcaaatactaagagaaatctgatataaatgcattaatatcagacaaaatggatttcagaacagaagcattataagtacagtcactccttgactcatgatggggttatgtcccaataaaactcattgtaagttgaaaatgttgtaagtcaaaaatgtatttaatacgcctaaaccaaccaaacattatagcttagcttcaccgacattaaatgtgctcagaacactcacattagcctacaatttggcaaaattatctaacataaagccaaattttataataaaatgttgaatatctcatataagaatatcatatctcatgtcattgctgaatgtatattgcttttgcaccactgtaaagtcaaaaattgtaagttgaatcactataagttggaaaccatctataattaattgcataaagattaaactttcaacttactagaaggtacattattcctgaacttgagcatgcccattaaacttcaaaatatataaaggaaaaactgatagaactgtaaggagaacctgaactatcaacatcactgtggggtttatcaacatgcctctctaaatgagatagagcaaaggaagcaagtgttatagcagcttgttgggtaaagaagggaaagggctgcaggaatggtctttataagaacttgtggtgttttgataatggaagccaactaggaattttgagcagattggtgaaattatctcagctgcattttaaggatcactgtggcaattcttctgaaaataccctatcctccatacgtttgcttcccgtggcttctaagacaacactgtagctggatttcctccaacttcactggttgctccttctcagacttttattggttcttctactcttcaatctcttaatactggattccctccaggatcagtccttggtccctttctcttctctgtatatacttctttatttaatttatccagtctcagagctttaaacatccctctagatgccaatgactccgaatttttatctccaagctgtacttcttccctgagctctcttacctattgcttactccacatatcctcttggatgagaaaaagactcaacatgccccaagctgaattcctgatctttcctcccaaagccgcttcattgtctcctattcttaattgatagaaactgttttttcagttgcacagcccccaaatcatagtgtcatttatgactcttcttctttcacggtatgtatctaatgctgaaaattgttctgccctcacaacatattcagaatctgtccatttctcaccatctctacagctacttcccttgttcaaagcactctaactggatgatggaaatggtaccctggcttctggtctccattcctaacccagtctattctcacatagcagccatatcatgaaaatactgtcattcctttgggaaaaaaaaatggggctgggtgctgcagcttatgcgtgtaattccagcactttaggagggtgggcagatcacttgcacccaggagtttgagaccaggctgggcaacacggtgaaaccctatctctccaaaaaatacaaaaattagtcaggtgtggtggcccatgcctgtagtcccaccttctcgggaggctaaggtggaaggatcactggatcctgggaggcagaggctgcagtgagccatgaccacaccactacactcccgcctcggcaacagagccagaccctatctaaaaaaaaaaaaaagaaaagaaaagaaagaaataaaatggatgaaaaaagaaggttagaacattgtggagcaaatcaacaatgccaaagtgtgattaaggaaagtgaggcagttcaaagaaacaatattggggaaatatacataggcacagaaaacaccacaaaatatataaaacaatattctgaacaattttatgctaataattctgaagacttagtcaaatgcacacatttttagaaagtatgcattatcaatattgacccaattgcaattttgagagcctgaatatggggagacaacagtgaaaaaaaatcaataactcccacttttatggagttgacattatagtgcagaaaatcaagcaaaagataagataaatgattaaaactggtaacagttgagatgatgataaatgctaaagagaaacatcaaatgggaaaggggaaggggagtttgggggaagttgtaatttcaaaagaggtggccagaaaagggtggatgaagaggggaccttttagtaaaggccttaaagagatgaagaagaacacaacgggaatatcagtaagaggatgtttcagactgagggatgagaacattccagaaggatggcaagggtaaagacctcaaggtagggaatatgcttgcctgtttgatgtcatcttttcaatgaggcttcactgacaaccctatttaaaattgcaacaacacctaatatcccatgtccttttactttctaacctaaatttacttattttttatatttattacctttatctgcctcctctcactagaaggtaaattaagggaagggatttttgtctgttttgcttacagatgtatcacaaatgcctaaaacactgctttgcaactgagaaagctcaacagatatttgttgaaagaatagggaagaccagaaaggtacagccaggggagtaggaaggaaactacaagtggcacaatcatagcttacccactgcagcctttaattcctgggctcaagcaatcctcctgcctcagcctcccgagtagctgggactacaggcatgcaccactatgcctaattttttatttttattttttgtagagacagagtctcgctttgttggccaggttggtctcaaacttctggactcatgtgctcctcctgccttggcttctcaacatgctgggattataagtatgagccaccatgccttaaagaaagtctttcaagggtaaagggacaactatgtgaaatgtttgtgacaggtgatgtaagaagactgagaactggccattggatgaggaatgaggcaaagcctggtaaacttcacatggtagatggcaagataaaagcttgattggaatggattttagaaagaatgagagaagagaatttagaaagaagaaagagccaattctctcaaagagctttgctgtaaaaggaaggaagaaaattggacagtagctgggaggggaagtggggctaagaaaaagacttttaaagatgagttaatggcagcatatttgtatgtggatgagtaaactccaacaaagaaagaaagagaaaaaaatagagaagggaggaaggacaggaattaccttttggagagagggtgggatctaatgtacacatagagaggttggcctcggcccagagcacagatggttcacccatagtaacagaagtgaagagcgtgtattcgggcacagatgcaattgcgtaggtgggttgatgtggccgtgggagctggtggcaattcttttctgattgcttctattttctcaaagaaaaaggaagtaatgtcatcagctaagagtgaggatggggaggaggtgtggaaggtttgaagagacaagatatgaaatagttgtcccagaaatgaagagggaatggagtcgggaaatgccttctgattgccaggcaccattaagggcccacttgggttagtcatcgcgcctgggggtgtgtttttttccagccacagtcagctacatgtgtgtgggcatgaactaggcaaagagctggctttcaccggcattgtgtttttaccaggacactaaaacaaagtgaaatacggacaaggcaagcgaggatgtggatgagtggggcttttacattgcatttaagcagagcacaaaaggagatggtaaagagaacaggatacagtgaaaaggtggtagggtaacagattatagggcacagaggagatgaagccttgtctgactggagaggaaggtacttgacaaagagcttgtggaggggtctcatttactggtgatgagcattctaggctatgactgtggagtgagtggctagggttgggtgtaggacaggatcctgggggaagaggtcaagaacctgagaggtcatgatattgggaggatcatctctaggttactgaagttattaagaattatgacatgcattgtcatccaggaaataaaatcttcaagaaaggaaggcaagtgacctaggtagggttggtaactgcaataaggatgtgtagcaggtggcagagcctaatggctactttcatgattccttatgactgaaagccttactttgccaaatcaatactaagaataataaattagtcagtataatcactctacaagtatgataagcaatagctttgtggtcacattttaagcctagtgctgaagacaacctggctcatcagctatgtgaccttgggcaagtcacttaacctctctctgcctacactttcctcatcagcaaaaaaggataataatacctatctcacatccgtcatgttaagtgtttggtaaaaatcaaatacttaggactgaaacatggttaagtcctccataatagttggctatggttattgttatttttctagataactgaacattagggtaactggaaaatagaaaagataatacaggtacactatgttttgcagaatacataagttcttacacatatatacatatatacgttaatttttcagaaatagtaaaacaaaaccactggcagaaccattcacaaagtgaactctcggaaacacacctttaaaaaatgatctgaatccaacttgcaaacgttgcctatgcattaagtgttgaaattgtgttatttttttaaaaggtgtgaagaatgaaaaaaaccaagcattgtaactttgatagcttgttcaagttttcttgacaaaaaccagaattactttttagaccaagatgggaagacaatattcccaaacattcttgatcatacatcaatgattcctaaattgtgattttcccaatttattgcatctccaagtgagcccaatataccagcacagaggtgttacatcaaatcgagagactgagttggtgccattgaggaaacttataatttttagttgttttaataagtcaaacttggccaggcgtggtggctcatgcctgtcatcccagcgctttgggaggctgaggcaggcggatcacttgaggtcaggagttcaaggccagcctggccaacacggcgaaaccacatatctactaaaaatacaaatattagccaggcatggtggtggatgcctgaaatcccagctacatgggaggctgaggcaggagaatcgcttgaacctgggaagaagaggttgcaatgagccaagatcgcaccattgcattccagtctgagagtgacaaagcgagcctccatttcaataataataataattcaagcttttcaccctcaaagcttagcttattataggctcctaatatatatttttcaataaatgagaattgattttaaaattgacaatttaattgttttatgagctactttaagtacccatgcccaggcctagtagaagttcctacctcaatgaaaagatcattctaatattcaccttgaacctggcctgagcccctgtcgctgctttttacctttatctctttattacattccttagttttctcttcagtctagtcctttctgggtttttgtttgtttgtttgcctcagataaccattttctccaactcctgcccctctctctctccctgatccacttcatttctggtttctatgctttgttcactagactttggcagagagattgttctagctgtattcttgggggttggcacagggtgtctctctctcactgtctctcaagggagctagaagggctcatgaagggcctgaaatcatatagccattgaaacacacagatagcatgtgcattggccaacttaggactcactcccccgtaggagatactactgtctatagtgtgccttgaattaatatttctacaaactgttataattaactagtaaatagcagttacattgtctggcattttctctgtggtgggacatttaagtcaaagttaaaggtattatacaaagaacaattgtgtagatgcttctcagacctctagattggaggcaccacaaacgcctggacctcgtctgtgcccctcacctgttgccctggagctgaaaacctgcacatagtaggaatatttgctaccatgcctatttgctgaattaacgtatttaattctcaataaatatacattctacatttcatttaaaattctaagttgacttctttagtatcaaatatttacatcaattaaaatagtttcatatgtaggtaacaggtacactagaatcctaatccccaccattatgtaatatactcatgtaagaaacatgcacatgtaccccctgaatctgcaatttaaaaataaataaataaacaaatgccagttaaggtaaaaaaatagtttcaattaagttttccatgaaaaaattattgtgtgttatatatgcttagttgctaatttgctaaagatgttattgtttgtgtaatactattttcacacttttctctatttttaatatactggggtgattcaaaattgacatggcccaggaaactgattcaatcccaggaaaattcttgtgacttgatctcgtatgaggcctgaactctgggtcccttacggcatagctgcccccactttagggcactaaggcacagataagcaggccccgcttttatttgtgagtatctgcacagatgaagaagaccccaaagtcatgcttgcatctgagaagccaaatgacagagagttcagtgtgtgtgtttgtctgcgttggtgattgggggaggagaggagctaagagatcatcagcaactttaaaagtgtctaaaggcactgagtatcagaaaaggccaagaggaaatggaggcaggaccctgagtgatggcctctgcagatcatcaaatcttgccgtggccatctggtttgatgagcttgtctgaggttgagtctgtcaagttgaaatggccaagatcggcaatggcatcacatctctgtgtctctgtatatctagctccaaaagtaaagccccagagaggcataaaataataaaaggcaataaaatctgttgtaaatttgctttatgatcttgtctagaatacaggacagtgtatttccttggggtaatttttcaaaaatatcaataatttggcagaaaatatacatgggctatacattgcccatgtgtagtcaggagtagaaatctctatttttcacatatgcaggaataccccaccacattacagcaaatgaagtatacaaattcaattgcataaaatgcaagattgcattaatgtgatgttaatgaaaaacggcatttttagttaggcctgtaatatcacaaaacacaaagaggaaatatattggaaattataccatatacaactgatcatatactaagtttaaaacatcccaaatgactaagagaccatcaaagcctaaccccaccacttcctacagcctccattccttctacccccaccccacagcaccaagacataagaacttctgcctgccttcctttgagaatggaggcagaaatgaggtctggagccaatggccggccacattattatgtaaatgcataccatctatgcttatcttttgaaaaataatatataacaacagaaataacaaagatagctgcagatgaaaaaaataccacacaggtatggaaaatatctcaggaagtcaacccactggaaccgtcattaaccagtgtaagaaagaaacaatcaaattagagaactctaagaaggtgtgacgtctccgatcatgtagaattaatatttggggcgtccccgccagagcaggttgtaactaggctacctctccagaccacagtagggctgttatgctgcaaggttttccaaccagaatttttaccttatgttgctcaagtttccgttgtatcgtgtttgctgtttcctcgtggacctgttgaacggttatttcctctctcagggccacctccgctctgtacagccaggcacctatggtgcccagaggtgcaggaagagatttatcaagctgtatatgccagtcaaagagctaaaatttaaaaagcagaaaagtaaaatatctttaatacagatggcaatttataaaattgcacccaaataatagtaaagcatacataaagctttaagttaatgatttcaggctaagttaataaatatcaaataagcaaatgtctgtgttctgagtttgacactttagggatggggagaaaattacagttaaaagcaaattttgaagaaactgaaaatacatcttaaacatggaagaatattatcagaagtgtaagcaattttcctcttacaggagtagcatgaagcacccactgattttcagtgtggcttttgctgaaagggaagggatcaggtttggtgacatgcttggaggatgcagcagttatacacctggcacatgtgtatcttggtcgtcggaatgagaatcccattaaaacctcccacgtgatcagaacaagttcagaaaaatgaggattatctaagcagctctggacaaagatgggtttaaaggattctttctataatcctatgattgtctacccttctctccatctcttccattttacccaattctcagacacatttcctagcttactggaaagccaggtgggatgagttgaggtgcttaggaactagcctattctttaatggagtcactagaaaaaatgagactatcaaaaaaaaaattaggctgggtgcagtggctcactccagtaatcccagaaatttgggaagccaagatggatgagatgcttgagcccaggagtttaaaaccaccctgggcaatatagtgagatctcatctctacaaaaaaaaaaaaaaaaaaaaaaaattagccaagtatggtggtacatgcctgtggtcccagctacttgggaggctgaggtaggatgattgcttgagccaaggaggttgaagctgcagtgagctgtgattgtgccactgcactttagcctgggtgacagagcaagacactatctcaaaaacaaaataaaataaagtaaagaatatatggtaagttcaagacaaatattcttattagtgatagaagtgttccaggggtttgaaatcttggcctttaagcatgaagaatatgaatatgaaagatactgagcaattttccttcagattcatgatcagataaaaaaagatgcttgaattaaagaatgcaaaactgtatgtcaacacaggaaggtcattaactgttgatgaaacatgattttagaatacaagaagttgctgtggctctactctggagaatctgctacaagaccagagagtcacctcttctaaaccacccagaaggaagttgtgtaaagtgtgaagtgatccagatggtctcaggactttaatctatcatctagttaattgctgatatcacatagagggaagccaaggcaagaaaatagctgttaaaccaaagacttccattaacttacaggaaaactagacaaggaggcaaagattctcccatagttaagtctttctagcctcagacagaggcagtagaacctgttgccataccactgtgtagaaatagatgatgaaaaatattcttttctaaatttattaagctcagtataactaattgtgggagaacttaccctggaggtcactctatcccaagattgttttaccaatgcttggtcaagtgacaatttaccgtctctgtgtaatggttgtattaaatgttcaatctgtttcctcttcatttcatattgaactctgaagtgcttaaatgactaaaagaggaaaaacagcaacagtatggcaatgagtcaaaaaaagcaaaagcaaaggaaagcacatttcctaaataacaatcttttctatttggataacactcaatatatgttgttgataataataacggtagttatgatactaatagcagctgtcattcatcaagccctgacatagcttgaccctgtgctaagtgctttcttcatattatcctctctggttctctccatcaccctacacatgcattattattctgaagcccagaaatgacttatcaaggacaagtagtagaggtaggactaaagcctaggatttctcatttctagtaaagtaatttgtgtaccagtatatgtttgtcaggaaatcatagtaaacaggagtataaatcttagctaataatcaagatagttgctttacttcaagtaccaaacaatttacaaatagaaattgcatatatcaaaataatgcagaattaaagctgtctagatttgtgtttaagtaagcctgcataaagaggtttactttaggggaccatgtttacatgataatcctttgctttaatttcatggtattaaaatattaagtatatcacagtacagttgacatcaatgtattatatgtagacttaactataagcttaatgctaacattaaaacaatttttaaagttttatattttacattaactaaattaacccatcctaaaatatgactccaaatctaaacataaaatgaaaagataattaaaatgtgcaattatgttacaggagaatggccccacaaaagttagcagataacacaactaaaagaatttcaaaattataaacaaacatgtaaattcacgtgaagaacactggggggagatagtgaactagaattttatctacaaggttttctttcattttctctaactgaatggaattttaaaaataccaaaacataggctgggcacggtggctcacacctgtaaccccagcacttttggagatcgaggcgggcggatcatgaggtcaagagattgagatcatcctggccaacatggtgaaagcccgtcgccattaaaaatacaaaaattagctgagcatagtggcgcatgcctgtagtcccagctactcaggaggctgaggcaggagaatcgcttgagcctgggaggcggaggttgcagtgagctgagatcacgatcatgccactacactccagcttggcgacagagtgacactctgactaaaaaaaatattaaaaaaaacaacaaaaaaataaatttaaaaaaaaacaaaacatcaaatcaacttttaaattttattccacaggattctgagtgaaaaaactggaaaatgcagcatttgctacagattgaaagagatttaaaatgctgattacagaatgtaaagatgaaatgaaattttccctaaattcagatttcagagagactctaaacccatttttatgagactagtgatcaccttcgggctgaaaggaggatttctgttttctgttttcctaagcctttgtttccctcatgaactagcatctgtataacagatagctttataacttggaatttattttttgataattggtgccaaacctaaacctcatcagtggactaaataagtatattcactctgttcttgcaattcttttctccatttactggcttaatcattttttaatggatctcagcccagaaaattttattttggggaaaaaagcttacactgaatttcaaagcaaaagagtacatgcatattaaccacatatttattgctttgctaagtttgacaaatataatattgatgctatcatccacctaaattcaggcatattttaaagatacaattatataaaatcactaatgccatagataaatcttttgtctaccatgttgaagttctcacttcatttgacctttttctgtagcagaaatgactgaaatatgatgtcgagtagaatatattacagaatataattcagaatatactatatttaattttgccactaaaagggactgatgttttacattgggaaaaatgataatgctgcatcaaataaatcacaatttttattaatttttattttttctccaacttttattttaagttctagggtacatgtacaggaagatttgttacataggtaatcatgtgccatggtggtttgctgcacagatcaacccatcatctaggtactaagcccagcatccattagctattcttcctgatgctctccttctcccactcccccacaggccccagtgtgtgttgttcctccatgtgtccatgtgttctcattgttcagctcccacttataagtgagaacacgcagggtttggttttctgttcctgcattagtttgctgaggataatgacttccagttccatccatgtccctgcaaagggcatgatcttgttcctttatatggcagcctagtattccatggtgtatatgtaccagattttatttctccagtctacattgatgggcatttgggttgattctgtgtctttgctattgaaatcacactttgtaaatgggaataaactgtgttttgtgtcttggaagtgaaaatcagaagcagaagtccaattaatgacactgtagtcagactggagaaaaacattaactctgagctcaacttgaatgcaatggtgttggactaggcaggtcgcagtcgaaactgatccctttaatggaccctccaatactcatgttgcaatcctttgttaaattcagtttattttatactaattttcaatttgactcaactctttgttcttggtagatttttgggttaggtgagatctataagatcatgagttctggccgggcatggtggctcacgcctgtaatcccagcactttgggaggccgaggcaggtggatcccgaggtcaggagattgagaccatcctggctaacatggtgaaaccccatctctactaaaaatacaaaaaattagccaggtgtggtggtgggtgcctgtagtcccagctactcaggaggctgaggcaggagaatggtgtgaacccaggaggcagagcttgcagtgatccaagatcacgccattgcactctagcctgggagagagagtgagactccgtctcaaaaaaaaaaaaaaatcatgagttctataaacacaatgactctgcatttgttttccaagtcatctataagactgagttatggaaaagtgatgaagcctcagtgctccatatatagtgtggacacaatgcaacttaagactatctacataagttagaaatacaattattaaattatatgcaaacttagggtaatgaatgttatgtctttaaagacttttctcattaatgtaatttgaagcattaaatggagatcaaatgacatatataaatattagtcaaaaatagcttttgaaaaattcaaaaatcttctccatacaatacctgatatttatcctgtaaatttgattccaccatctgtgctcttgtcaaatctctctcaaattgttctatccaaactttcatttccttaaaaattactctgtcttctctctggaaatgaggagacattacaattttattagtatctgtgcatttatttaattgctgattaatacttgactgattctagaagagacttaatatttagtaagtcccaactgtctctgaaaaatttcctttctccttacccccacctttaggacagtaagaagcaaaagttaactctagaaaagtatcttagttatcttattgaataacgaaattaaccaactccattttttttttgccaagtaacgctaatttaataaagaaaatgtgaccaggagggaatttcctaagtacacaaataataagagtaatagctggagtagaaacacagtcctgtgggttgcttcctacccaaagccattggtaacccagaagacagttctagatgggattcattttgactgaatttgaggagttacacccagaataccattgggtgacttgtctatattactatttaaactgatattaggtattacaatctccatgtggacagaaaacacatttatcttgttcaacacagtattcctagaccctgggaacataatacctattagagatttatcaagttatttggtgaataaatgtatccaggtcaccactcatctcaaaaatgaaaaataaaattgggattttcatacttattttcacaaataatgacaagggccattctataatagcactgatttagtgaaaatatcctaacttttcatcaagatgtagtgtctcataagaatgccaagtattcataatcataccgtacatgatttttcggcatttacaaaatgcaactccagcatctcacttgctgctgacagtgctgtgacacaggtaaaatgactgtcccccttggcaggtgatgtttccgaatggaaagaatgccatttatggaggcaggctaaactgggtttcaaattctggctttgccatgcattagctctgtgagcttggtgtgtcttttttttttttttttttcgttaacctctctactgtcatactacaggatgtactaaagggtgtgttaaatcatcacggaccctttcaattgttttgctgagaattagaggtaatctatgtagcatgtccagtacagaggttgtcacattctcatgatccatgccttctctcactttcttgtcttgcaaaagcagttgtcttctgcctaaacacttaccacattttcccttggataatgcctttttcagaactcggctcaggcacaacctactctaggaagattttctaacccagaagtctgagtgagggcatctgtttcctatgccagtggttctctcacttagtacacactagaaatcatctgaggggcttataaaaacacaaattgctgggcaccacccccagagtttctggctgagtggatgtggggtagagccaaaaatccgtatgtctaagttcccaggtgaatctgatgctgctggtgaaggaatcatatattgagaacacttctctatgatcctgtgacaacctcagcgctaatattcacccaaatgcattatataaagtcagccctctgttttcttagattcaatcaatagcagattgaaaatattcagaaaataaacaataaaaataacaatacagcaataaagataatacaaacaaaatacaacacagtataacagctatttaaatagcatttactttgtgttaggtattatacataatctacagattaaagtatatgggaggatatgtgtaggttatatgcaaatactacactattttatatcaggaacctgagcatcataaattttgctatcttgggggtcctggaaccaatcacttgtgaatatctaggaacaactacacaaaatccttgtcaggcctctgagcccaagtctgcacgtatatatccagatggcctgaggcaactgaagaaccacaaaataagtgaaaatggctggttcctgccttaaccgatgacattccaccattgtgatttgttcctgccccatcctaactgatcaattgatcttgtgaaattctttctctggacaatgaatctcggaagctccccattcagcaccttgtaacccctgcctctgtctgcaagagaaaaaccccctttgactgtaattttccactaccctcccaaatcctataaaactgccccacccctatctacctttttcggactcagtctgcctgcacttgggtgattaaaaagctttattgctcacacaaagcctgtttgttgggctcttcacacggacacacgtgacatttggtgctgaagatctgggacagggggattccttcaggagaccagtcccctgtcctcaccctcactccatgagaagatccacctatgaccttgggtcctcaggccagcccaaggaacatcttaccaatttcaaatcgggcaagcggtcttttcactctcttctccagcttctctcgctacctttcaatctccctgtccttccaattccagttctttttcctctctaatagagacaaaggagacacattttatctgtggacacaaaactccagcgtgggtcacggacttgggaagacagtcttcccttggtgtttaatcaccgtgtggatgcctgccctgatcattcacccacattccactggtgtctgatcactgtggggatgcctgcctgattattcacccacattccactagtgtctgatcactgtggggatgcctgcctgattattcacccacattccactagtgtctgatcactgtggggatgcctgcctgattattcacccacattccactagtgtctgatcactgtggggacgcctgccttggtcattcacccacattcccttggtggcaaatcaattgtggagacgcctgctttggctgctcacccacattacagcccagggctgctcaccacccccttctctgtgtctctacctttctctttaaacttacctccttcactatgggcaagcttccaccctccattcccccttcttctcccttagcctgtgttctcaagaacttaaaacctcttcatctcacgcctgacctaaaaccttactgccttattttcttctgcaacactgcttggccccaatacaaactcaacaatggttctaaatggccagaaaacagcacttttgatttctccatcttacaagacctggatgatttttcttgaaaaatgtgcaaatggtctgagatgcctgacatccaggcattcttttacacatcagtccctccctagtctctgctcccagtgcgactcatcacaaatcttctttctctcctgtctgttccttcagtctccaccccaagctctgagtcctttgaatcctccttttctatggacccatctgacctctcccctcctcaccaggctgctcctcaccaggctgagccaggtcctaattcttcctcagcctccactccccagccctataatccttctatcacctccccctcctcccaccctgtctggcttatagttttgttccacgactagccctccccaacctgcccaacgatttcctcttacagaggtggctgcagctcaaggcagagtcaaggttaaccctcctttttctttatctgacctctctcaaatcagttagtgttcaggctctttttcgtcaagtataaaagcccagcccagttcatggcctgtttggcaacaacccttagatgctttgccgccctagacccagaggggccagaaggccgtcctattctcaatatgcattttactactcaacccactcccaacattagaaaaagctccaaaaattagattctggccctcaaaccccacaacaagacttaatcaatctcgccttcaaggtgtacaataatagagaagagtcagccaagcggcaacttatttctgagttgcaattacttgcctccactgtgagagaaaccccagccacatctccagcacacaagaacttcaaaatacctaaaccacagtggccaggcattcctccaggaccttctcccccaggatcttgcttcaagtgctggaaatctggccactgggccaaggaatgaccacagcctgggattcctcctaagccatgtcccacttgtgcaggaacccactggaaataggactgtccaacttgcctggaagccactcccagagcccctggaactctggcccaaggctctctgactgactccttcccagatcttctcagcttagcggctgaagactgacacagcccaatcacctcggaagcctcctggaccatcacagatgctttaggtaactcttagagtggagtgtaagtccatacccttcttaatcaatacggaggctacccactccacattaccttcttttcaagggcctgtttaccttgcccccataactgttgtggatattgatggccaggctgctgggccctttaaaactcccccactctggtgtcaacttggaaaacagtcttttatgcctcttttttagttatccccatctgcccagttcccttattagatcaagacattttaagtgaattatctgcttctctgactattcctgggctacagccacatctcattgctaccctttcccctgttcaaaacctccttcatgtcttcctcttgtatcccctgcacctgaacccacaagtatgagacaactctactccctccctagcaattgaccacatgcccattactatcccattaaaatctaatcatccttaccctgctcaacaccagtatcccatcccacaacaggctttgagaggactaaagcctgtccaggatcttcaccttatcaaaaaaattgtcttgcctatccaccccgtggtgccaaacccatatactctcctatcctcaatacctccctccacaaccccttattctgttctggatttcaaagatgctttctttgctattcctttacacccttcatcccagcctctcttcgctttcatttggactgaccctgatacccatcagtctcagcaacttacctgggctgtactgctgcaaggcttcagggacagcgcccattacttcagtcaagccctttctcatactttactttctttctgtccatctgcttctcaccgtattcaatattttgacaaccttctactttatagcccctcctacagatcttcccaacaggacatcctcctgctcctccaacatctattctcaaaaggataatgcaactcccccgtcaaaggccaaatttcttcctcatccattacctatctcagcataactcttcataaaagcacatatgctctccctgttgatcgtgtccggctaatctcccaaaccccaaccccttctacaaagcaacaactcctttccttcctaggcatagttaggtactttcgcctttggatatctgtttttgccatcctgactaaaccatcatacaaaaggaaacctagctgaccccatagatcctaaatcctttccccactcgtctttccgttccttaaaaactgtcctaaaagctgctcacacactagctctccctaactcatcccaacccttttcattacacgcagccaaagtacaggactgtgcagtcagaattcttacacaagagccgggactgcactctgtagcctttctatccgaacaacctgaccgcacagttctgagctggccttcatgtctgtatgcagtgacagccaccgctttaatacttttagaggccatcaaaatcacaagctatgctccatttactctacagttcccataactttcaaaatccattttcctcctcacacttgatgcgtatactttctgctccctagctccttcaactgtactcactatttgttgaatctcccacaattaccattgttcctggcctggacttcaatctggcctcccacattattcctgctaccacacctgacccccatgattgtatctctctgatccacctggcattcactccatttccccatatttccttctttcctgttcctcaccctgatcacacttggtttattgatggcagttccaccaggcctaattgccactcaccagcaaaggcaggctatgctatagtatcttccacatctatcattcaggctactgctccgccctcctccactacctctcagcaagccaaactcattgccttaactcaggccctcactcttgcaaagggactacacgtcaatatttatactgaccctaaatatgccttccatatcctgcaccaccatgctgttacatgggctgaaagagttttcctcaccatgcaagggtcctccatcgttaatgactctttaataaaaactcttctcaaggctgctttacttccaaaggaagctggagtccttcactgcaaaggccatcaaaaagcctcagaccccattgctcaaggcaacaattatgctgataagacagctaaagaagcagccagtattcctacttatgtccctcatggccagtttttctccttctcatcagtcactcctactcactctcccactgaagtttccacctatcaatccctccctactcaaggcaaatagttctttgaccaaggaaaattcctccttccagccttacagctcattccattctatcgtttttcataacctcttccatgtaggttacaagccactagccctcctcttagaacctctcatttcctttccatcatggaaatctatcctcaaggaaatcacttctcagtgttccatttgctattctcccactcctcagggagttcgcccctgcccaggattggcagattgactttacccacatgccccgagtcaggaaactaaaatacctcttggtctgtgcagacactttcactggatgggtagaggcctttccctcagggtctgagaaggccaccgcggtcatctcctcccttctgttgacataattcctcaatttagcctcccgctctacccagttgtcccatcaatccccattacaacttctaatggctgctgccctagctggatccctagtgttagatatgagttctaaatttcttttcaaagaatcaatatgtcagtaggttcaattctttgccttctacttttaaacttaacttcctcgtaaagcaaactttttcaattacctgctccaccctgactcatttcaatcacctgctccaccctgactcattccgattacctgctccaccctgactcattctgattacctgttccaccctgactcattccaatgacctgctgtcataaccatttttcctgccaaaccactcaccctgtcactctctttaaattagccaattgaaattagtttagcctgtgcggtctaaccctagccaataggggaaggacgcagcagcaggggccacgtgcatcagggataagaaccccttcccgtcccttgtccaagtgtgtgctcaccattgctccatctgtaagggtgcaaccttctatagaagtaacttgccttgctgagaattaaaaagaaaattttatattcgagtgctatttcttttgtggcacagaaacttcatatataatactaggagtctgggtacaagacacctcttttagtgctctttctcattttttcactttgcatttccagtgttgcacaaggtctcttcttctgtgactcctctacctacatgtgtctacctgctaataggacaggcacgtgcacactagttttccttactcccaaaattcaatttgcaaataggactgaacagcttcctcttcccctcatgacaccaacacttcaccactattttgttttatttttcttattaatatagaagacaggaataggcctcgacttactgctgaaaaaggagaactctgtatatttttaaatgaagagtgttgtttttacccaaatcaatctggcctggtgtatgacaacataaaaaaactcaaggatagagtccaaaaacttgccaaccaagcaaataattacgctgaaccgccttgggcactctctaactggatgtcctggttcctcccaattcttagtcctttattacctctttttctccttctcttattcagaccttgtgtcttctgtttagtttctcaattcacacaaaaccacatccaggccatcaccaatcattctatatgacaaatgctccttctaacaaccccacgatatcaccccttaccccaaaatctttcttcagtttaatctctcccactctaggttcccacatcagcccaatcctgctcgaagcagctctgagaaacatcccccacaaattttcaatgccccaacacttcaccactattttgttttgtttttcttattaatataagaagacaggaatgtcaggtctctgagtccaagtctgcacgtatacattcagatggctgaggcaactgaagaaccagaaaagaagtgaaaatggctggttcctgccttaaccgatgacattccaccattgtggtttgttcctgccccacactaactggtcaagtgaccttgtgaaattctttctcctggacaatgaatctcggaagctccccaccgagcaccttgtaacacctgcccctgtctgcaagagaaaaaacccctttgactgtaattttccactacccacccaaatcctataaaactgccccacctctgtctccctttgctgactcctttttcaaactcagtctgcctgcacttgggtgattaaaaagctttattgctcgtacaaagcctgtttggtgggctcttcacatggacacgtttgacactccttatgtatctttttaatctccatcatctaacacagtgtctggcactcagaatcactcaatatatgattgcagaataagcaataagttagaaactcagttaaaagtagaaagaaatggaactggagcccaagactacaaagcttcaattcttcccaggatgtcttttctgaatgaacaggtgaatataattaaggtacatgttttattatcagttgattctcatgcccagaaaagcattgataccacattcttatgagctcagagagaaaacttgttcttgatgtgtacccaaggtaccagaggtcagtgtggccaccagaagtgacccatctaacagtgagcacaagacttcattgtgagcctgaggacaggctgctcaccaacttctggatttaaaaagcacttgactgccctgaagaggagctatttgttatacaaagtcatctgagagaaaagggttatgttcttaaaataactttattagagcctatttagtaaatgactttctaatggttggaaagtgtctagcagattgcaataaggtgagaaggatgtcgctatttatatactcaacattctcctttctaagagaaaaatgaagtacaaaacaatatttatagcccattagtctagggcttttcttcaactgataactttcacacacattcagaagacgtggcaacctattgcttatatctaaattccaagcagctatactgccagcattctctctactttttctttcactttattgtttttctttctctctcattcactcatacacacacacacacaaacacagacacataagtcacatttacatttgtgtaccatgttcacatatacataacctcatactttatggagcatgatatttaaaaaatttactatctgatatgaaattagttgcttctgatttttctattccaatgttgatataaatacaaatatccttaacctgtggcctagatggaacataaagaaaaacggaaaagctgaaatatgggacatgcattcaataacttggatatggacaggaattcataaccattcattctgctaatatcttttgagcacccatgacatgtcatgaattttactaaaccatgagaccgaatactgagcagaagagagtgaggaaactcagactgacaagctgatcgaatacttaccttgttcattgattctctgctaacattttaagatacaaaactaaacctttattttgtttttattttctgtgtcacatttaaagacaccatacgtagttactgtaagtcctttttattagtgttattaagtattataaagaagaaattaattgatagataccattttataatgaaagattaatgggcaagtccatgggagtagcttagactatcactaacatttggtaacacatatgtatgttatttgttctgttagaaaggaaacgcaaatgatgtgattaaagtattaagagaaatgtatacataaagacaaaaacatgcaagggaatgactaaaatgctacagaatgcaggatgtttgaaagaggtcatcaatgcaagattacttaaatcttaccttaaaattttgtacagaatttgcaaaagatgggaaacctggaagtatttcctaacaatatgaaaagataatatatagaaatataatataaatcagggtcaaaaattatttagaaaacaagaataaaatcaatggaaaggcatccgcctttagagaaataggcaatcatttcaagggtatatttactttaagacattttcatagcttttgaaactacaaaaatattcaactccaataaggcaacatcatttcctagaatatcacatttttaacttgaaatagtcatatgtagctatatattttgtaaacatatctcgaaataacattaaatattttagaaggtaaactatgtaaagaagaggtatatggactcatattactttccctataaatatacacagcacacatgtttctttgtcctcataagaattaagaatgtgttgtgcttcttagggcagtcaggaatgtttgttgcaatggaagaacagatgggtgaaaaaataaatgaaagtttagaaggtgaatgagataagccaatagacctattttatttatttatgactgagtgctaattattcaagaaatatcttaaggggaaaagttcatcagttttattggatgagattaaaaaaacccatggtgatgtcgattttcagtaagaaaatcatatttaaaatggtatcgataaaatacttaattcaaataaaatcacaaaggggatatataaatcaaatacacacaaaaatgaaagcctggtagatatgttcatgccaagaatttttaaaaaaatgaattaagagagtaagagctgagtgacaaatactgagtactttgaggtgagggctcaaaactaatacgcatagtttacaaaatattaaaggttcactagacagaattaggttaccattaactgttaaatataagccctatgtcataacaaaaaaatacattattcaaaatattcagttttagatgtttatgtactacatgacaaatgccactaaaaaagggcgaagcttccaatacattttcctcaaaattaatttttgagataataagcctgaataaatcatatgcatcctctttttaggaaagggatagagggaatttttttaacgaccagaatttattttctggatgattaaagtaacctctgaaaataataaagcttctttagtaaagtatattaaaaagcctatatcaatagattgtgtgtttcgaatctctaaggatttttgcattaaactcctgctcatgagcattaactaaagcatctccttttgtttttttagatgcttccagccactcagtttactaatctggagagatgattaatgtcagagactctaaaacagtaaaacctcagacaccaaattagatataaatccatctgggtaatataaggacttcacgtataaaaaccagatggaagtttggatggattttctctgtgctatatgaggtaagtctaatgtgttttcttatagagtttcttattcacacagcaatattatcaaaacccagcaagccccagatgactccaaaatatttgcatcaatccatgccagcatttgcacatggagtctttgctttagccatttgtggtgctttttagaaacaattactttactagtaataactatagttaagtcacgctggtggccaatgtttgtgccccaatcctggcaaggaacaaaagaggttccctgaacttattgtttttaagaagctaacatatttctatcaaatgccaaattaatttcatttagagacctaggaaacagtagttacctctattttgcttattcttttatgaagtcactgatttctaactattggcgtgatgtctacttgtaagcttttggttatgctccttagcctttttcttctttatatatgtttctaagtctatttagaaaacatattgaccaggtgtggtggctcacgcctgtaatcccagcactttgggaggccgaggtgagaggatcatgaggttaggagatcaagaccatcctggctaacacagtgaaaccccgtctccactaaaaaatacaaaaaaattagccgggcgtggtggcgggcgcctgtagtcccagctacttgggaggctgaggcaggagaatggcatgaacctgggaggcggagcttgcagtgagccgagatcgcaccactgcactccagcctgggtgacagagtgagactccatctcaaaaaaaaaaaaaaaaagaaaacatattttacattttttggttttcttattactcttcattgtcatctcaaattgctctgaaaactccagttgagacctgaacagtgaagacagacagtttttcacacatcttgaaaattccatttcttatttttcctgatgtcatttgccttataattatttttttcaggaagaaaggagaaaggaagaggaggagcaacttctaattaatttaaaattccgcagtgaatccacctctctatgtaattaaaaatagaatacaatactacttcaaaaatattaaaagaatggtcatgtccgttgtttaaaaaaacaggaaaacaggcagtctggtgtcttggagtgtgaaataggacaaactttctggttggagtgtgaaataggacaaactttctacaaggcaacacgaaaaacatttttaaaagcattaaaattttgtatgccctttagcctaggaattccacttctaaagaagaatcttggccaggcgtggtggctcatgcctgtgatcccagcactttgggaggcagaggcaggcagatcacttgaggtcaggagtctgagactagcctggccaacatgtgaaacccaatctctactagaaacagaaaacaatagctgggcatggtgatgtgcaactgaaatcacagctacttaggaggctgaggcaggagaattgtttgaacccggctggcagaggttgcagtgagccaagattgtgctactgcactccagcctgggcgaaagagcaagactccatctcacaaaaaaaaaaaaaaggaaagaatctcggaacaatgttttattacaagattgttcataaaagcattgcttataacaacaaaaattataaattaaaacaagattgagtaataaattaatgtacatacataagttgacctgcagaattctttataatgttcatggaagaagaaaattataaaattgtatggataccataattctatttttattaaaatattgtatgtatctgccatatataatacaaatgttgggaattaacatcaacatattaatttttctctagtataggttctctctagaaggtcaaatacagaaaattttttccttttcctttttttcttgatttaaaaaatttatgacaattaacatatgtaatttgagcagcatgaaaaatgttaatgttatttaaattatttaaaggctgaaaaatctaatgacagtgaataattagaacttttacaaattgcgtcttacttccatatgtttgctgtcaatagatgtaataaaatccaaaagtcaaaattagatttgatcagatcaaccagagcgaggggattaaagatctagatgtgcaaatgctatgacagaaatacaattacttcaattctcagatcactaagatggagttcccaacactgctatcttttctcagttttagtgtaccagcatcacataccttacatttgttattagcaatgctttctctaatatatccaacatacaaaccagaaaaaccctttcctctaatcatcaccccatttggtgatagctttttaaaatcagttggtctcatattaaaatgcattcaaatttaattttttgagaacagtatactcaaaaagctgagtcactgtcattgcatataccagtgatacttgaagaaagcaaatacctacatcatcctcttgcccatcagtgcttgcattgtggatgtcaggataatgtttcagaaactgggctacataggtcataatagatttctcatctggtttatccacatcaacgtctgaaaaaacaaaaaagaaatgtgaataaactaattagcattcattggattttgataatacaagtttggtatctagctatcacaccaaaaacgctaaacgcagaaggaaaacagaagtactatttagaattttggacggggaggagggtaaaccaaatttagtctggatattacatgatgaaaattatattactcagaaagatgacacatttaaacaaacagcgtttaagaaagtagcatatgtgtcatttaaataagacatacagtatctcatgagacagtatctcccaaatgggtgagatacggtatgattcctcatacagtatctcatactagttctattcatactagtgaatagaacacaaataatatgtaaattttagaactggcataaataggaagtacaaaaatgcttacaagtgtgacactgaatgacatatatatatatatacacacactatatatggccaaatatagacaagccccctctctgcccccacaaatttcactttagaagaaaggcagatgccttatattcaatttcctgggcagcctcctctttgtggagcattctctccaaattacagtgctttgagcaatcaagcactcttcgagggaaactcttcgagggcctgagaagccctcaatcactgtgattttgaagcttatagatatttatctaatacaaatggtaaaaatcaggcaaataaattcatacagatttagtaattatacatggaggtaagaatgcataagtaaaacgtgttgtaaacaagtcttttaaatatcaattttaaaggcaatagaaatgattatatcttacagagcaatttatagagcagaaagcaaaccaaattgccacaatgaagtataaaactaatctaatctttcgtaaaagttctttttgattagaggtataatttctagagacttgcaatatagggtttaaagagtgctgcaactcacactatttaaaaggaagcgaagataatgtattctgaaatttgttaaatgactcaaaggtgatgagtcaaaccgttgagtaaaacttttttttcaggaaatatgaaagtggaaagaaaagcaatatttaatacatgatttaacatagtatatgctgttaactatatatgtaaatcataaaataattattataatagcttttggtctacctaatctgtattcctaaaagcttatacatccaagttggctaaataactttttgaaggggaagttctcattaagaaattagaggaatgtcttatatctaggatagccttgtatttaggcaacctcagtttctaatcatcaaagaaaatattaagatcttctggtctggtggatatgaaagaatcatgcatattctcctttcatcccactctaggaataatgtcagctctgatacatcctctgaagtcgatggctggaatatgtgtttttcccttgatttatttttgtgcagaaagaaggcagaaagccctttgatatcctagtgaaagtggggtgggggcagagtgggactcaaaaacagaatcctaaaatggcaaggaatctccatggggcccttcatctcagaggaaacctaactgggtctctgtaacttactcttggaaacacaagtctatcctctttgttttagagctagggaagttcagtctgaaattccatctttaaaaataatttttggtggatcccatgaaaacagagagtagattggtggttaccagaggccaggaagggtagggaggagaggggaaaaataatttgctttcactgtatatttacatttctgcattcactggtagaaatgtccataattgccagcccaaataagaaattatctgtgacatttggaaacttcactttgatacttttgtttcaacataacaacttattagtttataaaagtttatcaaaggcatctaaattgtcttttgaaggcttgaaagagttcactccatttccaaaaagtcttagcactcacgcccttaccaaaaaacgtgccaaacaattgaaatgacaaatattagtcaaacatttgtgaagtttgctgattgacaccaaaacactgcatggttaacaacatttctaagtatgaataatctacatctttcagacctctgagattatatagagtaattatattatcctgtcacctacccctcatacacacacttctaaaactttcattccacccttaagtatattaagtccagttcacccgactgacataccaatgccaaagtgctgtttggagcaatgggatcatattttaccccaaccatggtggtagatatttatccagaagaaaattgatgcaggaaaataccattacttgccacttttctccagctttctggcctccaatagaatcttggaagtcatgtgtatttctgggtttaagacataaaaaccctccgtgttaaggtatataacagtcaatgaatattcagcctaccttcaggatctagcagtcttgggatccccagttctgtttcggcgatagtgaaagcatcctccaaattttctcggttggatctgcctttcactgtctccaagtccaccaattccggtcgaatggcatgaataactgaatgaaaggcaaccccgcttctccaactcttcccaaaatcttttacttctattccagtctgcctttgtgttataaaaacataaaatgatgtcacattctgaatagatacaagcactttcttcaaggcctcatgcaaaatccagtgcttttcaccaacgatatgcagagagctgtatcagttcattgtatttgagaaaaattaagggaaacaaaatttttagggggcaacaagataagatgtcgaaattctggttctatatttagagatttctatgttggatttttcagcaattaagatagttaagttaaagcgtatttttacatttattttatactcaatcccctacagtcctccgctctaccagctgagctattgaaggatgtttacatttattttataaagaaaaatcaatttagagaaaaatgtctgaaaaaattttaagaaaccaaattataaagatgccaaaagtgacagtaattaaccactgtaaatttttgtagaaagagctaacacgtttctaatgggaagcagcactgtgttgtacacaggttatcacagactaagataatgtggctgaatactttcaaatgcagtagaatagacaaatgcaaatattgcaattatatctcaaagtgttcacaaaggaccctgtattccacctaaatgcaaacaataattccaattactccaccaataaaattgtttttaagctcctttttggtaattgtcttgagggcaaagccgtggtggtaaatcttttttctttgatggcggatttgattaactcaaagccagttattaagaaactgaatcaagttggtagccatattttgcccttggaaaagagaagcgaggcaagctcacaatgaatgattttttttcctacatgtaacttatcaattataaaggcagttccgaaaacagagttgtaaagatgattttgagcatcggctgcaccccttgaataagtggagggcctgcaaatatgatcacttaactagggaacattcaatggataaagtcatctagtagcttctttttaaaaagttagtctcattaaccttagagatgtctctaactaaagcaaaaatattgctcaattaatttttactagaatctcaaaattttcatgaaaaaatacaacctgaatggtatgctgattaatataataagtttgtaagtgtccattattattattattatcattattattattattaagacagaatctcactcattctgttgcccaggctggagtgcagtggcacagtctcggctcactgcaacctccaccccccaggctcaagggattcttgcacctcagcctcccaagtagctgggatttcaggcatgtgccacaatacctggctaatttttgtattattgaatacaaaaaatacaaaaaatcaataagaatacaaacattttgtattattcatcatgttggccaggctggtctcaaattcctggcctcaagtgatccacctgcctcggccccccaaagtgctgggattacaggtgtgagccattgtgcacagcctatccttaaattttattgtagacaacttatcattcactttaaaacatgttttaccaatgtacactgtttgcataaaatatattatgcatcattgagcttgatcattggcttcatcaataaatatcctaaaaacaattttatgagactccagaaattgtaaagtaatcttgaatcttctctaattttcaagcttgtctctggtagtacagatataatttttttcagcagacagctgacagtcatgcaggttgaacagtatgtcctttctatctactcatttgtaatccaactctgacttcattttatttttctttgtccacatttcctcatttaaaaatgttttttatcttgttaagccacctcaaattagtttttaacaaaattaagtggggtgtaaataaataattagctaataaatattcaccatgtaattagctatttctaattttcttgaacttatgtattgttttagacattttcaaagagaaatacataatatgcttttctaaatatttactgtaatgaaataattaaaaagtttcagcacattttatttcttctatatttgttgaaaaaatatatgtaggtatgcacacacacacatacacacacactgtttcctattgtaacagttaaagtagtaggtaatattccttaaaagttttagttttagttcaaacctcttatttgagaattttagatatgaaccaaaagaaagacacagcatttaaagaagtgatgaacagtgcccaatttataagcatttctgacctctaatatgtatttacttcaagctgcttttaaataactacatatatgcatatatttatttattttgttaccttactaatttttgtcagaaaatataattgttcttcttataaatgtgacaatagttatgcaaatgtaagatatgctataacttaaagcttttatttctgataatatgtattgatagtggatgaaattagttttagcaattagagggcttaactatcttatgttactgaaatcatttttaaatttatttctcaaatatttttaaactttatacgaaaacagtggatacatcctgataactagtctagtgtttactggatgttttatcatttcccaccatcttcaatcttatgagtgtgatgaacttccaaactagagtcccacgaaatattatgattttaggaataacatcactcatacctcaaaatggatacagattctaaagtcttttacacatgttagataataagttgcttgaaaagtacatactgggatagtgtaaaaagcagtttttagaaaaaattatcaacagtttggtagcatcatggaatcatgtgttcattacagaatttttatggcagagaaaagtcatcgccccaaacctctacaatttatgcagctacaaaagaaatggattttattgcttgctcacgggtggagaaccctcaggcccaggattctggacattggcccagataaggaaagtaaaacttccactgatgttaccaacatataagttgtagcaatgactttgagctgtcaccagactcttgcacatctttgaaacccaacatagcatgcatgaaactaaattaaatgctggataactccaacagcattaaatttgagtttacttcaagctactgttttattaaaagaaaatcaatttgtttttggttaatttaatgtcgtgtgaagcaatggaccacagaatatcaccttgacattattacaaagtttaattgcaatagcatcgtgacacatcagtgtgcagtcaccagtcttctccctgcccagttaagttgtaagagagattagtaatgccactgtggatgcaattaaacagtgttccagcaatgtgggaagggttttttatttcatttctacttcagattctaaagagccacaaagctttgttttcagaaatatatttgactacaacttgaatcatgaaaacatagcccaaattagaaaaccagcaacacactttaaaagttaaacaaaacaacataaactagcaacactaattacatcctttgtttctctttttatttttttatttttgctcttcaaacaccttaaaaatagaactccctatgtttagtacctcaatattttataagtacttgtttacaactattttccagaagtagagaatcaaatttagattacatttaagcatgcaaaacaagataaaaaatgagtaattttacatgttgtttaggaaaatcaaacaaaagcatactctacatgaaaggacttacccctgatcacatcagactacaaaatacttatataatcaactgaaaactccattgaaattgctatgagaaagtactttttgagagcactctttttcttttttctttttcttttttttttttttttttttgagatggagtctagctctgtcgctcagactggagtgcaatggcacaatcttgatctcagctcactgcaacctccacctcccaggttcaagcgattctggtgcctcagcctcccgagtagctgggattacaggcacgcgccaccacgcccagctaatttttgtacttttagtagagatggggtttcaccagattggccaggctggtctcgatctcctgacctcaggtgatatgcccacctcagcctaccgaagagctgggattataggcatgagtcactgcgtctggctgagagcagtcattttctatccactattatcatataaatgtatacacatgtaaatttattatgcctagaggaaaactgaaaactagatgcaaattctcagctcacaaagctagagttgacaaaaaaatctacactctagataaaaaatgagaccaaagggaaaaaatttaaaaactaaaattgctagaaagtttcagaacataaaaaaaaaatgtttttggaatgtgtaccttagttcacacagttcttaaatagaacataatagtctcatgaagagataaccgagtttaaacttcaagtttatttatataaagattatttaataggagcagaaactctaaacaatgacctaaatagaattatccctcatgctactcaaagtttaggattagtcagtttaattaattaggcccaattgcatgaataaagaaaaaattaattttttaagagcattttcctagagtattagtggtgatttgtgtttatatctcaattcaaggcaagagtgaaataagcgctaaagcaaagccattcattcaaatgtctcttcacatttcgcaatcattagaagttgcaattagtaacattcataactcaatttaacggtttcaaatttagacaaactcttgatacttacttgccagctgtgtactgaacccactttaataaagccttcttagcatttccttggatcttggtggtcaccttccgtttacttggtgggctgggagtctcagagctaactatgctgtccacggaggatgcgctgctggacaaagactggagctggggcaggttgctggtcaactcttcaatctgtttgtgagttaacagccagcaaaaatataagcattatctttgttattatttcctcagatgttttacttttccagcaacaaatgagttatgttaacactcttgacattcctgacaaaatgcaagctcttaaagggcatgattgatatcttactcctctttgtacttcccattgcacccctagtgtatcttacatacaataatccatatttgtagaatacatgaatgaattaatcaactaaaacctaatggttagaacaattattctgaatagaatggcaagttcattcctccccttcatgtctaaaaggagtttagaagtgctcctttccaaagaaaaaagaaaattttcctgagctccttctgcaacaatatttcatctccatcttgaggtgctcgcttttcagattgggcacctctgctggagttcttcggggtgtgaggttccacatgcaacagctttgcaagggagaagaggaaattctcctaccaaagaaacaacgtatgtgtgaaaggtacatttctgctaagttaaggatcaaccccaaagatatggcaaatgagagcattattaaaatggccaccatgatctccctctgagacattgcatcaactgaaagaggaactgtagcacaatacctggaaatatagaataatggtccacatcaatccaagaactattgagggtcggccatcagctatatcggtggagttaatgttgactaatttaatctgtttaaaaaagagaaactgtactagtaatgtactagaatattataactcatttaattatgtaacaattaggcctttagtagacatcaataagatttgatcatgcctatgtaatagtacatgggagtaagtagagtgaggcaccgaaacaaacaagcacaaggtttcagtgaaaatttcagggggatttgttaggtgtacaaagtaaaaactataaaatggatttcagaaacttcttttgtttaaagttgaaaaaatataacatgcaggcaattaccaacaaaaatgtcaaacagaaaaaaaatgttattatttatatttagaggttgactggagcttaaaagaaactgcaatgagaagtttaagaagatgcacttactttgaagtttgttaccaaatagcaggtaacttatgttcccttttacctataaaaatcaggagttaagaattctaaaatttgtactaaccggtgatcctctgtgcatggactgacatgaaaaacaaagggagaagataatagatatacataaatcatctttcaaaatcagcattatttgttcaaagggaataaagaggtaggtagtcagtttagaacctgactgtggtaatacgttttaaagaaaaacaaaggaaaggcaagaaatagcaaaacagagcctattagcattcagttccctacttttgggtgatgacatataaagcattaaggagagacgtcaatctatgtacaattgacccaaattattcatgctaatgtttttcatccactacaaagttgtttgctaagtcccaacaaaatggacttacatggttaagtctatctcattcaatttctatagcctaccatcaaaaacatccttttaataattcctaacaaatgaaaacaaataataataaagtacccttcagacctctagctcaataattctcagccaagatttcatgaagtgtgttattaataaaaagctcagatgtttgtacattttttttatttaaatttgtgtcagatgcaaaatcatttcacaaatactttactcttgaaagtttaaatttactagttttacatcacagaggtggagtaaaagctagcacaaaaatcattgtaaatgatttgagatatacctatgggatttttgtctcactggtgaagttcattcatcaggttcaatgacaaaaaataaaaattgagaactggtatagattacaaacttgtatatctacttcctttgaatcaatcagtataagacgtttaagatatctttatggaaaataaagaacatcaatttttttaactttttatgaaagaatctactatgatctctaggatcattttgagagcttcattttacaacttctctagaattttctccacatccattttagcatacatacacaaaaaatttataatatatgctaatatccataagattaatgaatttcacaggggaaaatttcttccttttccttgtgcatcattttttaaaaagtgctattgaatataatttgattatcctacctcgacccagttccaattgtacttgaaattgtacattgttaacatattcaatttattacagaagctaaaggatcttttgcctaacttgtgaagaaaaatgtttttcatgattatctgccccaaaatgtgtttcacaatgagtttagggagcacaggttggtttgtctgtttatttaacctcccatctcttgcaaaatcctattgaacttacaatacattcttagtagcctaggagggtaggatgggcaatagagacacatccaaagagaatgaagaatttccagaagccagaaggaagatgggaccatattgacagataaaaccagagcagaaggatgttgagccagatgttctcaaagggtgattcccagagtcgcagcaagcacgtcacctggaaacttgttagagatatagaatctgagacttcaccttggacccattaaaccagaaactaaggaagtgagcctctggaaagtgtcttaaaaccttcaggtgattctgatgcacattagtgcttgagaatcctggactagaccattgtacctggcccatgtaatctggagaagtctgagttataagacagaggcttgaatggaatgaattattatttgtgtccctccaaaattcatattttgaaatgtaactcccaatgtgattgtatttggagaatgagtctttaaagagataattgaagttaaatgagttcataagcatggggccctaatctaatcagatttttcttttttagattagtctcactctgttgcctaggagggaatgcagtggcacgatcttggctcactgcaacctccacctcccaggttcaagcgattctcctgcctcaactgggattacaggcatgcgccaccacacccggctaatttttgcatttttagtagagatgaagttttgccatgttggccaggctggtctcgaactcctgacatcaagcaatctggccaccttggcctcccaaagtgctggtattacaggagtgagccaccacgctgggcccagtgagattagtgttcttaaaaaagatgaagaaaaactatcatcagagtgaacaggcaacctacagaatgggagaaaatttttgcaatctatccatctgacagagggctaatatccagaatctacaaggaacttaaacaaatttacaagaaaaaaacaaacaactccatcaaaaagtgggcaaaggatatgagcagacacttctcaaaagaagacatttatgaggccaacaaacatgaaaaaaagctcatcatcactggtcattagagaaatgcaaataaaaaccacaacgagataccatgtcacaccagttagaatggcgattattaaaaagtcaggaaacaactgatgctggagaggatgtggagaagtaggaacgcatttacactgttggtgggagtgtaaattagttcaaccattgtggaagacagtgtggtgattcctcaaagatctagaaccagaaataccatttgacccagcaaccccattactgggtatatacccaaaggattataaatcattctactataagggcacatgcacatgtatgtttactgcagcactattcacaatagcaaagacttggaaccaatccaaatgcccaacagtgatagactggataaggaaaatgtggcacaaatacaccatggaatactatgcagccataaaaaaggatgagttcatgttctttgcagggacatggatgaagctggaaaccatcattctcagcaaaataacacaagaacagaaaaccaagctctgcatgttctcactcataagtgggagttgaacaatgagaacatatggacacagggaggggaacatcacacaccagtgcctgtcacggggtaggggactaggggagggatagcattaggaaatacctaatgtagatgatgggttggtgggtgcagcaaaccaccatggcatgtgtatacctatgtagcaaacctgcacgttctgcacatgtatcccagaacttaaagtataatttaaaaaaataataaaaaaaaacaatgaataccaaaaaaaaaaaaaatgaagagacgccaaagattgatcttcctctctacactcacacaaagaaaatgtcatgcaaggacgcaaagagaagggaactgtctacaagccaggaagagaagcttccccagaaaacaaccctgaggcaccttaatcctggacttcttgcctccaaaacgctgacaaaataaatttctgtagtttaagccacccagtctgtgatactctgctatggcagccaaagcggactaatgcacagctcacagatgtttaaaaaaatatttgagaccaggcgtggtggctcacacctgtaatcccagcattttgggaggccaaggcgggcagatagcttgaggtcgggagttcgagaccagcctggccaatgtggtgaaactctgtcactactaaaaatacaaaaattagctaggcttggtggcgcatgcctgtagtcccagctactcgggaggctgaggcaggagaatctcttgaacctgagaggtggaggttgcagtgagcctagtttgtgcctctgcactccagcctgggtgacaaagcaagagtctgtctcaaaaaaaaaaaagaaaagaaaagaaaaaaagtaaaaaatttgaattatttggaaataaatttcaaaaaactctcagtaaacatccatgttactagcttttcttcataaatttgaaaacttaatgaataaatccattactgctttccactagttgctttctacaatgaggtatcaggtacctcattctcaacaataatgcaagtagtcaactgcctgccttatttaatacacaatttaaaggaattttaaacattaattacattttaataaaagtccagacaactggctcttctttgtaaattagaaaaccagggatcacagttcttgcagttcactgaggttactttagttggaactatttgctcccctcttccagacaggacgcaggaccactcagttctcctgttaccacagttagcctggaactcacctcattcctttacatcacctttctggacctcacaggaatctgaatttatgtcccctgtctgcactatgatggtcagtggttggctctctgtattactgtgctgaatgatctgcctgacacctcattggagaaagaaacttgtggcaaatggtgatgaatctgttcaccacagtcacatttacacatttctcatcagattcttacataagttttttcaatagccctgcaaataagagaaaagctaaggacactgttagggtttccccagtaaaatgaggaataccttcattattccctaagtcaaactaaataagaataaaaggattaaataaatgtcctgttatcaaaagaaaaaaaatccaaatggaagacaaagtcagtacaaagatcaaagacaaatttctaaaaatatgattgagacataagttttaacttgtaaagatcaatgctaagataataagtgggagggcactaaagaaccctccaaaactcattacttcccacaggcaaacattttgtgaggccataggatacagaagtgcaagagagtgtggccgacaagaatgtttcagggagatgtggggaggaggtgactttaaaaagattaagagacttgtggggaaaaaagagaaattctttcattttgttctgattctcaagacactacttttggtgcttagcaaatatatttaaactttattttttttactttgggttgttccgtgaaaatggacattgtgaaaacaagtcttctttataaacaatgcctttcataggtgaagttgttaaagttttcgccaaggcttccaagttaataagaggaattttgtttttgtattccagccaatcaatataactcagaatgaagtaggacactgttgtcatacagctgaaatgggagaatgaatgacctgaaaaactctatctttattttttatttttattttttttaagagaaagagtcttgctctgtcgctcaggctggagtgtgatcacagctcaccgtagcctcaacctcccaggctcaagagatcctcccacctcagcctctcgagtagctgggaccataggcgcatgccaccacatctggctaatttgtttgtttgtttgtttgtttagagacaaggtctcaccatgttgcccaggctgatctcaaactccagggctcaagccattcacctacccttccctcccaaagtgctgggattagaggtgtgagccactgcatctggtcctgaaaaactctaaatatcctgtttaacaaggcttcattcagctttcaatgaaaaattaatgaagggtgagcagaaagaagagaaacccttcaataagaaagagattagtgtgatctggaaacactgcctgatattgcataagaagctaaaattgttttgcacactatcctaatgcctggaatctctcttgggcatgaaatttgcacaattgactgaaatgtatactgattcattgcattaccaacttatcaacaatgtagattatttaagggctagaatctaagttttctgtaaatttgtattttctagagttcctgtcttatagaaagtcatcaattatgcatttgtaatctaattaattcagtgcatataaactgagaaggaaataactgaatgggtctattttctaggagtatctggatctccatttataaaactagttttggtattactaagcacaggcttcctcaattcccacaaattagaaaaggctaaatgtaagaggattggtgcaacccttttggagggaaatatggtaatatctaccagaattacatgtgcatttaccttttgacttagcaagcacacttctagaaatttacctaggagatacacctccaattatatggaagcacttatgcacatagttattaactgcatcattgtttgtgttttaaaaatactagaaacaacccaattcccattcataagagagtggttgaataaactatggcatatctaggcaatgggacactgtgtaactgtaaaaatgagtagagaaatcactatgaactgatgtgggatgatttccaggacatattgataagtgaaaaaagcaaaatgcatttatggtatgctatccttcatgtaagaaagacggggatatatgaaaacacatcttatttgtggaaaaaatgcaaaatgtatgtcagaaactagagagactggttatctaaaggtaggaaatgcagttagaggcagggaatgagaatggagtagtagggatgagaaaggagtttgacttctttaaataaaacgtttattattttagaaccataacaatgtcccactctttaaaacaaataaaatcgaccaggatgggggtggggcacaaaatagaacacaaacaacaacaaatgaacctatctctataacagataatgacataatcccactgacggggatggggaagaatagaactaacctaagaacatttcaaaaatagttttttgactggatactgtaatgctaaagacaaaaagaactacacacaaatcctgttctctagtttgtaaatctgtttctcacaggggcatgggttagtgacatactagatgtgtatactaggtgatatagtttgtatacatgtccccattcaaatttcatattgaaatgtgatccccaatgttgaaagtgaaccctggtgggaagcgattgaacaggagggcgagttcttatcaatagtttagcaccatccctcttgggtaccctccacacaatagtgagtgagttctcgtaagacgtggttgtttaaaagtgtgcagcacctcgccccttgctctcttgctcctgctctggccatgtgacgtccctgctccccttctccttccgccatgattgtaagcttcctgaggcctctccggaaactgatgccagagctatgcttcctgagcagcctgcagaaccatgagccaattaaacctcatttctttataaattactcagtcttgggtatttctttatagcatgtgagaatggactaacacactagggttgaaaaaataagtaaatatattgtagatgagagtaagccttctcattatcagagaaagcagaaacaaggacataaggccagagtaaaacttgcagtgtttaacttgaatcagaggtattagtctgaactaatgttttacccacacgtgcgagaagctacatatgtatatgtgtatatacatgtacacacatacagagatagagagagagagaggagagagagagaagcacagatatatgtatatatatgagttaataaacatatacaattgaacaatgagagcacatggacataggaaggggaacatcacccacccgggactgttgtagggtggggggaggggggagggatagcattaggagatatacctaatgctaaatgacaagctaatgggtgcagcacaccaacatggcacatgtatacatatgtaacaaacctgcacgttgtgcacatgtaccctaaaacttaaagtataataataatttaaaaaaagaaaataaataaataaacatatacattttctaatctatttgctgagagggcctaggagaaatgatgccccagtagcaatgaaatacttagcatttagatcttggtttctaaatgccactcatcactaaaaggaacgaagcctctttagagaagtggttgattccaggactggggagggaaaatttaagaaaaacctggaatatctgtagttctagcaaataaaaatctgcttgaaaaattatgagccaatattaaaaaggtacaggtgcaagcctgaaggagctcttagcggtcaaagctagaacaatttgagtgacaaaataataacaatgagtataatgatgaattttaactacgtaacaaaataaatatacatgtgtccctactggaataaataattgaataaataagtaaattgtgggggaggacatctttttcttacagaacaattccaattaataaatatagaaggaatgaggaaaacagaaaatcattaggcaagtagcacagaaataattattgaaggcaatggatactaaaatcagtgagcaaaagtttgaggaaaagcagaaacttagcatagtctcaattatctctcctaagttatttcccaactataaagggaaaaacagtgactctaccataggaaagcatggcagacaccacattaccaagtattcaaagttaatgtaaccagtaataagacatatcagcaccctacatttactaatatggtgcactgggaagaatatgacatcactttcttgggactttttccaaaaatgtctaaactcaacctaatcacgagaaaatatcatacaaactgaaattgagagacattatgcaaaataactgaccagcagttatcaaaagtgtcaaggtcatgaaagacaaggaaagaatgaagacctgtcatagaatggaagacacaactaaatgtaagatgtgatactagagtgggtcctggaacagacacagacaatagagggaacattgatgaacttggactaatgtctatgttttagttaatagtatcatcccaattttaatgtccttactttgataattgtattatggttatgtaagctcttaacactagacactgaaatgaactgtagaaataaaatttcttttttgcaacttctccataaatctaagagtattttataatacaatgatattgtatgtctaggctgtatagattacatgccatcctcctatctgactacagataggagccaatactgaaaacataagtatgcccacaccttcttccttgggcattttgtttttgtttctctcttacctttcttccttcgaggaacttgagtgccgtgccaatgttagccacagcatggattcgcttcatccggcgtccttgttcacaaggctgtaaaaagtggggtaaaaaagggaatgagacaaaatctgcatattaaaatgttagttataagatctatttaaatggattaaaaatatacttgaagaatattcaaaagcaaccaacattgttcactttctataaaggttagcaaatacataaaggggtgttccccatggcactctgaagatatactaattcactcaataagtgcattcattctcagattatctgttaatgcatttgccttttagtcttctgtatgtctaagagcagaaattatttactgagacctctgttagacacgacacagtctcatcattggtctgtgcacagcccatttatttagcttattagttaattatttttaaaaatgtaaaacacacccagaacctgcaacctaaaacaaagtcaggacccacaactaagtatgaaagccatatcccaaaatatgaccaccattaatcccatcctcctatctgactacattgagggcacccgtcatactaactccagtctagtgtttgccattttatagagattcatttctttcacacgctttcttaaaaagaatgcttagtttttaattttatatgaagagcatcactgtattaatcatttgagacctacttttccacattatattgctaagattcatcatatcattgcctttcactgtatttcattcatttcaaaagctacataatgtgctatttctatactcttcttctgatatgaatgtgctatttccaggttattgatattttgatatgttgatgattattcttgtacttctcaccttttgtacaagcacagtttctcttggacatgtacctgagagtagaattgctgagtcgaagggaatgtgacttccatttgtaaagtaatatcaaactctcctaaaatggttgtactactttttattctgatcagcattgcaaaaataatcctgctaatctgtatcctctccaacatttgattttgacagataccttaaacatacttttttcaattgaatatatgtaaaatgtatatgtactctttttcattgcagtctccatttacatttccctgatcagcagcaatggggacttctcctcctctgttcattggtgatgtgagtttcttctgcaaaatgccttttcacatctgttgcccaggttttcctttgggttgtttgcacccatattgttttgaagatgtattttatatattcctgatttaatccttttacaacatgaattgtgaatatcttcaacaagtttgtaacttctgccagttgttttaaaggtttttaatttttaagatagtcttaattttaatatattaaatatagcaatcttttattgtcaatatttttgtgtcttattgaataattgttttcctatccctgtgtctaaaacatattcacccatgttttctaagagtttagagtgttactgtcagtaggtccttaattcatgtagatttaatttttgtataggccatgagataagaattcaattttacctttttctgctagaatgaacttaatttcctgttccattttttttaacttcaataacttttagggtacaattggtttttcgttacatgaaggaataatatagtggtgaagtctcagattgtagtgcacctgtcactcaacatttagtttttgatccctcacccctctcttaccctcatccttctgagtctccaaagtccattataccattctatatgccttcgtgtacccatagcttagctctcacttacaagtgagaatatatagtatttagttttcaatcctgaattacttcgcttagaataatggcctccagctccatccaaattgctgcaaaagacattatttcattctttttttatgactgagtagtattccatggttgtatatatatcacgttttctttatccactcactggtcagtggccacttaggttgggtccatatctttgcaattgtgaattgtgctgctataaatatccgtgtgaggtgtctttgaaataatgacttcttttcctttgggtagacacccagtagtgggattgctgtatcaaatggtagatctacttttagttctttaagaaatcataccgtttttccataaaggttgtattaatttacattcccaccagcagtgtataagcgttccctttacaacacttccatgccaacatctattgttttttgactttttaataatggcgattcttgcaggggtaaggtggtatctcattgtggttttaatttgcatttccctgatgactagttatgttgtacattttttcatgtgtattacttatttgtatcttgttttgagaaatatctattcatgtcatttgcccacgttttgatggtattgtttgtcttttttcttgctgatttgtttgagttccttgtagattctgaacattagtcctttgtcagatgcatagtttgcaaatattttctcccattctatgggttgtctgtttactctgatgataatttcttttgcttgcagaaactttttagtttaattaggtccatttatctatttctattttagttgcatttgctcttagggtcttagtaaaaaattatttgcctaggccaatgtctagagattttcttctagtttttttttctagaatttgtatggggtttcaggtcttagatttaagtatttgagccatcctgagttgatttttgtataaggcgagggataggggtccagtttcattcttttacatgtgactatccagttttcccagcaccatttattaaataggatgtcatttcttcaatctacatttttgaatgctttgtcaaagatcatttgattgtaagtatttggctttatttctgagttctctattctgttccattggtctatgtatctacttttataccagtatcatgctgtgttggtaactatagccttgtagtataattcaaagtcagataatgtgatgcctcaaattgttctttctgcttaggattgctttacctatttggggtcttttttgcttccacgtgaattttagaattgttttttctaattctgtgaaaaattatgttggtattttgataggaattgcattgaatctatagatttctttgggcagtatggtcattttcacaacattgattcttccaatctatgagtatgagatgtgtttccatttgtttgtgtcatctattatttctttcagcagtgttttgtagttctccttgcgagatctttcaactccttgattaaatatgttcctagatattttttgcagctattgtaaaaggaattgaattactgatactgatattattctcggcttggtggctgttgctatataaaagtgctactgacttgtgcacattgattttgtaacctgagactttattgaatttgtttatcaaatctaagaattttagaggagtctttagggttttctaggtatccaatcacatcatcagcaaacaatgatagtttgacttactcttttccaatttggatgccccttatttcatttccttgcctgattgttctggctaggacttccagtaatatgtttaaaagaagtggcaaaagtgagcatccttgtcttgttccagttctcaaggggaatgttttcaacttttccccattcagtatgatgttagctgtggatttgtcatatatggcttttattattttgaggtatgtcccttctatgactagtttgttgggctttttatcattaaaagatgctagattttatcaaatgctttttctacacttattgagatgcccatatagattttgtttttaattctgtttgtatgatgtatcacatttattgacttgcatatgtcaataaacacttagaatgacacataaacttcttgaatacctacatgaatattcacataaagattcctttaaccttcaagaaaatagcttaattcaggaggatatatctaaatggccagttatatcaggtaatcaagggagtatgtatttcaatctaatgactcccacaacctaatgcttatctagtatctttagctaatgcatatgcctatatacattccaaattgcctgttcatatatgtctagcttgattccttccaaagcagagcttgagacaagcacttgggtgcatgtagcttactagggaggtgatcccaggtggcaagaatgaggatgtgtggagagcgagatggggaaggaggaaaagctaacaaaggatgtgctattgagggttactgctattggcaactggaactcagtcccactgatgactctatgggaactctataagacatgtgtaaaatatgcctcagaatcacctgtctcagaattaccctgtaattttagggtggagcatttattcatagactcccatatccattggttgagggtcccttggtactactaactccccaacacttcaaagctgctctgtgcaacttgtgcctttaagaaaagccctgaggcagaaagccagacagatactacgagtgcttgaagaaagaagctgtcagagtatatgggaatgtctaccactgatgtagctgagatgagacatggggtgccagaagcatctgctacctgggaatccaattacttaaacgactgatgcaaaattattaccagtttatgtttttcaacaaacaactcttacaaaagctatttgagggctccctgtacaaaatgaatggaaattaattttgaagaggtaaaaatcctcttttaaaaactcagttatccaagtaataatgattgtgtcattattgccaagatacaagtgataaagaaaaaatggactttcaattttggactctgtgtctagtgtgttatccaacatcttgaaaattatttcctgaattcctttttccaaattatggtaaacattatttataaataatttatgtttacaaactacttaatgctctactactctgaaatgaaaaagagataagcaagaagagataatttattatttgacaatgtagaaaatgtactttctagctcactgttaatgttgtttttcactctgctggctccacagcacataaaaacaactctgaacaggctgttcttgctacaaatgatggatgatggatgatgtcaacaagaatatgaaaaatgccacactggtttcctgcttaattttcaataaacaactatataaatacacagatatggaccaacatttctttctaaatggaagacaaacacttaaagtgaggaagatggtaatttgcaactaatcttcttgtataccgtatagatacaatggttaatcatgttaagttactgatgaagttctttactcttaattgtaaggttgttattataaacataacattttaaatgcactaggggtttgcaggaacaagaagggaaatatattccttgcacctagaagtagaagtgccagcagtgtttccagtatactaccaaccacgacaaataactttcttttacctgggcagcacatcttagcactctcaactccatagtccccaaattccaaatggaaacaatttgacaagtatgatcacacaaaaaaattcttaccagtttctgcccagacaggacctccagaagggcaagcagtttaacaccatctttcatgtcttcaaaaagatcgtccaccaccattggaggtttccgctgtaaaagcaaagaggaataagtgcagaaaatatctcttccctctctgtttctctctttctctctctcacctttgttacttatggtggtgaaatttgtaggagaggcttctatatactttaattctttattttggattgagttgccaattgcctttcgataactgtgagaagaaaaacaatccagtggagataaaactcgatattcaaaaacctcagaagatttaatgcttgagccttaatgtatgtaccagcttctttctagaaagtgatttttgacaagggcaggatggtgtgggataagggaaggaaaagaggatactatcaacctaaaagataagagagagattatagcaggacgtaaaagcagagcaagagctgcatggaccaacctcagcttaactttgtgcaagacacattactggggcttaacaaggtgcagcccttctataggacattctcaccacagcaacctcattagctcagtgacctgctagaggagcactgtcagcagagctaaggttgcaggttcaatcttcctgtgggttagttagctgttatgttgtgttctacagcctggtgaatctagcgaaccttctttcagtgtggcattgaacccaaaagatcataagcacaaaagtacagaccgatcagtgcaaatctatcatcgctgctggaaaaataagccaaagaccacctttaattcatggagcatcttttatttttttatgaaggttattaaaatactcaatatatgggaattcatcaaacattgaattagggtctatcttggctcaggagaaagtaaagaagccattatgccaatgttgatggtcaatagaggggaggtgttcactgatttatcacagaatcagaatttgttttccatttagcatctgaattcaaactttatagctttctgattcttactgaatcttgttaaaggcctaatgctcaattcctgactttcaatgttctttctttctttaaaaaataatgtgttctatgtaagagatttaactccaaatgtttggttggaatgtaactttttttctctaccaactgatgtagagcatttatatttctcttacaactgcatgaattataatgtctgaatagtacaattctaagttaaaatgtatttttctctcattataaaatgaatagctgaatacattttgttctcatgctgtgaaatacatgttcaaaaataacagagttttcatttttgatcattctctttcaaattccaccattcacgctgcttcttacttacatagcaaaaatgtaatagtgactttatattctaagcatataaataaaattcatcagaataaaagaagccattacaaagaaaactatttggtgcaataagaatcaaaattattgttattagccatatacggtcattaaaaatgcagtctatttatcattcaaagtaaccacttgtacccaaattatttaaatcaagcaaaacaatgaggaacaagttcataaatgtttgatacattcagtgagcaaatgcaaataaaatttttcatgcattgttataaatatgcaaaaagtaaggaaagcagggaattctcataaaataataaagatttcaagaaattttgcacccaaaaatgataaaatgcacatcttcatctgtttcgattttaaaaatacacaggtgtctgccactttgaggaacacgtcctctcacctcacttctgcctctcttctttccctcctctgttgctactcatgctgcaggtgctttccttttccctccagctgttccctccacaaggctcctggaattggccttccgatcagcagcgacagctgaacagctcagcagcctactggcccctctgcatgggacattgccaataccattctctccctgatctgttcctacccaaaactctgtgaccagactgcctagttcacagccctttctctttctttctcctctcttcttcctaaccatggccattcaccactcaatcctgagtcctttgttctttacaaatttttttctgcttatacatgactcttaaatccaggtaagcgacctctcctaaactttgtcaaacatgtggcaggcacttcatatctattgctggcttgctggctgactgactgactgaatgaatgaatgaatgaatgtaaatattgtgtgaagccaataaagagactttattacaccagaataaaaaaaattagtaattactggacaagttttgccatccagtttgtataaggtattctttatatataccaaacaatcagttagggggacctttactatgatgactacctcacatttaatttttggaacaatattttaatagaaaatctttcagctaaaatatttctcctgtcacatgtacaaatatttataccaccaatatggtgactttgataagacttgggtcatagtgctgaaggtcaaaagggagagttagagatgcagataatttattggatcttgacttaatggaaaataaagatgtgacttgagctggcttgtgtccatgccagtatatgttagatatgttagtacatacgatgcttctattattacgtttttagtctttcttaaattcacttttagaagttaataaagttagtgtttctagtacagtagcaggcacttcagctgatcagtcagtactttttctattgataataaatatgaattacatttatgggtttgtgtattattcaggaaaaattaatgttaataccatcatttttatactaagcttcctgtctaacaaggtgactcaaagtataaaatcctgggctctaatccgagtcacttagtgtctctgagattcagattccttgcttttaaagagaggatggtgttcccataggtagtggctgtgaatattaaacaagatagcaggtaggagtccacagaatagcactcagcacacttagatgtttaacaatattttattcatttttcttctcttcctattttattatctttctccttttatccttatgaaacactcactaaatttgagtaatatctaagtcatagaaatacctactaaatattggaatttatatattgtatgtagtctatagaaggactattttgtcataattactttatgcatgaacattttttatttcatatataatacttaaatgtgagaacttcttaaattttcatttcatactgtatgtgagtggcctgagctgggcccatcatattctctgcttgggtccagaagatgtctgggattacattgtcccatggcagtgacctagggactagtgtcatcaggtcatgctgctgaggtcccaagagccattctgactgtccttctcacaactgggttagtcagtgtgttgggggctcccaagaacactttcaggcttgatgattcactaggactcagaactcagaagtgctgctgaactcatggttacagcttatgacagcaaaaagatacagattataatcagcaaagcaaaaagacacatgtagtgaagtccaggagaaactatgcacagtctttcagaggtgaatgacctctcccttcccagtggagtcacatgaggatgtacttatatttcctagcaatgacatgtgacaacccatgtgaagtgttcccaaccagggaagttcccccaggtcttagtgtccagggttttactggggggtctatgacatagacaagcaatatccatgtgactgacctcagctactcagctccagctctctcccacaccctcaaccccagcaaaaaaaaagttaacccaaatcacattattagcataaaaagatctatcaaggtggtacagtattgccaaggccccaggacaaacaaaaactgatgttcactataaatatagtgtggctcaaggtctcaggcatagaaaaccacactactggggcagaatattccaagggctcagattatctcccagaagccagccaaggtctattcttaaagacaggcccgtctttggaacacagcatctgagcaccgcaggcctgctgagttaagtctgtcttgcccagttggcttttccttctcatactttgagacaactagtagcctttcaatagctctttcttcttggttaaatcatctaaaattaattttatttacttgcaacaaaatgaggcacaactgacgtgtctaatttcttagtgtgtaaacactattctgagtgtaacaatttaaatatcagtgtctccccactcccactcacataagtgaccaaaagtaaatttgttctgtaaaacagaagtgcatatcttcagaagaacctaattgtatggtttttttttttttttttttactaaaacagtccccctttatgtgcagtttcaattacctagggtcaactgtagtctgaaaatgttaaacaaaaaattccagaaagaaacaattcataagttttaaattgcacactgttctgcatagtgtgatgaaattttttttttttttttgagacggagtcttgctctgtggcccagtctgtagtgcggtggcacaatctcggctcactgcaacctctgcctcccgggttcatgccattgtcctgcctcagcctcccaagtagctgggactacaggcgcccaccaccacacccagctaattttttttgtatttttagtagacacggggtttcaccgtgttagccaggatggtctcgatctcctgacctcatgatctgcccgcctcagcctcccaaagtgctgggattacaggcgtgagccaccacatcccgccgtgtgatgaaatcttaagctgtccctgcctgggacatgaatcatccctttgcccagggtattcatgctgtctactcaacctgacccacctgcttgtcacttcatagttgtctaggttatcagatcaactgcctcggtatcacagtgcctgtgttcaagtcatccttattttacttaataatgaccacaaagtgcaagtgtactgatgctgtcaatttggatatgccaacaagatgctgtaaagtgtttcctttacgtgaaaagatgaaagttctcaataagaaaatgaaaaaaaaaatttgagattgctaagatccatggtaagaataaatcttttatttgtgaaactgtgaaaaaggaaaattggctgtcacacctcaacaaaagttacggccagagtaaatgataagtgctgagttaagatggaaaaggtgttacattggtgggtagaggacatgaacagaaatgtgttctagtggatagtgatcaggttcagtactgtctgtggcttcaggcatctactggggactgagacatgtcccttttgaatgtagtttaactttttaatttttaaatgtgctaaaatacacataatataaaatgtgccatgttaatcttcttaagcatacagttcagtagtgttaaatatttccacattattgtgcaactgatctccaccattttcattttgtgaaattgaaactctgtacccattaaacaacaactagccattccctctgcccttcagcctctaccattctaccattctattttcttttgaatgattttgactactctggatacctcttataagtagaatcacacagtatctgtcattttgtgactggcttatttcacttattataacgtcctcaaggttcatccatgttgtagcaggtgccagaattccatcctttttaaaggctgaatcgtattccattgtatggatataccacatattttgcatccattcatccatcaatgggcatctgcattgtttccattttctggctattgtgattaatgctactatgagcgtgagtgtattaatatctcctgaagaccctgctttcaatttttgtagatatatacccagaagtggaattgctgaactacatgttaattctatttttatcttattttttgaaaaactgacatattgttttacatagtggctgctttgtggaagaatagaaacctactttgaaacattactagcatatcatcactgtatgaggtacaaatttctacaaatcttctacaatcttagaatccgtattgaccaatatcatgcagctataaagtagattttcagtattaataatttagtatttaacaaagaaaatgataaaatcacctgtctcacaccaggaccatctaggacctcatttgccatcatccataatcacttttagtcttctagtaaatggtttttacttttgagaaaagagctctcaaaacattttatcatcaaaaaaagctacaatattttactttaaactactaaacacatatcctatggcttaatatttgtgattgctaggtacctagtgataccaataaaactgaaccagaaaatgcttagaagaatagcgcatgccacagttaagtatttacttcagttgaggcacacacactattgagcacagtcagggttgctgaacaggatgaagagtcatgacctgagatagtcacaacattttcttctgcagagcatgtagggaggtctcaaggcaagggttgactctccatgtgcattctgtgcacccttgaaacctctgtgcacagaacgacccataacttgtagaaccagataaaccactacttctggtttatataagtttcaggtaggaattatttcacaagctaagagattgtatatgtagaaaaattcccatcccaggaccagtctggagttttgcatgctctgatgattatcttctgggtgggaacagcaagttaaacaacagtaatatagagaagtgggaaggaagagaggttaaccagcagatatggagcaagtgacctccccaaaggttggcaaagaaccctccacagtatatgtatcaaaatgccaaagtatccttggaccagatcaagtaaatcatgattataaccactgacagtagtcaaataaaattaatgtccaacaggttttgtcattttattcagcaaatctaattgaatgtttccaatatcttcagaaacaaagtgtagtaatttaaaaactgtatgtgtaatctgcttctctttcactgcctttgtaacagcactgttgtgatcattttccacttctgcttggcaaaggtgggaaggtccttcccattcttttttgtttcctgtgacagatagcataatcctttccacttcctcgattatttaattcaattccgaataaatattccaaaggcaataattgccctccagctcagctttaaatctgcttggaaaactcagctctcaacaattttcagatgtaataaagtttgttttactatatagtataaaagcattattgtaccaagttatttatttggtacaagttggggttacccttgactcctctcttttgctcacactcaatatctgattcatcaacaaatcttgttggcttcattttcaaaagtcttccagtatccaaccacctctcatcacctctactgctactatcttggtccaagtcaccagtaccttggccagatggcttcaataacctctaacttatctccctccttctgcccttgcttctcttcagtctacgttcagcagaagagcttcttgatcttctttactgtccatctcccccattaggatataagcttcataatgagatggttatttttttttctgttttggtcactgctacattttcagcacctagaatattctctagcttattaaacagcattttaaaatatttgttgaataaatgtatgataaataaaatatatttctggttgggcacggtggcttacagctgtaatcccagcattttgggaggctgaggttggtgaattatttgaggtcaggagttcaggaccagcctggccaacatggtaaaacctcgtctctacttaaaatacaaaaactagctgggcatggcggtgggctcctgtaatcccagctactcaggaggctaaggcaggaaaatcacttgaactcgggaggaggaggttgcagtgatccaagccatgccactgcactccagcctgggcaacagagcaagactctgtctcaaaaaaataaataaatgaatgaatgaatgaatgaatgaatgaatgaataaataaataaataaaataatatatttctaaagaaggaactttgacaaatattaatattagcaaaatgtttattagtctgcataaactttgtgagatctagatctttgttatccataaactaatatattctataaataaattaacaaatgctattcattttgaaatgggaattttcctttataacattttaattacatatttggaaataactaatttattagaatgtttagggttgacaaattaaattattttttccctggctttattaagatataattgacaaataaaaattgtatatatttgttatataagatgatatcttggtatgtgcatacattgtgaaatgattaaatcaagctaattaacatatccatcatctcacctacttattgtagcttgagaaaaacaactaaaaaattatttgggggggtgaattattgcatttaccttttcctctttgcctctttatcttcctgtctgagctcattaatagtctcaccaaaatgtgtacaaggaaacagatgggagtaaaattctattcggaacatgtttccatgttatctttcagcactgctggtggaaagacaactaaagaagatgaaagccaccactaaagtgatattttatgactataaagatgtcatttaaattcatgattagcatggatttgtttttagaaaaaacatggaaaatccaaaatgttccttttaaaagactgtatgcatctaacttggtattaaaacaaaatgtgctcttaatggaatctgttataggttgaattgtgcctactcaccagagatatgctgaaatcttaaccccccaaaatgctgcagaatgcagccttatttggaaatagagtctttagagaggtaatcaagttaaaatgaggtcattagcatgggtcctaatccaatatgactagtgccctcacacagtggtgaaatttggacacagacatgcacagaggcagagactgaaataatgcagctacccagagacttagaaggagcctggccttcgagtctccagaactctgagataacaaatttctcattttaagccacccagtatgtggtactttgttacggcaatcccagcaattaatagggaacctaaataatgttttataaattttttttctgcagtttttctgaaaagtgagaagatgctcatatcatgcctgagttcatcccaaacacagtatttaaaatgttcagtgccttttgttgatggctccataaattttaggctgacagaaggataaaggactgctcattctatattgaaaagaagctccatttatagaaacactaaaacatggctatttgagacctatttttcctcaaagggcttagtgacaagcaatctatttatctcacagtcaaatatcataagattgaatcaagggtgtttaaataaagatacaatattccattctatttgataaaatgagagaaaatatgaaactgcaagcatttgataatagaaaataatcaatataaatattaagattgcttatacatgcctaattttaaacatctaactttttacaaagggtttttaaagattgttccctttgggtggctgaagtactaaataactacaacagtctatgaattttatataaaatgtaggaattttttaagatatattttaaaatgtgaaagaactatttttaactgtcaaattttaaatatattcatcgtaacataacttctttgcctaaaatgcaaggcctatgctgttaggcctaagacatccatggtcattaggtgagaattccttcaaatttaagtccatgccacctctgtcttcatctctctgcttatcccaaagttagacacagccacacccactttcctattcccaatgctagtctcagagaaggggagatatctctgctctggaacaaacctacaccctccacctctgctcttgatttcttctctcattctgcctcctcgggcgccttgttccttcagaatcccattcattgccttctttttcagcctctccctctctacaagctcttgatcattcccttctatacagatgcaggctcatgaccaccctttattaaaacagcttttaccaaatccaatgttctgcgccaatatatatagtaatatatatatataactatatatatagtatactaatatatatatagtaatatatatatatttatatatatactatatatagtaatatatatatttatatatataactatatatagtaatatatatttatatatatatacaatatatatagtaatatatattaagtgtactaacatccttacctctcatttactcatcagctcgctagagtctagtttctactataacatggccactcccaatggcggccaatgacttccaaactgccaaatcgaatgggttcacctttaccaactaatttctccttctaaactgaatttcctagctttccccccaagcctcttgtattccctatatctgtgaataatctcaatcatttgctcaagtcagaaatctagaagtcattcttgattccttcccctccaagattccaattaattactcagttctatcaagtccactcctaaacatcttttcagtctatccatttttctccatttaagcttagaactctaagcttctggttcataatctacaaaataataaaaataatgcattttcttgtgtgagggttaaataaataagagataaagttgctaaggcactgtaattggcacgtggtaagaatttaggaacatgttttctcaataagtgctgataagctagatgtgagtcagaaacttgactttgaaaaaccatcactaaaaatcaatattgggctaatttaataaaatactccaccttctttcattaacagagctaacagaatagaaagatactggtttcttcttgaaaagtgagaaaattataggttcaatgtctaacaatagagccccatccctgaaagaaattatcaggtatatgaaataacaacaacccgccaattgttaatgttatatcaacaatttgtgatttgcaatgttttacataattggagaagcattaagacttcaatttgataataaacatcaaaaaagaacagatatttatacccacaagttttaatgatctaacatttgtgtagtaaaaatagaataaaaacacaaacacagaaaatccttaggtttttttcttacttataataagatttttgttttaagaaaagcatatttttacttataataattaacaaatgtaaaaaagaaaaaataataaaagcatgttttaaaaaacagattgcaatcttatttgcatactatctcttcttattgctatcataatatttataaagaaatgttacactagaataaaatgtcatcagtaaaagattttttatttaattaaaagtcaaaagtatattaatttgcaactgagcaaagcagtcaagcacaaaaataaaaattcctattaaaaagtgcccctagatatacaatcgtgtcatctgcaaacaggaacaatttgacttcctcttttcctaattgaataccctttatttctttctcctgcctgattgcctaagcatcttctgaacagctcccagtgctcccaagatagaagaactttaggagaaaaggatcaacttcctttcttctcaactaaacatcccagctcttaaacctgccactacctattattaaagctatatttggaaatggtaaatttaactcataaacggtttggttgtcagtttatctgaaaacattccaaagcacagagctatgtatacctggattaccatgcaaggaaacatcaaacatgaaaggggagacaagctcatcactgccattattccagggttgagttccaacctctagctattaaaaactttgaagggtgttttaatagtgcaaggaaatggggattcttagaagatcttagaatatattaaaatcataattgtgcatagctgttgactacctacttctagaaatttatcctaagaagaaaatatcatacaagtgttcaaacaacgtataccaggactttcactgtagtattttatataatatgaaacaactgaaaaccacctaaataaccctccacaggcaactggctaactcatcacagataaacatgacaaagtttatttagccattacaataattacatagttctatctattgtcatggattgacgtgttgggtgaaatagaggctccagaacaatatcctataaaaccacttatatgaaactgtgtgtagaaaagtgttgtccaatatcttaatgatgactgtatctggattatgtgatataagattacttttactttctttacactttctaaaagtttcattattaatattattttcaattacgtaacctctgtacactatgaaaaaataataactcttttcattttgaaaaaaaaaaacaaaaccttttccccaatcgatgacaattccatagtacaaatagctgccagatgggaccaacggaagctttaaaaaataagccccaaagtcatcaatcctatgtatccactgcctttttacagagcagattgtggggcaactactgggccaaattcccttctcatcaagtgctgtggggaagagagcataggaaagatgaccctggtttatcctatatctagacaggtcgctctaggcttctttcatggctggattgcaagcttctcggggcctgggaaagtgttttactaattttttcctgtcttcaaaggctagcgcagacacaaagtaagcagtgaatctgtagaatgggactaaaatcaactgtcatgctttgtttgcttctgcgctatcaaaatggctttggggaagcccctgatcaaaacctgcttgtagggttgggctttacatactacaggcaccactctcagcaaaagtgagaataaaaaatttgaagataaaattgttttatcatctaattcatttaaccaattattgacttgaagggagagtcaacataacttccactatataatcatatagactactcctttaaaaattatcagcaaatcctctaactgaattcagacacaattgtcccatcatctgaatttatttttacaaatatgatgtctcttggcttgcttattttttcatcagcagtacaagagattaattttattatactgtatcaagattaagatttattttatattagcatttatgttcaaagacattataatatatagacatatagtcacctaatatcagtgaatgacagagtggataatactagaatgattttagccttttcatgtcctattaccatggttacttttttaaatcaaagcaccagagatgagagcactgatactatcataatatctttagctaaaatcttttgcttagcatagatcacttatagcttctttgtgttccaaataggaacaaacacacacaaacaaaaatccagcacaaattctccttttgatatgacacacacattagtattagaaaaaataattggatgaaatagtttctcaagattcacagaattgacatgaagtaactgctcttgactctagctataagttcatttcttcccagaagcaatgttagcaaattccactcttaggcaacagctagaccaaccaataagattacagtatcattgattcgcaacagtgacaacagggacagaagcattttgttatactggacatttaatgatttactggctcaacctaagtaaacctgtaatgctgggtagtttcctttaccttggccagatgagagttgatccattttgtgaaagttcgtttttgtactatctcttgctcatctagaaggaaaaagaaatctggttaaataatgtaatatttcatgaagctgtataatgagaaaaagtcctatttacacaaatctggaaggaatcgtgaaatcgttttctcattcattttaccaattattgtcttgaagggaaaagtcaacaagagtcgatctacataatcatatagactattcctttaaaaattatctgcaaatgctttaaaatttgccatttgttagccctatgtttaccttcatccacttacttaaaattcactgatgacttatacttcaacaaagctgttaaaaatgaaaattcaccaagaccactaagtgctgaattttatgctaagtgcaaaggaatacagagggttgaatagggcaaggtccctgctataaaatatctagaggtggaaatggacaagcaagggctatgaatagtaaagggttacacagtaatgcaataagatagagccgtatacatgaagcaaaaaaggaacttcacccagatgagaatgtggtgactacacactggagtgacctccaaaaattcccaccacatggagtccccatttttgtgtcggcagaatgtgggtagaacctgtgatttgtgtctagccaataggatatgacaaaggtgatgagatgtcacacttgtgatcatgttactttatgatactccagcttagctgactggagtgagagattctcctgctggcctagaagaagcaaccagctaggctgtgaagttcctttgcagagggtcaatggcaaggaactagaggctcccttcaggagtgaagtgcaatctcagtgaacagccagtaagacaccaggcccttgtcaaacagtcacaaggaatgaattctgttaacattgtgacagagcccaaaagtggattcttccacagttgagcatccagataagaatgaaatccagctgatgccttagttatagccttgtaagaccctgaacagataatgcagctaagctttgcatggactcctgacatgcaaccatttggagataataaatgattgttgctttaaacttcaaggtttgcggtactttgctatgtaacaagaggaactaatatagaaaggaaaagaggtagggtttggataggctttaattagaggtataaagagataataatgatgttggtagtttgacaggaacagcgttgaatctgtagattgctttgggcagtatggatattttaacaatattgattcttctcatccataagcatgggatgcttttccatttgtttgtatcatctatgatttctttcagcagtgttttatggttcttctggtagagatagatctttcacctctttagttagatgtattccaaggtattttattgtgtgtgtgtgactattgtaaatggggttgcatccttgatttggctctcaggttacaagttgttggtgtatagaaatgccactgaattggccaggcgtggcggctcatgcctgtaatcccagcactttgggaggccgaggcaggcagattacgaggtcaggaggtcaagaccatcctggctaacacggtgaaaccctgcctctactaaaaatacaaaaaattagccgggtgtgctggcgggcctctgtagtcccagctactcaggaggctgaggcaggagaatggtgtgaacctgtgaggcagagcttgcagtgagccgagatcgtatcactgcactccagcctgggcgtcagagtgagactccatctcaaaaaaaaaaaaaaaaaagaaaagaaatgccacagaattttgtacattgattttgtatcctgggagggggtgtgggttgaaaaactacctattgggtaatatgctcactaaccgggtgacgagaccattcatacacaaaactcagcgacacacaatttactcatgtaacaaacctagacatgtaacccctgcacctaaaataaaagttgaaaaaaaaagagagaaaagccacacagaagtagtttaataccttcaaaagaagaattgaattttatccaccccaccagcatgtactgagtatcagctgttcacaaactagtaaacgctatgttgtgggggacatacacaagaaataatttcaatccctcgccctttgagggatgatacccaaatctctgtctttgtctctgaccttgtctgtgcttcagcccagaccatttgcttgtctactagaatgtaaagcccaggaggacagcaacttggttcccaatgcctgcaagtatgaccaataagaatgaatgagtaaagaaaataaatacaaaaccttttaatttggagaaattttgaatctatctataaaattgacagaatccatgacctctaatatattttaacatgctcattaattttcaagtgtatataaaaaacaaattggtataaaaataagtagcacttcctatataccaggcactgacatttagataaatcaatcacttgatattttaattatcatttatttatcattatatattacatgtaatattatataagtattaatccattaattcttgtcaagatctatgagcagcaactattataatgcccattttacatataaaactgtcaagacactgaactaccaaggtcatccagcagcacagccatgttgtagacttcagatatctagtagtatactatgccattatactgtcactcaagggtagcataaaaattaccacattcatctatcaaatattaatctcatgaaaattataaatttatagttcaaattttttgacctgagaatctttaggttgtataaataaagttaggtagcggcaaaatgatcttaaccaatcaaggtaggttggatggaatttggaactttataatgcataaaatccaattcaaaatctaaaatagacacagttagattatatgtaaattgtttacactcaacttgagattatacattcttttataaacatcacaaaataccactgtttaaaaatgttaatataaattggcataatatgttaatgttatactgtcataaaattaaatatataatctgatgatatattacttcttaatataaattgttatattttcactattataacctttaatgaaataaaaatagtattgtaacaatttcatctgatggtaaatctctgagtttatagttagacttcagctaaatggccttttttagaatcctcaaattatcttttttgtagcacagcatatatttaaatgttaaattctttacgtgtttccttttttactatggttgcaaaaacagattttactaggtcctacaattcactttttgtattatcaaacgtagtcagctgaattctaggtaaatatttttctgattttacttactattttcctgaaagaaaaaaattgtttaatttaattattcagcaaaccctcattttttatgtaaaacttgaaaaccttactcccaagatttggtagttaaatctgataccaacaacataaaatgttcaatttgtggaagtaacagaaacatgcaacgaatgtctatcaacttgtgttaaaagtttaatgaacaataacatttctttttaatgctgttgacagggaacaaaatgaaccttcacgactaggtctataaagttcttaagtacagtcatgcactgcataatgattttttggccaatgacgaacctcatagatgacagtagtgccataagattataaacacaactgaaaaattccagttgtctagtgatgtcctgccattgtagggcaacccattgctttttctatatttagacatgttcagatacacaaaatacttaccatgtgctacaattgcttacaatattcagtacagtcacatgctgtacaagtttgtagcctaggagtaataggctatatcatgtagcctagatgtgtaatagtctataccctctaggtttgcacaagtacaccctacagagttcccacaatgatgaattcacctagaagacaaatttctcagaatataactccatcattaagctacacatgactttatatgtcattatatttaagaaaacagtttaaatatatttaacaagtaacaactttattaacaatgtttctgtcctcagcttttctgcttaagaagagttatgagaattcagaccaattgcaaaggcatcgtaaaatggatgagatgacagcagcgtcagggtagaggagaggtgtggctggggaagccacactacaatttgggtgctgcacagctgtgataggctctgatttaagaccagtttttggtgtgggtgattattactgggtagaattggttcacattctccttctctcttataacctaaatcgtaaatggttcctaaaggccagaccgtgtaacattaaaagcaacaaccacagaggagttccaaatactctctgggtccttcatccttgaggctcacattgcttgtatttcaaaagcagttggtcctacaggcctcaggaattggagtcagctgaggctatataaacacctagctctgggtaatattataccgtagtatccctccgtagaaatgagttaaaaaaaaaaaagggttctggctcaggtattcaatttctgcatttctttgcccatttttagatattttctcagtgttttgccatttcagggcaagatcatgacatacaacaaatgcacaaatgaggcccaatttagcaactgtgattccatttgactattaggaaactatcataactgatgacagttcacatggttttcttcctgatgagttatactaatagtcacctgcgggtactgcacaattgtggtttactctaggtgacttaaacatgcacccggaagcacaaagatcataataaaaggtggcttgggttattgtgcagccattgcaatcaatcacaaataatatattgtctagaaacatgttaaatatacttttaattttaccttacataacaaatgtaccaactaatatgtgatgtaaaactgtgtcacagggtcctatgaccactgccttttaaatagatttactaaattacaaaaatgttaaaatacatgacaatatccacttaacagatggtatgtttaaaatttggacagtaaatgaaattagtatattttaatatattgaatacattcttccataataatttattactgagtgatatagcatctcatgtatcagtatgtacataataatgcataatgtattttcatcagaatcataaaatatcataaagagcaaaatagtaaatgtctagaagtatccatctgtaattaatatcacatttaatatatatattaccaggaagagtccgggtgctgtggctcatgcctgtaatcccagcactttgcaaagcccaggcaggaggatcacttgaggtcaagagtttgagactagcctggccaacatggtgaaaccctgtctctatgaataatataaaaattagccagacatggtggtgggcacctgtaatcccagctactcgggaggctaagaaaggagaatcacttgaacctgggaggcagaggttgcagtgagcagagatcacgccactgcacttcagcctgggtgacagagtaaaattgtatctcaaaaatacataaattaattaatactaagaagaaagaaatgctgtttacataattatatataggtaagcatgaaattgcaatctctggcaaaataaatacataaatagtaccatgcattgatacatttataggagcttgcaataggttatgataaactttttggggttttatttgcagattgttattatgcctaataggtttctttaatgataatgatagcttaaatacatgtcttaaggatttaaattatctaaaaatataaatgtaaatgttcatttaaaacaaatcacacatttaaaatcacattattcctggtagtatctaataaagatttttcatcattttcattgcaggcaaatacacctcaataaaatattggaatgaaattgaaaaaatagacaaatgcagattgaatttcttcccacaaccaaatgacgtgaatacaaaggggaaaacaacagcaaaggcatacagtgacaaggtaatgattattaattaccaaacacagtcaaatgacttgatttgggaacagaattatattatccggattgcatatctacaattactaaaattaccactaactttattatatatgggtagggaataaagtatattgaatagtccaacacaagaaaatggacaatttacaggtgcttataactactcaatgttaagattttaaaattgaatatataaatgaaagacatttacaggaccaggctgtggcagatttccaaatatgaccataaattcttcccattgtgatcagcgcatcctttgcaatgtgattttattgcctcttctcttaggaggtggtctcatttccccagaccttgagtctgggctggcattgagatctacattgatcaataatatgacagaagtgattttaagtgacatctgaggctgggccttaagaggacttgagattccactttggctatattggaattcaactctgctctgagacctctacacaaggaaactggtctaagatcctcgtgaataagaagtcacttggaggatagattctaaacctcaagaataagaaataaaagtacaaattggtgtgatgaaggtatattcctatttttggggattgggaggctttacttatttttaaaaactctattgaggtaaagagttaagctgtaacatacttcattgatttcctcacccttttcggctctgttttactatatcccctaatttgttggttgtgctaatatttgtagaaagaggtcttgtatttgctgcatcataatgacatttgtacttttttgactggtttaagtacaaatgaatgaaataaccatttttcctttagttgactttaccctgatttcacctagtgtttcaatgagtaaaaatacagctaaaagaaaagaaaagaaaagaaaaaaagtcacttggaggagaactgaggtacctcagatggcagccagcaacagctgcctgatacatgagtgagccgccctggacctgccagtccaactgataccccaccagcatgtagccatgtgaatgggcccaggcacagctggcagaaggaacacccaactcactcacagaaacatgagaaatcctaaactgttgttgctccacaccactaagatttggtggtggtttgttgcacaggaaaagctaaccaaaacagaaattgctaccaggagtgtggtgttgctctaacaaaaatctaagacatatggcattggtcttgcgaccaaataggggaaggagattggaaggacacaaagagcctattagcggaggctgattgggcagtgagggaaccgccattggaaattggagaaagagccgtacatattttgtacattatatattctgtcacctgcagtaacttgaactcatgattctggctagggagatttccttgcagaatgctgaaagtgtcagttggcttcttttagctgaacattataaggtgctggaagagacagaaatgagctgtttcatttgcagacacaaggcagaggaaacacagaggcctaggatatgatggactgaaaaataagatattttcttattcctagtctttccaaaaaaaagatttgcaaagtaagaaaacgcttcagggtaacagcaaatcaaaggtatgagtattgttgaaaactcagaaagagtttgacttgtttaaactccacatataaatgatatcacacagtacctttcattctgtatctcacttatttaatttagcataatgtccttcaggttcatccatgtcattgcaaatggtaggatttccttatttttttatggaggaataatattcaattgtatgtgtgtgtcatgttttctttatctgtcataatggatgtgttaattgactgtggtaatcatttcacaatttatatgtatatcaaatcatcacactgtacaacttaaatatatgtaagttgtattcatcaattatacctcaataaggctggggaaaaaagagaacatttggaaagatttaaggtagtgcccagttgaccttctcaactagacaaaccagcttctaagaatctttagggcactgcccacagcagcctcatatgtgtccaatgtttgtttcaaagctgagattttgggggcacagaatgcactacagacaagtttttaggaagccagctttcactgaagggacagcaccactccaaatgaacaggagactggaaccacaactttgtgtgtctaggaagaaggctaagaaaactatcagttgcaatcttgagccatctcttaccaagatagcaaggaacatgccttgcccctggacaaaacgaactggccacgtgtggctcactggatttcagaatggctggaccacaattgctccctctgttcaattctctcactccttggacagaagcatctattgaagtgaccccactcctgcctcatcactgcatgttgaagaagtggggagcaggtaacttctctttttagttaacgggtctatggattgagagaaatttcacctgaggaacctcatctctatctggacaagatgcaaacgatgcaacacaggacttagagcttgatgccaaaccaaaggctggaggagacttttgataccttgagaatggatgaatgtactttccatgcagaaagaaaacaaacagtagtgaccagaggacagattttaaattatggccacaaaatcctgtggtccaactatgcatccttcttttgtatggtgactttgtccttcccatccaggggtagaatcaatttcccttccccttgaatctgaactcgtatggtacttgctttaattaataatgcagcagaaattactttatgtcatctgattctaggccttaagaggtcgtgaagtttctgttttagctgtcttggatctccatcctaaaaccactgtgcaaagaaagcagtttatattagaagatgtttccatctgtggaagaattcagatgtctcatttgttacctagaactaaccaccaggcacgtgaatgaggtcaccttggatcttcaagctcagtcagccctgcagatgaactcagccacaggtgaacccaagtgaagtcaacaaactgaggcctaagacttcgagactgatgtgtctgatacctcctctctctcacatccatacatacttgatacaaattccttgtaggaagaaagcattttcctcaatatcgtattcctaaagatcagccccctgcctggtatattgtcttatatatgtgtccttatgaaaccatccatatttaactgaactaaccagcaaatccacatactgtgagaaagcatgaattctgattggcttaagccacagagttttggagtagtttgttacacagcaaaggctaactgaaataaaggcatttacatgtgtgggggggcggtgggagtggaggggtccttctcctcctccctcactctgttttccataatgaaaagattctaggcttatttctttgggcctgtctcctaggcctttcctgttttaatcagacaagtaatggattaaaagttgcaaagaacaagggcaaccaaagttactctgcatgagttctgacatggattgatgcgaagggacagacgagaagagagaaaattaatagctatctacagctgtgggcttgagggaaaagatgagttaagagaatttttagggagtcttgcctgtgttgagtcctctaatgactgcttcaatttttttttcaagtgaatgtcagtaaagacttacattgctcttaagactttcagaattggagttgcatttcttttgtatttaaaaccagtggctagattgaaagagcccaatttcattaaagttatatttgcaaaatgtagtatcatttcactttaaatctaaggcagatgggatgaaaggaatataattatctccgttcctaagttacagttgcttaacctcagcaatattgacatttaggcaagatgattctttgtcgtgggaggtggtcttgtgcattataggatgtctagcaatgtcattggcctttacacattagatactggcagtaccctacaccctagtgatatatctatttgaaaagtgacaaaatatagtaaatctaagacttttgctgaaaggttacatagaaattacacgatttttccaatatgaattaaagtatcttatgatgtctgaaattatgtcattcaaatctggaaagtttggtctcatgtggtgggaaggtataagtgggagagggtggatagatctgatagtgtgtttgatttatcttataattcttaacctctaaaaaatattttagaactatataaagcaaaatctattttttaaaaaacaaatattttaaaaatattacaatttaccaaattttaatgtatttgtcacaatggtggcagttatataaggacacatatattagaaaatgtgctaggcactgggttggcttctagggtgacaacaatgtggaaatgctttcatctcacgaagaatttgtcatctcgtatgtatgggggtgtgggagagaggaggggacagatgcatcagccttgaagccttggatgggcctcagttttgtaactttgtagtaaataatttggtagcaaaaaattgacctgaattgagaaaagactatttatagtctttcattattccacttaatgtgaaaattcatacttttctctgcagaaatatcaacgtctttgattgcaaggtgctgccacagactctgattgagagtgaaccataataaatagtatgtgcaccgtatcacgtttctaaaatccaaaagattctgagtttgaaaacaaagctggggtccttagactttcggataaagggttgtgtgaatcacacagaagtgcagggatggagatgtgcactcagagagtaataatcacaatagagagcacaaagcaatcaatacagtgggaggaaaaacagcacagcttattgtggcacttcaaaccttttagttctaaatcaagaccacatttgaacagtttcaagcagaacttttgtggattttttcctgacaccttttccttcctctatttgtggatataatgttgcaggagacaatgatcggatagtaaagtaatgaaaataccttttaccttgtatctgtacagcacttgaacttattcatgttttgtatacatttctcatttggattctcacaaataacctgccacgtacacagagaagaccattaactcggatgtgaacaaggaagctaaagaatagtgggggtgaggaaatacgccagaaatctagaaactggaatgaaggctgaagagttacagaataatgaacagtatttagtagtcagactcttaccctaatctaattttgaccagatcaatttgctgattatttgattcactaatttaatgaattccactgtgcccctcacatgtaccagccgttctgctgaccagctgtggatgcaatctgagaggatgggtttggtccctgagagtccatcagggaaacaggaatcaaaaagaattacatcacagtccaagttttgtaaatgcaaagaaaagttcagaacagtgacatgaaatatattagtatatttaaaaaatatcacttctacatgattaaagattattcttgtggaaaacatgaaagcctaccctcctactgtttgctacaatggaagctaaggagaaaatgctgccttcacatctaagagttttcctactgaattacatataaaggtgcatgttaatgaaaacatgaagacaactgatctcttggatgaaaggttatttccaatcagagagcacacacagaagccttgagaaggacttcaagctgaggctggacaaacttgccacatgtagccagctccctcctgtaaaatgtggcgtctcctgcttttgcaagaaagccaccaaaactatgaaatattttcctgttatgagctcttagcaataccagggcaccagaaagaaagggagtcttgaaaaatgtcctgaaatactaccttcatagaaccactttattttaacctgaaactgtattccaataccaagagtttcaacaattcaaaatacattgtttggtgtggaatggggaaaaggggggagaaaagctggtcacagtgttcgtatattttatgtccaatatttaatccagacttttaaaaaacccacagttctctcaaacaaacatgactgttctcagagagtgctttcaaagtttggtcgttgcttttcatcaaattactgctctttatcttaagtaggttcaggattttacaattttacattttcacattttgggattttgcatttcaaattactgctaatattatttcttagtctcaccctgtgatctaaatgttccttctctctctccctctctcatataaatacttatatttatatatttacatatttatattatatatttatatattattttgtcagtatccagcacggatacaataatttgacacaatttcacctatattttatactacctgtccccttgacaagacgtaaagagagctacaattttaacaacaaaactcataaatctcagatggagatgaaatgaaaaacagcaagcacctaaaagagtgaacctgagaaataaggtcaaatcacagagtttaaagagccagtgttagaaattgcaatctcaaattcaacccccaccatgtaattcaattagccacttggaagacctgcactcagtggttaatcctgcacagagcaccaggtggtgctgttgctttccgctgcttcagatctagcgtggcgttagtgaccctcctcataatagaagatctactggactccagaacctgtggccaccgcggcagctgcaggggtttccacatgagacagcagctggtggatgtcacaaataaatttcctgagtgtcaatccaacctcacatgctcaagtttattcgtatagtaatgaataattttaaaggttacttttaataataatagaaatctatcttctatttagaatgtatgtggcaggcatatgttgcatatatttactacacatattatctaattaaaactttgcaataaccgtatgagaaaatatcctccaccctcaccaattttacatgtaaagagactggagcaaacgaggttcatcaactcccttgaggtgacacaagacactaaacgtggagcatggatatctgtctgactcaaaagcccataccttcaatcacttcattctactctcacgtccaaattgcccattggggtttccagaataactttacatatcacaacctatctggagataggcaatgtagacgcaattcccaactcacagatgaggaaaccgtgtcagaaatgggtatctcagcaagcaagtgccaaagtcaaatgaaaccctccttactccctttcccccgtactatattaaaaacgatatggccagaatccagctggtcaatagagcacctccaagctaggccatgatgctcagttatcttcccgagctacaaactataaagagttctcctatccacggacatcttgaccgcctatctccagttcttcaaccttgtctatcctcattctcagcccatcttactactacttgagcctcctcaacagagcaggaaatgtttatgggaactggctcacctatgaatccacagaataattttcctttcacatgtctatatttgcatctgccttggtattattattatatcatgtgtcacaggtcaggataacagggaaacaaattctagaaggaattttgtcagcaggaggttttttagcatgtgctctcaagaactaaaaactttaagtgtggagaagcagaattaggacacagggagatgctggactcatgcaattatgcagctgaagctaggagagtctttcagagatgtccaaaatgaaggcaaggggctgggactttgcatccaggtattggccagttgctggatatggggtggccctgggaggaggtataacttgagaaaggcagatccccggggctgaggaccagtcctggggagaggctcagctgtgagtcttcagcaggcaacatttggagagctgggaatgagggcctcagagctgaggggcatggtctgcactgtgccccagtcatctgctgcaccagctacaatgttaactactaagctctaaaaatttaaacagtcccagtaacaatgagaatagcagcacggtcccaataataatgagatcagtagttctcattagttgtatgctatgttcgatacactgcattcaaagggggtcaagatttgctcctatttctatttgggactacagccaaacacttgaccaccaagagatgctgcctcctccatttatttcaaaatgaacaaagtgttcaaggcccacttttgcacttttctgaggactggatcaaaagtctgaggacttctggatcaaaagatcgatagtgcaaggacagggaaggggccatagctttcttgaggcagccaatcatggagttctccaaaccatcttagacatcttagttttttttatcagtttcttactaattcatatgcttcctcagtttaaccaaccaaacttggttgtatatttctaccctctgagcctgcctatctaaggtaccattttacttctctaaccagacaactttggcagccactatctagttctcccctctgacctccatatcatcatccaccctttgcataactatttctcctgaatatgataccatttttccagttcttaaacatcatcacccaagagcctacacaaataaaaaacatggattgccaagtagtggcatgtaggcagaatctgggccccaaatgtattttccttcatcctgcaaccttccaagaaaacattttaatttaaatgtttgtaggtaggacttaagttctaatttttacacagacccatcactttcttttgtctttaaccagttacttctcaaatcaccagaaggtaatgaggtttaagacatcttaaaagaggaagacttatatttcaaatactcataaatgggaagtgagattttgaaaaagcaacatgatgagaaatcttaggaagagcaaagaagtaaaatagagactcttgattttaaaataaactcatattttttgttacaattattatatctttgtcatagatatgttgtgtctttggggaaattggaaaagatattctgtttacattctcaatccgttcccccagtataagcatatatcacataacatttcagccaatgatggaccacatatacaactgtggtcccatgaaattataatactgtatttttactgtactttttatgtttagatatgtttagacacacaaatatttaacattgtagtacaattgcctacagtgttcagtacagtaaaatgctattcaggttgatagcctaggagtaaaaggctattaacacatagccaaggtgtgtagtaggctatgccatctaggcttgtgtaagtaccctctatgatgtacgcacaatgacaaaactgcctaataatacatttctcagaatgtatcttcattgttaagcaatacctgattgcattttaaattagtatatgtttaagcaagtatattatttcactgaaacccagaacaattggaacccaagaaaagttacttgcaatgatgtaaagacatgaatgaattcatgtaatttgataaataacaatataacatgttggtatttttacatataaacaaacatcataactaaatttcaatgagttataagaatgcatgatatattttatataaaactttagaaaatatgagaatctacatccagagtaagcttgttatcagtaaattccatgtagaaaaaccagaataaaacttactactgtatctacatttgtttcctaataaggaaaatggttcagctacctatgtcctgaaggtagtcactgaagagaaactgctgtgatgccagaggcaaacttgagtgcatctgattatcatcttatatgtaaacatagtgaaaaagaggtaaaattctgaggcaccctcacattttaaaagagatctgaaaacaaagtgatatcagcaagatggcataatagcagtttccagtgctcatttcctcacagagacatcaatttgaacaacccattcacatgcaacaaaaatatctgcctgagagctaaggaatatagtgcctgagtagagcacagaaataaacacatacattgaagagggtatgaagaacagttttatattacccacccatatcacccccttcccaagcctgtactgcataccatggagagataacttccatatgagggagaatagtgaagtgagcacttgacttcaaagtagactccagcacttgccccagtgaactctagtgtcaagttggccccttcagaccgaggatttgggcctgcccatgcagatctgtgtttcaggactgccctcacagacccaagtgccagaccaactccagtacaggatgacccccatgaactcagaccaaaagcccaccccactgcctgactgttttctgtggactcaggttttaggccatcctccacagacccagtctccaggcccaccacaatggaccatagtcccagctttactcccatggtccaaaatatcaactcagcccctataagctaagatgatgagaggaccatctgtcccctgacgaaaacatcaggccagtcctcccaaggatttcagcagcatgcctatccatgaacccttccagctgaccttttcagaatccttggtcaggctgactgatgaagggctttccctgctaaggccagtctgaagactggcaaatgtgcctatgtcttcaaatgcataggcaccagctcaaggccacaacaaaccaaatatcagagaaatatgacactaccaaaggggcaagtaaaatactagtaactgactttaaagaaatggatatctatgaactgcttgagaaataatttaacataatcttctaacaaagaagctaagtgagctaaaggagaacacagaaaggcagctaacccaaatcaggaaacaacacctgaaaaaaatcagaagttcaacagagagacagaaaccatacaaaagaacaaaacaaaaattctggagctgacgaacacaataactgaactgaaaaaaattgcatagacagcttcgacagtaggttcaatcaaatagaagaaagaatcagaaagcttgaagacaggcttgacattattcagtcagaggatcaagaatggaaaaaaaggatgaaaaggggagaagaaagcctatggaacatatgaaacaccatgaagctaatcaatatacatattatgtgagtttcagaggaagcagagatggagaaagaagaagaaagcttgtttaaaaaaaataatgttagaaaacttcccaaatctagactgggaaataaacattaatatccatgaataccaagagccctaaaaagattaaacataaagagatcttcaccaagatacattataatcaaattttcaaaagtcaaagacaaaaaattttgaaagcaactagagaaaagtgatttgttatgtataagggaaactccgtaagattacaagcagttttctcagtagagacttgcaggccaggagaaagtgggataatataatcaaagtgctggtgggggaaaaatactgtcaaccaataatactatatccagaaaagctgtctttaagaaatgaaggagtgataaagaccttcctagataaacaaaaactgtggatgttagtccctactagaactaccttacaaaaaattaatgttagagttctttgagttaaaataaaagaaagctaattaacaaaatgaaaatatatgaaagtaaaatctcattgtaaaggtaacatatagtcaaattcacaatatcctaatactgtaatggtgccatacaagtcactttgatataaaagttaaaagacaaaagtattaaagacaactaaagctacaacaatttgttaatgggtacacaatataaaaagatgtaaattgtgacattaataatataaaacatggggagaggagaagttaaagtgtagtttttgtttgcagtcaaagttaaattgttaccagcttaaagcagactattataactataagaggtttcatgtaagcctcatgttaccacaaagaaaaaatctgtaagtagatacataaagataaaggaattaaaacataccaccacaaaaaaaatcatcagatcacaagaggatggcaagagaggaagaacggaataaagtaactccaaaatagaaaacaacagtttgtcagtactgggtccttgcctaccaataattatcttaaaagtaaatagactaaattctttaatcaaaagacaaagagtggccaaatggattaaaaagtataagatcaaactatatgctgcctacaagagattcactttagctttaaggaagcacatagtctgaaagtaaagttatggattaagaaattccatgtaaatggtaaccaaaggagaacaaggatggctatccttatatcgcacaatgtagattttaagtcaaacactgtcaaaagagacaaagaagatcattatataatgacaaaaggatcaattcatcaagagcacataataatgtaagtatatatttacccaacatcggagcacctaaatatataaaatgaatgctaacagaatcgaaggaaataaacagcaatatgattaatagtagcagatttcagtacttcacgtttgacaatggatagatcatcctgacagaaactcaacaaggaaacaatacatttgaagaacactataaacctaaacaatgtaacagatgtatatagaatattccatccagcaacagcagaatacacattattttcaagtgcacacagacaattctccaggatagataatatattaatatattagaccacaaaacaagtcttaacatatttaatttttatttatttatttatttatttatttatttatttatttatttatttttagagagagggtcgcatctgttgcctgggctagagtgcagtggcactcactgttgcctgggctagagtgcagtggcactcactgttgcctgggctagagtgcagtggcactcactgttgcttgggctagtgtgcagtggcactcactgtagcctagaactcctgggctcaagcaatcctcccacctcagcctcctgagtagctgctgggattacagctgagtgccacaatgcccagctaatgttttaaaatttttttgtagagacagggtctcactgtgttgcccaggctggtctagaactccttacctcaagcaatcctcccacctcagcctcctaaaatgctgtgattacaggcatgagctattgctgtctggcctcttatcatatttaagaaagttgaaatcatgtcttctcttttctgaccacaaaaaaacataaaacaagagatcagtaatatgaagaaaatttgaaaattctcaaatatgtggaaattaaacaattcattgaacaatcaatgggccaaaaaataaaagggaaaccaaaaaatatcttgagatgaatgaaaatggaaatactacctacaaaaacttaggagatgcaacaaaataagttctaagaggatggtttatagtaataaatgcctacatttttaaaaaaagaaagattttaagcaacctaattttatacctcaaggagctagcaaaaagagaaagactaagcccaaacttaggagaaggaaggaaataacaaagatcagggcagaaataaatggaatcaagactagaaaacaagagaaaacaatcaatgaaactaagagttggtttttgaaaagataaacacaattacaaacttttagctagactaaagaaaagagaggagattcaaataaataaaataagagatattacaactgatactacagaaatataagggatcataagagaatatatgaacaattgtatatcaacaaattggataatctagaagaaatggataaattccagacacgtacaatctaccaaaactgaatcaagaagaaatagaaggctgggcatggtggctcacacccgaaatcccagcactgtgggaggccgaggtgggcagatcacttgaggtcaggagttcaagaccagcctgaacaacatggtgaaaccccatctctatcaaaaatacaaaaaataaataaataaattagctgggtgtggtggcatgcacctatagtcccagctactcgggaggctgaggtgggagaatcgcttaaacctgggaggcagaagttgcagtgagctgagatggtgccattgcactcccgcctgtgtgacagagcgagactccatctcaaaaagaaaaataaaagaagaagaagaaatagaaaatctgagcaggccaataatgaggaaggagattgaagtagtaagaaaaaatctttcaacaaagaaaatcccaggacctgatggttttatgtgtgaattccatcaaacatttaaagaaaaactaataccaatctttcccaaactgtttaaaaaattaatgagaatgaaccacttccacactcattttataaggccagcattactctcatactaaagccagataagaatacaagaaaagaaaattacaagccaatatccctgataaacatagacatgaaaattctcaatgaaacactagcaaaccaaattcaacatgaccatggtcgatgggatttatacctgagattcaagaatggttcactatatgcaaattaatcaatgtgatataccataataatagaatgaaagataaaagtcgtatgatcatctcaatagatgcatgaaaagcatctgacaaaactcaacataattttatgattaaaaactcaaaaaattaggtacaggaggaatgtatctcaacacaataaagaccacataagaaaagcctacaactaatagtatagtgaatggtaaaatgttgaacatttttcctccaagatcagtgaaaagacaaggctgcccactctcacagagtgctatgttctattcaacataacactgaaattcctacccaaatcaattaagcaagcaaaagcaataaaaggcatcaaaatcagaaaggaatacatagacttttgtttgcagatgacattatctcaaatagagtaaaccctagactccaccaaaaaaatggttataactgataaatttagttaagttataaggtacaaaattaacaaacaaaattcagttgcatgtctatacataaacaatgaactatccaaaaagacatttttttcaaaaaataaattttaaaaatattctattcacaatagcataaaaaagaataaaatacttaggagtaaatttaaccaaggagataaaagatctgtataatgaaacaataaagcattgatgcaaaaaactgacaaggcaaatacatggaaagatatttccttttatggatcacaagaatcaatattgtcaaaatgttcatattaccttaaatgatctacagattcaatgtaactcctatcaaaattccaacggcatttttaatagaaatagaaaaaaaagtcctaaaaattgtatggaaccatcaaagaccatgaagcaattttaaggaaaaagaacaaagctggaggcatatttcctgattttaaattatattatatagctatagtgatcaaaactgcatggtactggcataaaaaaacaatacatggattggaacagaaagcacagaaataaacccatatataatattcagtcaattaatctttgaaaaaggcatcaagaatacacaatggagaaagactgtcccttcaggaaatggtgttaggaaaactggctatccacatgcaaataagtgaaactggatccttattttacaacatacacacaaatcaactcaagacagattaaagatttaaacgtaagtcctgaaatcataaatgtactagaagaaaacatgggcaaaatagcttcttgatattggactagacaatgattttctggatatgaccttataagcacagccaacaaagcaaaaagaggcaaatagaattgcaccaaactaaaaagcttctgcacagcaaagggaacatcaacagagggaagagacaacctagggagtggagaaaatatttgcaaaccacacaattgataagggattaatatgcaaaatatgttagaaactcaaaaactaaatagcagaaaaacaaacaaagaaaacgggcaaaggacctgactagacatttctcaaaagaatacatacgaatggccaattacaagaaaaaatgctcgacatcacaaaacatcagggaaagcaagttcaaacaaccatgagacatcacctcatgcattaggatgtatattatcaaaatagcaaaagataacaagtgttggtgaggatgtggagaaaagggaacccttggacattgttggtgagaatgtaaattattacagacattatggaaaacagtatgaagatttctcaaaaaaattaaaaatagaagtaccatatgatccaatagtcccactactgagtatatatccaaaggaaatgaaatcagtatatcactgagacatctgcaccaccatatgccctgcacactattcacaacagctaagatgtggaatcaacctgtctattgacagacaaatggataagagggatagcattaggagaaatacctaatgtagatgatgggttgatgggtgcagcaaaccaccatggcacatgtatacctatgtaacaaacctgcacgttctgcacttgtatcccaggacttaaagtatatatttttttaaaaaactctaaatatcaatcatctaaattttcactattcaggctttcactataaatgctggttttaggttttccaaaatgatgaatgtaaatcagtattattcatttcacttccactagttttaggttcagatacaataggaagaaaagattttaaacttttagagttcttttaaagtctactccacacattcatcttttggtacgaagtatttcaactcaaattataatagaggaaaaagagtacacacacacacacacacacacagaaagagaaagagacggagaaacacacatagagacaacaataacaaaatagtaccttttatcatacccggagtcttgtagattgtttttatcatatctcacctattttactgattttggtaaattatcctaattcagtcgtatctaaaccaaacacagctttcaccaagggaacttccaactctcctagcagcattctcctgatattatcactatagcaacatctctataaaagcatactattcttccctcattcttcatccttaccccctgcttactagccaaatgcaccgctccccagtgccagcgtgtctacaaagacagtgctcatatcgatttataaaaagtgcttcagatgcacttttggtgaaaaaaaagagacatttttcattcgatatttagaaaattaggcattttatcttattaaaatcctagtgttgattgtggtaattgtttcacaatgagaaatatatcaactcatcacattgcacaccttgaaaagatatattgacatgatttttatgtcatctcaataaagctggaaaaaattttaaaaatcttaataacttctaagggatttttgttggaaaaaaatcgtccaacttacaaaaacttccagaattgttacttttgaaatttaattctagaatttgggagaagaaattaaatggacattttttagatcactattacataggcatttaatttcttgtatttttacacaagatataatcttgtttatttctgatttgttctttgaactttctggaatttttcccaaatatctaatattgcaaaacactcattacaaattataattgccatactagaaatacacatagcaagttgccaagagaatcacaccatttttttgaaacttgcaaacaatattggagaggtttgacattacttaagcacataaaatatcagttaaagaaagagccttacaaaagacaaacaaatataggtgtaagaatgtacaaagaatattttttaaattccattttatactgcgtaagacaatcaaagactagatttttaagcaagaaatgtttacagatgtgtgagactctccaggtctagaatcaaataatttcttggcctgggatttcaaggaaaaacacgaatcagttgtagcctactcatgcctattaaaacaccaccacaaacaaaatcactggtgaaaatgttttcatttttctgactcatttagagtaagaaatgtttgttttttgtttgttgtggtttggttttggtttgagacagggtctcactctgtcacccagacaggagcgcagtggcatgctctcggctcactatagcctcaacctcctgggctccagcaatcttcctgcctcagcctcccaagtagctgggactacaggggcatgccaccacacctggctaatttttgtattttttgtagagacggggttttgccatgttgcctaggctggtcttgagctcctgaactcaagtgatctgcccaccttggcctccaaaaatgctaggattacaggcgtgagccaccgtgcctggacaggaacgtttattataacatcaaatttgttaacccccaaaagtttgcttataaaaaatgttaactattctcatgatttctagggaaaaaaaaatcaaactcactcttcagtagaggccaaaagaaatatgaatttcctcaacagactttggggtctaggagtgcaacagatccgactcgggatcccagcatcatcatttactgcgagaatttcaaaaggtgacttagccactttatagcttcatttagccatatgtaaactagagacaaaaataataatgaaaacctcctagaatcactgtaaatattaagttagatattttatgtaaatgctgtgtccaacacttatcacatagtattcattcatcaataaatgttagttacttgttatacttgtttttactcttattgatttaaacatgatagcagcaattaacttctcttaagggaatagaacagaccattgctttcttttattattagaatatgtatttaataaagacagggaagcgaagaagtttctagaagccaggagaaacctgatcattaatttatgtggttccttttgcctccactagcttcaacactaagaaagagggcctcttgtggaatttagacattcaaaggtatatttactgagcaaatccaaatcattggtttcaatttatcttgacatgttcaggccaattaagttagttaattactgggaataaagtaatcctgaatccttaaaagctgggcccacaacctagtattcattcctaagggctagcagatttgtcctccagtatggcatatgcagcaatttaaagtcagggaaaagtatggacttattaatactctttggcatttactggcactgctatttaccctctattacgtgctaagtgtctgacgacccaatacccatatattcaacattaaatcttcaaccttataattcttgaaattctcatttggtattcactcaagacccagaaaagggtcaaaggttgctaaactttacttcgctttaaaatcttcccttattcagacaagttccctgctgaagtttaaaaaaaaaaaaaaggaggctctaaggaagggcatatttctaaaaaactgaaaaaataagagggagatggttttcagttgttttacaaataggatttcttgtccttttcaatttctcacttaagccttatttccatttggaaatccagctactcagtgccaactaagggggaggaactgtggggtttaaaagttagaataaacatcgtttgtagccttaaatgaggaccagtcttcttaaatgactcaagaaacatttactgcacacaaattatgtgcaaagcactgactacatacatgggtgatgggagcagagggcacaggggcaaggagaaaaataagatacaaaacctaaacctaatgtccttgtaaacttagttcctttacatccttgaaaaattatttttttcttccacagcactacagctgtgtatagggaaaaacaggggaagaagaaccaagcaaatgtagcagcttctagctccttacccctccagtgttgaacctggggtgtgtgtgaaaaaccaaggttaagcatcacagcccactgagataagagtgaaggaacaagggatgacgcaaggtaacacagagatgctggcaggtttgagaaaaacatgttctcgcttctcaagctgaagcgagcaactagcatgacctttctttgtattttcgttttgcagtgtcaagggcaatgttgtttcttttcaggaagaaacaataccagctttgagaaaaaaaatccacattaaaaaaaaatagcagctattaagaagtgtgagaggaaggaggtgcagaggggacacaggaagatccaagagcagcaaaatataggttcagaggcaatttgagtccaatccaccacctttcaaattaaattaaaagcatggttaaaagagcatttttggcacaaaatcttaaattcacggtgctgtaggataaggcttagtgggattatcaacagagtgtggatgccaaatggacatcaggcaggaagagaaaccacagatgcattttcagcaaggtgtctttataggattactccacctagagcttggcctgactcaaatattaatttcacaaacaaccgcagttgtaagagtgacttccattatttaagggcctaatctcgggtagaataacaatccacaaacactttttttgtggcactgccaagcatcttttgtttttcaacatatgattttaaacattaacttgttattgtatatatttaagttgtattacatgatgttttgatacacatagtgaaataattactacggccaagaaaactaacatattcatctcttcacatactgtgtgtgtgtgtgtgtgtgtgtgtgtgtgtgtgtgtgtatgcgtgtgtggcaactgtataccctttgtcccccatctccctaaactgctccatccctctgcacctgttaactgctgtttcactctctgtttctatgcatttgcctttttttagatttactgtttaagtgtcatgcagtatttttcacttagcgcaagtcttctaggttcatctatgttgtcaaaagtcgcaggacctccttctttttaaaagctgaataatattccattatatatatgccacaatttcttcatccattcatttgtagatggatgaatgctaagcataaccattttaatcattctgttaataactcagccaatgaaaaagatttttttcccattataatataaaactgtacgttattttgttttcctaacctacacagtgcttacatgtttctttaatagtaaagatcgtaattagcctatagtgaagtatatataacagataatttggatgcttctattgatttttttgtctccattattaccactgagtccttctaccatctgctgaagcaaaggcaacagagaagaataaaagaagaacagagtattttttcaactgccatgatgtctccagcctgaaactctccttctattccaatgctaactagttattatagcagtaactttgcacttacagatttttgtgcaaaatccaagaaaaaaaagtaatctttattgtcaaaaaatagcttcctgggtgctttctggagaaaaggagggcggtctgacttcctcatgtagaaaatctcagatatgaaaaggaaaagtaacaagggaagggaacacattgcttgtcctatcaaatattaaaaataaaatgtaaaaggtgcattaattaaagcaatgtggtaacagagaaagaacacaccatagaatgcaatgaaatacacagtccagaaagagacttgtgtctatctagacaaaatgagaaagatcatttgatgaatagtttagggaaaactagagggcaaatgaaaatagaaaaaaaaatcattgagaacctctctttacaccaaaataaataccaaatggtttagggaattaaaataaactataacaactacctgaaaatatagtaaatatgcttaataatgaagacagacattttaggcctaaaaataactaaagaggaataggtttcattgcataaaaatcaaaaatacatatccaacatattataaacataaaggcaaagagtatagtgggaaaatatgtgctaaaaatatgagttaaatttttattttattttattctttttttttttttttttttttttttgagatagcatctctcgctcttttgctcaagctggctgaagtacagtggcgagatctcggctcactgcaacctctacctcctgggtccaagtaattcttgtgcctcagcctcccaagtagctgggactacaaatgcgtaccaccacactcggctaatttttgtatttttagtagagatggggtttcaccatcttggctagagtggtcttgcactcctgacctcagttgatccacctgctttgtgctcccgaagtgctgggattacaggcatgagccactgcacctggcctatttatttacatttagagacagggtctctctatgtacccaaaatagagtgcagtggctattcatgggtgcaatcagcacactgcagcctccaactcctcgtctcagggatcctcctgtctcagactcctgagtagctagaactacaggctcttgccactgcacctggcttagaattttaaataaaatcaatgagaaaaattttcagtcccattacatttgtaagcaaagatatggaccagcaattcacaaaatggtctttaaaacatatgaaataaagttttacattattcaatttaaaaaacaatgagataagcataatatccaggggtaacttttaaacaaaaagaaagagattttgagctgtaataagttgccatttttgaaagccagtatttttaactcttataatgaagattaagtaacattaatgaattagttctttattgctcctagtctcagtattatcatacatcagtggtccttaaagtgcccagagcagcagcatcagcaccacctgggaacttgttagaaatgtaaattcctggctccaatcctgacctacagaagcagatcagcaatcggctttaacaagatacccaggtgattcttatgcacaatcaaattttgggatcactgtatggatcataagctgtagaaaattttgtggtgcagtggttcccagcatgcatccaatttcctgggtttagtttaatcatcaccttatgggcaagttatctagattctcctttcagtttcctcatctgtgaaatggaggtaatgatggcacttgcctcataaggttgttggtaggataacagaagtttatgtttgaaaagcatatgtatcagtgcttatatagcttagcccattgttaaatttagatttttttaagtaagtttaataaagaagagaaaagaccatattttaaagatttaaaagtaaagataatcaataattacactgtgagaaatgacaactagatttgcatatctgtagtagaatagaaaaaatgggtcataagcagctttagggatgatgagaagaaatggaggaagaaaaaagaatatacacaagctgcatccaaaatactctcaaatactctgccagtggagagccacacgtataattaattcagagatcttcttggagatggccctagaagtgtgaattcttgcactctgcctaaaacaatttgggtatataaaccacctctctttgatggtaaagatatgtttgtttgatttttgatgctagtaaaatagctgtagaaacaagtcttgaggccatactttcataaaataaatacacctttattaaattacaggtgatctgaatacgatcttagcctgtcattaagatgtgttcttagttatttcagtctactgaatagactgacctgcaatttagtttacaatttagtttctgaaataatttaaaaacaaaaagcataagtctagcaattatttcgtgttgtctagaccctgtgtgacaactctgctgaattcttcaattatttccatgttaataataactaaatagatcattatgaaatcacagcaaaataaaaaacacaatcttccattttctgttgctcctatgttctttctcagcaccaagctatataaaagttaaaacagtttatttcctctatattatgtaggtatttgattgtcccgaacacatcaaaatattacgctttcagaaaaatcttttgaatctctgcctataaaaccattactatatcatatataaaactcatactcttccttctctgtgtataatatttagattctctcctgtgaacaggatagccagggaattagcataccttttgggtcaggtagatggggtagtcagtgagatctccgaaaaacaaaaaggttgcttgttaaaggccaacgtggtcaacttgacccttttggggaggtgcagccttgccagcactagaggctggacttgctgaggccacgttggatctccagtctcagcactgggttattttagtccttcatcccaacaaacttcgggatgggtggtgtgctgcacctattcccaccaggaagcgggtcttgcagattactaacagctgttcccttaatcagaggcaatcaaaacaatggtatccccttccttctacaaattaataaagggagctatctaggaaggttcagtccttactatcatggtaagaagtctttcttttgtagtgtacctcactaaagagaaagacaaacaagcaaacaaaaaaactcctactcacagcaataagtaaggtaagcatctatctaggagctctctcctaaaggcagccagatgcggaggaattcacgagactgccctgcccagtctcagaaagggatgcacaaagggggattcatcccattgctcagaaagcaagaagggaagggactttgctcagaaatcaagctgcttatttaatttgatgtttactctggtcttttttgacctacacagtaatacagagatatttttcaattgacaactttctatctcagttacttagtttcaataaatttaacctgtaaacattaccttacaatgtgttccattctgaggtttcttttaacccaatggaatagaaatgacccctacttggtttgtcttctgagattgcttaagaacaggaagcaaagtactgattactaggcttgcttttaaaataacagccttggcaatgatctctagctgagaactggcacttgtgttgactctaggtcttcagaaaaggaaaatcaagggaagaaagaaaaattcaatgtgcagaaacaaacaaacaaaaaatgccagcaatttctgaaggaatggagaatacatgtatatgaatcctgtagcaccacgaaatttagagctacacacctacaatccttcagaggcatttcatgacagctgcatgatgaagggggaggatttatatttaatttctatatgtgtatactttttaccctaaaaaaaaggaaggaagaaagcatgcaaattaacttcttgtcactaataaaatggtgtgatttaacccaaaatccgtgactgtaaagtacccacaaagagaaagaaaatgggtctcaggaaacaaaattgttttattatggctgtatctgtattgggtcaattactgtgacgaaagaggcattttccctggcagagaaaagattaacattttagtgtattttcttaaataatttaaaaaggaaagagtaacatgtaactaaatttagtttttaatcattttctacttacttgctatatgcaactaacttgttattttcaatgcattttttaaatttttcaatgctagtttgtgcatcatcacagtttttaaaaatttccttgccaggaaattatcatatttgtaattacaataacaaaactctagtcacttcctgaattaaagaaggggttggggtgggggcagctttatcaccgcaatcttggactgaccttttgcctgaagcatttgaaaaggcaagtagaaatcaaatatatttttgcataatgcctacatctttaatgacacttctgaggtgtctgagtgatatttctattgtcattgcataatataatacttagcattttactgtaatgaagtgtaacaattgaggtaatgttactaccatcttacgtaaattcaaacttttacaaaccaaagtatgttctatttttgtccattttgccaattcagttcttctcactattcttaaaggagggtccattaattacatgtatccaaaatgcacaacaatctaattagctgttagaatgactcacttcagtcctcaatgtcttgctttttgtaaaagtgctcatttcctatgacttatgggagaaattgtttggattggaagagcttcaaagccaataaacagaataaggggactcccagaataatagatttctagaataagagcactttttatggattaggaaacagctccagagtctatgacccgcccaacgtcacaaaaccagaatgtcagtaatactactcatcgttgccagatactcaaaagctcctctgcagttggaaagattcgttccagaaaaagtctttcctgaagggcaactcactttcgctagggatgaagagtaacttaaaaaggagagagagcggaggtaaggggaatgaattggtgtaatgccaaaagctgtggaataaaagttattccatggtatttgttcatgggtgttgtgtgtgaatgatgtgtgttgatgttttctgggtcatttagtttatgagggaaggcaggaaaagccaacagagcatacaaaaacaaatcagccacaaattctgaaagagggagttgcctttggtctaataaacattttaggaatgtaaacaccttctgggaaggattccttctgggaatgtctatttgacattcacacctcattgtcaactgctcgaattagataacaccttgttgaatatcctcaggcaatgaaaaattaaaggtaaagaaagagaaaggaatacttttctaagggcgaggcacttagaggtggagactcccctctgggcattacctacttgaggtctctatagaggaggctgatttttttttaaattttattattattatactttaagttttagggtacatgtgcacaacgtgcaggtttgttacatatgtatacatgtgccatgttggtgtgctgcacccattaactcgtcatttagcattaggtatatctcctaatgctatccccccccctccccccaccccacaacaggccctggtgtgttatggtccccttcctgtgtccatgtgttctcattgttcaattcccacctatgagtgagaacatgcggtgtttggttttttgtccttgcggtagtttgctgagaatgatggtttccaaggctgacatttttaactgaaactgaagagaagtgatgaaaaagcaggttggattccattgctcacaactcttctttcctcagatgaccccaacttaccattctctaattttgaaaacaggaaaaaatgttcaagaagatttagaacctatcttcaagaaatgtcaagaatgtaatattgggactctcataaatcataacttttctgcctacattttctgaagatttccctataaaagtctgttaccttgacactctaattcatatgctcaagaattaggttaattattttttaaaactttgaagaaaatgatcaaactaacagtaacaatagcatctacccatcctaaaagagtatgcatcatatacagcaaacttctatgactaagaaacaaaacaggttcattgttagatacagcataatagcatcaaagctctgcttcacctgttggaagcacagaacatattttaactttacgggctgtgggagctgggggaagcaaaaacattagagatgttcaaccaagctctgagtcatctctttatgagttacagattcttaaaaacaaattaaatgaagtccccagctgtaactatgatttgagcctcataacggggtgagaatggagaaaatgggccaaatctacagttatggaatatataatgggatatacacatatatatgtatatatatacacacatatatatatacacataaatatatacatatatatatatatatatggcagatataacaagataggccttagaagttaatttggtggcaaaaggagtaggtttagagaggaaatatatataatatatatttgttgttttcgtagatgagatctggagagttgcctcagaaacgtgtctgcacctctgcaaaggcatccccaagctcaaccctgtgtaattacctcctctttgctcttgttcttgcctttcctttctgcacctgacagttaattgctgtaattgaacaacaaggactgggatgcccttcctcctcttgctctcacttctttcatgactctcttcagtctttgttggttgattaagcttaagcagtctggtaatcaatccaaatcttatctcattaattggactaaatgaagctttgagggaaggaaaggagatgagcataataggtgctaagtaaataccgtagttgtttctcaaccatggaaaaccccacttgaaggatatacactttatatgtttgcatgaaagtattaaggtatttgaagtaactaaggtaatcaaagtaattttccccaatgtataatctaacttctgtttttttcaggcacactaacactttcagatccttgggacaggcaccattcagtcaaatccttatagagcaggactcttgaaacgtcagttcactcttagctgtttttggtttgttttttgttttgtttgtttgtttttaattttgtttgcttttcatttctgtggctttaggttctttaagccaccatggaagtacttattttaagagaataaccattggaattatgctttcttaagaaaaataaatgtgaatgaatgtaccaaacatgaaatgtaagaactcttccatctaagctataatcccatccctgaatgacacatgatggtggtgggtacagttgatgaggttttctctaactccggtggtataggatggtggtcttcaatctgggaatgtaataaatgccctaaaggactatttcaaggagcaacacctgataaagtttttcctaatgtcatactgcattgagcagaacaattctgaatgaagcttttatttagtggtctgggctgaattacatgcctctagatttgtatctgtcaaaatgtgtttcatggacgaatgacatcagaatgcaatgctcactagagatggagcttcctgggttctgcattagatgccccaagactctctgagacaaggcttagaggtctgcattggaacacactcctcatgtcattcttatccgaactagaattcaaaaaccacagctttagaatcttaaaatagttgttcaacaatttatttatgcaaactgctgaaaacatgaaaaagagaagttatattgcatttcactacagttcagtaatccaataggctgttgttccattttaagattgtggagtcaacataaataaacatgatctttgcagtcagaacagcctagatttgccacaacttactagctatgcaaccttgaacaagtttctcagcctatcagaacatcagtttcatcatcactgtaatgaggaaactattaacagctacctcacagggttgcttgaaagctaaatgaacaatgtatatgcaaaacacatagcacagtgcctggaatgtaataggcatttaatgcatgctacattattactttctatcttagcaacttgaggtgactgtaatctcttttaaaatattcagtgtaaacaaactttctcttataattcttgcagcattattagtaatgttctgggaaacggctattgcataatctgccaaataagaacaaagtggacctcggctaatcagcaaacgtgcctgtgcatgtctttctggtagcaattcagtcagctattaaattgttcctgctgtgttttttcaaaaaaataagtaccaacccatctttctttgctaatgttaactctaatctgcgttagctgcttgcttttgcagttattggtatgcattcacattctgtatctataggatataaataaaatcaatagaacttgctttgcgtgagccagtgttcaaggtccaactacagattgggaataaggaattactaggcatttacagcagaaatactagcacatagcacagtcttggtttttgagtcctactatgcagtttacaacactcccatgtatttagacagtgttaggtttttcttccaatcactcagtttccaagagtacattatactcaaatttcttgatgacaaatcctatgcaatttggtgtgttttcctttctaaacctactccttttgccaccagattaacttctaaggcctaccttgttagatctgtcagaggtaagtaactaaataattaactactaggggatgcaggctaccccaaaaagacacaggtattttccaagtgacacaggggcacacagaacaaaggctttcaaaaccttgtcatattttcagtcacagcaggtataaggacagatagccagattcttgaccttcctattcaaattagctacaggaagtggggaaattattttacactcctctaaatctggctgtcaagaattagtggaaaaatccaactttgaatttgtgcttccctgagtgtaatcacatttagtccgattagattaaagaagagtagatcaccctcaaagcaaacaggaaatggagacacaatttgacttcatgattgagcactaacaaaagatatatggaaaatagattggggtctaaagcaaatagcatttttagtaatttaaaaataacttgagagacacatacacatataaaatgccagcttttattgtcagacaatcaaaattgttcatatgttaagaaggcatttttttgtcatttctttaaattaatttgagcttcagataggaaggctacaatcactgcagctaataaagtgtttttgttcttgacaaagaataaaacttgctgttgcaagtggctcaacgatagaaagaatcttattagaagtataattaatgcagggctttaaagaagtcacattgctaacctagggtgcatggttttaggcagaaatgtgaacacaattgccactttgcaagaactcaccaagatccatgaaaacaattgagtctaagaaatgacatcgttactgcattttaaatcataaaaatattcttgcctgggcgcggtggctcgcacctgtaatcccagcacttggggaggccgaggcgggtggatcacaaggtcaggagattgagaccattctggctaacacagtgaaaccccgtctctactaaaaacacaaaataattagccgggcatggtggcgggcgcctgtagtcgcagctactcgggaggctgaggcaggagaatggcgtgaccccgggaggcggagcttgcagtgagccgagatggtgccactgcactccagcctgggggacagagcgagactccatctcaacgacaacaaaagaaaaaaaaattctctaactatgaaaatgcttctaaactctggtgattttccagacgggagttggagtgaaggtctacattcacttagactgtatcacaactccccattattacaagcttgagttttctgttttgtttttttttttaatttagatttgtaagcaatatgccaataaaataatttacttatttactatactataccttgcctacttgcaaaatgcttatagtatccaacaggccttacttagaaagtaacaaccagaagcaaatgtttcttggaataacaaactccacatcttctctacatcctgcatttttccctgtatattctgtgatttgatgcggtgtttttgtgagtgtgggagtatatgtgtaaagtgtcattatttctactaaatatataaatctagatagcaaaaatggttttttttgctacaataggcagtgaaacaattgcaaactatttttcttttgttaaattcatgaaatctgaaactttatatttttttcacttttcaaaaagtttttaaattatgaaatatttacagattcacaggaagttacatggaaatacacaggaagatcccatgtacaccttcacccggtctgccccaatgttaacatctttcattaccacaatataatatgaaaacttcatatccttggcctggcgtggtagctcatgcctgtaatcccagcacttcgggaagctgaggtgggcaggtcacttgaggtcagaaattcaagaccagcctggccaacatggtgaaatcccgtttccacaaaaaatacaaaaattagccaggtgtggtggcatgtgcctctaatcccagctacttggaggctgaggcaggagaatcacttgaacatgggaggcagaggttgcagtgagcagagattgtgccactgcactatggcctgggcagcagagtgagactccatctcaaaaaacaaaataaaaaaacaaaaataaaaacaaaacccttcatattctttaattccagtatctaactttgatttcaagattccctttgaaatttttaaggcttattaaccctatgaagtctataaccctgttttcctgttaactttcataattaagaatttgacctctaattactatgcatacatctattttatgaatttatctaataacattttatatgactgtcacttctctgtttatttcattaactttttattttttttaacagtaagagccatcttttgtttccaggttatttatttaaaaatccatcaagtctttggaaacagatgttaagttaatattctaatttatttcagaagagatttgacttcatatggctataaccaagaaatgcaaatctatagtaaagataatgatattttacttgctacttctcacaaaataggctccattggtttaaatttagtaactaagagtatttctttttttaagtcatattgtagaagattgcattttccaaagatgacaacaataatatttctggtcttacatgctcttccagaacctagttactaccccatttagaggtagaaatttttttccttccccttgaatttgggtgagctattgggactgctgtgacaagtaggatatgtaagaagtgaggctgtgtgacttctgagactaagtcttaaaggcaaaaagttctgtctggctctttctcttgagtcacctgcctttggatctcagctaccatgttgtgaggatacccaggccacaggcagaggccatgtggcagatgttccagctaaagtctcagccacaggcctgaatcaactgccagatgtattaagagagctttcagaagattccagccaccagcattttcttttcctttcttattgtgtcacttttttttctttccaacttttattttaggttcagggggtgcatgtacaggtttgttacatgggtaaattgcatgtgttgggggtttactatacagattattttgtcacccaggtaatgagcgtagtactcaataggtagtttttcaatcctcaccctcttcctatcctctaccctcaagtagaccctggtatctatgttattctcttctttgtgtccatatgcactcgatgtttagctcccacttacaggtaacaacatgtggtacttggttttcttttcctgtgttaattcgcttagggtaatggcctccagctccatccatgttgctgtaaataacatgatttcattcttgttatggctgtgtattattccatggtgtgtatgtaccacattttctttgcccagtccatcatcgatgggccgattccatgtctttgcgattgtgaagagtgctgcaatgaacatctgcatgaatgtgtctttatggtagaacaatttatattcatttgggtatatacccagtaatgggattgctgtgtcaaatggtaattctgctttaagttgttggagaaatctccaaactgctttccacagtggctgaactgatttacattcccaccagcaatgtataggtgttccctttttctccacaaccttaccagcatctgtcatttcttgactttttagtaatagctattataactggtgtgagatggcatctcatcatggttttgatttgcatttttctgatgatgagtgatgtcgaacattttttcatatacttgtccacatgcgtgtcttcttatagaaacgtctgttcatgtcctttgcccatttttcaatggggttgtttagtttttgcttgttgatttgtttaagttccttatgaattctggatattagatctttgtcagatgcatggtttgcaaatattttctcccattctgtaggttgtctgtttactcagttgacagtgtcttttgctatgcagaagctttttagtttaattaggccctgcttgtcaatgtttgtttttgttgcaattgcgtttggagtcttcatcatgaaattttgccagggcctatgtctagaatagtatttcttaggttttcttctacagttttatagttttagattttacctttacatctttggtccaccttgagttgatttttgtatatggtgaaaggaaggggtctagtgtcactcttctgcatattagccatcagtatttaagtcttctagctgaggacccaggcattgtggagcagagataagccattcctactgagccctatccaaaattcccgatcctcaaaatgtgtgagaataaaagtgattgttttttgctactgagttttctaatttgttacagagccacaaatgaccagaacacatgtacacttagatgtaaacatttgcaggaagagtatttggcattcattgggctacatctgttaatacctgtaatgttgctcttctcttggcttcttatacaatgtgttccattcttcattgatcagttagtctctactttgtaaacttcagcaaaacctacctagttaaaatgaacaatacatcttccagagaggcctcaggaactactgatgtgtgcaaagacctgcttccctgagaatgccctcaacatagcactgacagctctctgaattcccggtgaagtgcagcaggctaaaccatgtatgggcctgaatcaactaggacttttatttgcacaggtaagaggggatgccctagtgggccagggactggaatgttgtgagagggcttctccatcagccacaaccttcagcctgtacctcaaatcaaatgacctcccagttacccagagagagaccagaagtctcaccagtaagtacacaggagtctctgagggtgcaaagaataatgtcattccagaaatatttactaagtagccactgcatcctaaaaggatgatgtagggacttcagagtaggaaaataaccatgtaaacatgcagttaccatgtggtgagtactatagcagacataagcacaccaacttcccactgctcatggcccctctcgctacaccaacgtctcatccgtcacctttgctttcattccttgtcctgtcctcagacctccctttccagttttagtgcaaacacctcatcactttcccttgatgtttcttaaagggaacctagttgtccaccagcccaagaatgccttgggggttttgttaatattgcagacccctggctcgctccagactcactgagtcaaaatcaccagtggtgggatccagggtttgaatttttgtaaatgtcccctgctgattcttatgcatctattcttgtcttccccactctagtctctgctatccgattcactcttcttgtgaacactagattaatttttcagagcttgactctgataatatcactcccttgccaccttaaaatgggttaccagtgcctagcaggctttttgctctatatcccagtactcaaaactttttccaatctggcctcaacctacttcctagtcatgtcaccaataacccacatagagctagttgtatgacatacagcttgcttctgccaaatcgtatccccctccaccccctacttcccaaacatagccaggacttcccaccagctgcctgcctgaagggaagtttttcaagttagcctgacactctgaataccttcagctcttctgtggcagctggtaaaaattctccttagtacctagttcaaaggtaagatctcccataatatcatcatatctggaagttctctttcccttctctgtagcaccttgtcttaaacattctcatagtatctctcacatctctccttgtaataacaatatcattacttacctagtcccactcaccccctaaaagtattcaaatatgtgtatatatacatgtgtgtgcatgagtgtgtacacacactgagttaaattttaagtcaaatttatatatatacacacacacatatattacatattacatatacatgttgccagcttaaaatgggttaccagtgctcaaaactttttacatatatataaataaatatatatataactttattttattttagatccatggggtacatgtgcatgtttgtcacaagagaatataaggtactggtggagactgggcttctagtgtacccattacccaaacagtgaaaactatctgataagttatttttcaatcatcagcctccttccatccttcccttttttggagttttcagtgtctattacttccatctttttttaaaattacttcatctttgttaaagagtatactggccacttacatatattgtggccttttcaaaatttgctgaaatctgtaattctacaatataaatttatttcataatttctaaatactttgtagaaggttgcaatcatatttaaaatttttcatcagagtattctatttagtaattgttttgctatgaatacagacaaaatcatgaagtgctattaaaatcaagtggtcactttgttggagtggagagattctgaagtgttataaatcttatacattttataattattttattgacaaagaccaataaataagctgctactgagtaatataaaagttactttgcaccaaagggaatacattaaatatatattttgagttacctttgctcagatcctaaatcagtgaccctcattaaggaaccactgtgtgttgggacttctagtgtgccccggcttcatgcgtcacatcctaaaatgaaggtcactcagggtggaggggcctttaggatcatcacaactttccctttctcacaccctcaacccatatctgcctccctgggaggacaggctttgcagtgacatctctatcattactagttgggcatcattacctcactgtactgagccccattcccttattatgaggataaaaatagtgtcaccagctttctaaggttactgtgaggattgtgcagaaaaataggaaatctataaatgttgcctgttttattacaacaattccaatgtgtgggacctttatcagaaaacttagagaaacagaagacgccttacttccagagactggtaaaataggctgtgtctgtttttacaggttccagaatttctcctacctcaaatccccctatcagcctccaatcccctgaaagctggcagtgactcagatgagcctgtcagtctggaatcaatggttcatttctgctgtaaaagggacattggaagagagcactatgcctcactggtcatttgactgaatttatcagctcttttcctgagagcaaaagtgggagaattagactcgggtgggcctgcggcagagagtaaaaaagcagggatggactggaggtgaggagtcctaacaaatatgtttatcctactcaacattacctaaaaactagatatagccacacaaggaaggagaaaaacatctcttctgtgtgcatctttgcgatggatttagaggcaatgtataggaaggcattattgcctgggggttatgaacagaagctctggtaccagactgcctgctttcaaatcctggcactggcactccctagctctgtgatctttggcagattatgacacttgtgcctcgatacccttatctgctaaatcggggagcacaataattaaagttttccttagggttctggtgagatttaaataagatgacacatgtcatatacacttgcagtagtgcctggccacaaagtttcaataaatatggagagagagagagagagacagagagaaagaaagagatcacaaaatcggatcatactatactttaactttttatacttaatttagtgtgatttataatttataatctaagtagagataacccaaaatacatatttaatgtattccccttggtgcaaaataacatctgcttctctgtatccctacttattttatttatttattttgttttttgagacagggccttgctctgtcacccaggctggactgcaatggcgctgtcagacctcactgggaccacagtagctgggaccacaggtgtgtaccaccatgcccaactaatttttttgatttttagtagagacgaggtctcgctacattgcccaggctgctctacacttctgggctcaagtgatcctccctcctcaccctctcaaaatgctggggttacaggcatgagccactgcacccggccttatacttttcatatcttatttaatatagcaagttaacgtaatatttatatgtaaccctacactcttgtgaagaaaatatgcagaaaatatttctggaataaaaatgtatacatgcttctgcatcttcacgttacattacatttaaatcttcatcatattttaatagctgcataatgttgcatggtatgaatgcatttttctattcataaagagttccttatagggaaacataagatgtttttagctgatatggcttggctatgtctccatccaaatcttatcttgaattgtagttcccgtaatccctacgtgtcatgagagggacccggtgggaggtaatttaatcataggggtggttatcctcatgctattctgctaatagtgagtgagttctcatgagagttgagggttttatgaggggcttttcccctattgctcggcagttctttccttgctgccgccatgtgaagaagaacgtgtttgcttctctttctgccatgactgttaagtttcctgaggcctccccaaccatgctgaactgtgagtcaattaaacttctttcctttataaattacccagtctcaggtatgtctttattagcagcatgagaacagactaatatactagcattatcaaaaatgttgcaattaacaactttgtggtctagttttgcatgcaaatgcaaatagatccgtgggataaaatcatagaaacaaaattactgactcaatgtttatgcacgtctctaattggaggaatattgcctaagtgcagatgttttcgtcttttgcctattttctactgactggttttcctttttgtaatgatttataaagacctttgtctattacaaaattatataacttctgtcatatttgtgacacatttttctccaactttctcatttgctttttatttatacattttgttgtgcagatatttttaggcactgaaatgtacaaatcagtttctttttggttctgggtttctgacaagctaagaaaggatttccccattactagattataaaagaaaaagaaaaacaccgccatgatttttaaaatagttctatggtttcatcttttaaaatttaggttaagccatatggaatcgtaaaaataagtgattttagcctacaaaatgtcagttgcagacaaatgtatttaaacctttggtctgcttgaaatcgcatgtgtttgtgtttgtgtgtatgtgtgcatgtgtttggggtgtctgtgtgtgctgtgtgaaatacaaagacatgaggtaataagtcagctcctttcctctgcttccctatccaagagtctccaaatgatgacatgaatattctcatctcttacatatgtgggcctattttgaactacatattccaccctgagtatatatatgtctaaattactatggttggcaagtatattccaatatctaatagaattaggtttccctcataactcttcttttgtagacttttttctatataccatataatgtttatttttctgaattaatataattatttctaacaattcaaattttttaaaagtcttgctcaagagtgcaattttagcttaatttgttatctgacatctttattgtgagttttcttgtccaggaacaagttatgtctttcaatttagtccaagtcctcttctatatattcctcaaaagactgtgtcagatttttcctcatataatttctccgcatttgatatcttccaccttcttaaattctcttgctgttttttaacagcttttcagttaattcctttatgtcttccagtcatacattgataatatatgtaactaatgataggtttgccataccacttctaattatttttgttatttatttgtacccaattatattggctggtatgtgactactgactttggtgggaatgttcttaaaacttagcactgatgctggctatatacaaacatactctcatacacacacacacacacacacacacacaccactatgaagattttatacaaatcagaattaagtgcaaatttcatagaacttattttgcatttggatgggtacagagtttcttctttgggttattactaagataaattatattaatataattcataatattgaattatccctacattcctagaagactcccccatttggtaacacattactgtattaacaaactgctaagtctattctaggtcacagaaaataattgcagctctatgttgtcttcttcagccctgattctctgatgttcttcagaaagaaaatcggtctgtattagaacattctccacatctacaatggcttcccatgggccaagtcatatctttgtaaagggttattttgggaccatttcgcttatctttagagaagtccatatcctaactgagcttcagagtggtatgtatcagtctttgatgtctttcacttgatctgatccaattatcactattatttgacagatagagatactcctatcctaaagatttgggtaggagtatgattattttcaagtttaccaatgttgaattttttccacaatttttgcattcctttttgttgcttttgataagtctcagggaaaaataaaaacatccttccttatcatcttttaccagaactcctacaccattattccaagggctagctgctgctcctttgaatggctgtacttaaattatctaaccaatatcccatttttagatatttaggttatgccaaattttcactgtgatacatatcactgaaaagaaagaacattttaaaagaccaatattggagaaaatcaaattcacacaaaatagtgactagtagaaaagcaaaggatgcctgtagaataatgaaaaaactaatgaaaaagagctgcttttgtggggtgagttgctcaggcagaaaggaacagaaagggaactaaatctctttagcaacttcctcttatttaatctcttctctttccccttcccacatcctctcttgtagagggtctgctgtggcaatattgctgtgtgagattaggacacctctctctgatgtgtaaggtgcaagctagattgtggtggcaggcagcattatgtgtttccattctcttgagttctcacttattggaaaatccaggatagccattagtaatcacagaaatggttttaaaaccattgtccggaagaaattccttttctgccacatggaactcaactactataaattatgattttgggaatactacattgatttaagtaagagggacagtcaccttgaatcaaagaaccaactcttacattgggcttgtaaatgtttttctgtttaagaataataatagcaggatttaactggacacttatcttagacatagatgccgtaaaatttcaagactgcttcacctttatcacttgtctgtctgaagaacctagagatttacacagtctagctgacattcaagttctttaacttctcacccccagctgcttcatcagatacagatgtctcaaatcagacttaggactaaggtgggcagcagtgaataaaacataaatgtcaacaacaaaacccacaagaaaatttaaaataactttcttgttgagggtctgtactgggcattaaggataaagaagtatcttatataatctgtgccttgaagaagcttacaccgtgctgggctaaatagagatgacaattttcaagattgaaatgatcagtgatacaatgtcacacagaaaggcaagaactattctattaaaagttctttggtctggattttttctgtgtgtgcttttactccctgagtagatggacagccaatgagagtcctgatcagtagctaactaggttctaggacaagcaatgtcaagaatagacttgcagaagaaaaaagaatcctctcagcaggtcaagctgcccctacattatggataggaagggttggggaggagggatgtgtgggatgtcagacttgccagaggagctcttttgaaactcactgtccaggcttcctcgctttgcagttctggtgaacattagaagggagaaggaaaggcaggcacattttgaagtcttctaggtaattaactttctttcctcttcaccctgcatccaaaagaggctggtagggacaccctgcaaaggcccatccaggtgggtccctgggagggcacccagcactaagggcaccttttgaaaaataagccaggcttaaccctctacagccacataacaagcaagaaatcaggaaagccaagagttttaaatgcttgtattctttttctcttttttttttcaacagagacttgttctgttgtctaggctggagttcagaggcatgatcttggctcactgcaacctctacctccctggttcaagcaaccccaccacgcccggatcatttttgtgtttttagtagagacgggattttaccacattggccaggctggtctcaaactcctgacctcaggtaatccactcattttgggctcccaaagtgctgggattacaggagtgagccaccatgcctggccaaatgctgtattctaatccttccttttagtggcgataatgggtatttgttagccatttcatgggattatgtaatcatgaaatatactattattagttttgattatctgagaaaggctactagtaatctcagaaaaccattttctaccatgaaatttaatataaatattctttattttaaagtcttattttttatggtggctttaagtaaaaacctgttagtgtgaaaactcttcatcttctcatcagaaaatcaatcataaaaatgagttttggtaataaatggatctaaaccggtagaagtgcaggtcagaagttacaatgttaaaggtacaaaaatagaaccatatgggaacttttttctaaaaagtctgcagtcaacatttcatccatcaattcatatcaccattaatatttggaagctttgagtcaagcaagaatcacatgtgcatgtgaccagccctaagggactcccctttagagaggcagcaaaggcccggcataaccatctagcatggctctcttaattaatatgaattgcagttacccacttgaaacattaatgcaaaatgaaactactactttagcaaaccttagctggatccattttttcaatacacattctttcatattccaccagtttgctgtttgaacctactgtctcaatatataaaagcatacttcactcagcagaggaaccagaaccaatttgtccctaaacatttctttttttttttttttttttaaagacagggtctcattctatcacccaggctagggcacctagtggtgccaccatagctcactgtaacctcgaaccctaggctcaagcaaccctcttgcctcagtctcaggagtagctgggactacaggtgcatgccaccacacctgactaattattattattattattattattattttgtagagatgggatctcactctgttaccaggcctcaagacatcctcccaccttggccttccaaaagtgctgggattacaggtgtgagctactgtgcccagctaaaaaaaattatgtcttattactataactttgtaaactgtgttcatctgaatgaaatagtcacctgaggcataacaaaatataatcttagattataacaacacatttaaattaagacatgtatgagagaaaatccatttttttttctggaatattccacataggtcatagcatactacctaattttttatgttaaatgttttattttaccatgtcaaaaagacaaaaactattattattatattattcttataattacaaatgtaatttatatttaccaaaaaactacaagcttcccatagtttctacaattattactttaaaaaaaagtcctgtatggtttcttgttgccaagtgcaaaataatagtcttatctttgtgggtgtggttctggctttcctaacttgtctgtcactgatcactaataaacatcctttgtcccatctaaactgagttataggatgtgtcccaatttaccttaaggtttcccacctccactccattgcttatgctagttctctgcctgccaatggacaatctaattcacttttcctttgaaactcgtctcacatactaattcattaaaaatatcaagttctggctttgttctttttgcttaagattgctttgactatttgggctcttttttggttccacagaaattttagaatagtttttttctaattctgtgaaaaatgtcattggtagtctgacaagaatagcattgaatctctcaattgctttgggcagtatggccatttttacgatgttgattctttcaatctatgagtatgaaatgtttttccatttatttatgttgtctctgatttctttcagcagtgtcttgtaattctccttttagagatctttaacctctttgggtaggtgcattcctgggtatttcattttctttgtggctattgtgagtgggattgtgttgtttatttcactctcagcccagatgttgttggtgtacagaaatgctactgaagaacaaagccggagttatcacactacccatctttaaactatactatacagccacagtaaccaaaacagcatgttattggtacaaaaacagacacatagactgatggaacagaatagaaaatttagaaataaagccacacacctacaaccatctgatcttcaacaaggctaacaaaaacaagcaatgggaaaaggacttcctattcaataaatggtgctgggataactggctagccctaggctgaagattgaaacaggacccctacctttcaccatatacaaaaattaactcaaaatatattaaagatttaaatgtaagacctcaaaatgtaaaaatcctggaagacaacctaggaaatattcttctcaacattggtgctggaaaagaatttttggctcagttcccaaaagcaattgcaacaaaaccaaaaattgacaggtgggaactaatcaaactaaagagtttctgcacagcaaaagaatctatcaacagagcaaacaggcatcctacagaataagagcagacattcacaaactgtgcatctgagaaatgcctaatatccagaatctatagggaacttaaatcaacagcaaaaaaataaaataaaataaacaaaaaaccccattaaaaaatgggcaaaaatcatgaacagacacttctctaaagaagatgcacatgtagccaacaagtatataagaaatgctcaacatcattaatcatcagaaaaatgcaaatcaaaagcataatgagataccatctcacactagtcagaatggatcttattaaaaactcaaaaacaacagatgcttgccaggctccagagaaaagggaatgcttatacactgctggtaggaatgtaaattagtccagccactttggaaagcagtttggagatttctcaaagaacttaaaacaaatctaccattcgacccagaaatcttattactgggtgtatgctgggtatatactgggtattttttgcatatactgggtatatgcaaaaaataaataaatatatcactctaccaaaaagacacatgcactcataggttccttgctgtaccattcacaataacagagacatggaatcaattctggtgtccatcagtggtagactggatggagaaaatgtagtacatatacaccatggaattctatgcagccataaaaacaatgaaatcatgtcctttgcagcaacatggatggagctggaggccataatccctaagcaaattaacacaggaatagaaaaccaaatactgcatgttttcacttataagtgggaactaagcattgaaaacacatggacataaatttgggaacaatagacactatagactactagaaggtggagggaggaagtgagttaaaaaactgtccatggggtactatgttcactgccagggtgatgggatctgtactccaaacctcagcatcacacaatattgccatgtaacaaatctgcacaggtaccctctgtatctaaaataaaagtataaaagaaaatcaaagtccttcacttgataatatcctctccaccttcactcacagatgagagggcagagaatttattagtgcctctcttccggattatccatcatatcacaccttatataatcatctgtgtatttattaagtgaactggcatgtcttcatgggcccagtgtgagtgagtgtgggtgtgggtgtgagtgtgccctgcaatgcaacagcagcctggctggggcagttcccacctgagctcctggggtgggctctgaccacccgcaaccctgaactagaatatgtaggtatttatctttcttaaatgtatgtacaactcatttatttcaatgtttaatatgagaagtattttggtctttatttagaagtttggtgaaacttttgcaaccagaaatatgccacaggagcttgactcctgtttatatcaattaacttgtggtcaaatgggtttccttataagtcatctcacttgaagttacagtttgcagtttccaagaatctattgatagcattcaatgaggacttgtaccataaagaaaattatactacaatgaaatgtgttatgaaatgacatagcttgggctgggcacggtggcttatgcctgtaatcccagcactttgggaggctgaggtgggcggatcacgaggtcagtagattgagaccatcctggctaacatggtgaaaccccatctcaactaaaactacaaaaaaattagggtgtggtgacgggtgcctgtagtcccagctattcggaaggctgaggcaggagaatggcgtgaatccgggaggcagagcttatagtgagctgagattgtgccactgcactccagcctgggtgacagagtgagactcctttaaaaaaaaaaatgacatagcttgaagacatagaggacggaaaacattcaaggactctatagttgtgatctcagtgcattgagaaatgccaggttgagtctaagagagacttgaggtcagacagactgtgatttttaatgttgatggtgccatttgtaaaccatgtggccttgaccaatttactatatttagagtttggggcctttattttctcatttattaaacagagatagaaatgcctacttacagggttgtgaaaatcgtatgagatcattaagtagagcacctagatatgttcgcagcatgttagtaacatgggcctccacaaacaagagctctttaatcactaaggtctggaaaaaaccatagtgagcagaacccacccaccttctcattaacttctttttaccaatgttttagatgaggacaagattcttcccccaccccctgcctccgccccatcccattctgctcaattttcattttctttgtttctggaaaggcttcagtagctggagggaggagtcattgtcaggtgcacaaagtcaagggaagaggtgaagtcccataaagtctactggtcttgccattctgtgtgggacagggatcactgtaaggaatagtcataagactgattttttagtttgaaaccaaatcatacaaagaatggacaggggacataagagtgttgacctgtaagagaggaacgctgaggagaccagcatcacctcatgtgcaggaacagccagacaaggtcccctgaggcccaatgggataaaactaggacacatgaatgaagttacaaagagacatatttctgttcagtatacataaagaactgggttttggatgtttgctctatccaaagatggacagggaagtggttctaaaaggtcagattatattacctttaggaggtattctaaacttaatatccaatgaatctatgaaatcttcaagaaattttattttgatgctacacaagacccagcttataggaaacagggtgaattattttaaattacagaattgtgtcccatatttatcgtaaactatctaaaaacaattcattaaaataaatacgtcccttgatgtcacatctccctccagctaccatcagtttcccaactctcttgtacaaaaaactcttccaaggaatttctactgagtcagtctccacctcctcaactctcagtctctcctgagcctaagccaatcagactttcatcctcatgattttaaagaaaacattcttatcaattcccagtctctcctgagcctaggccaatcagactttcatctccactattttaatgaaaacattcttatcaatgccacaccttcaccgtaccacattccaagcttcattttcagttctcatatgacatgacctttcagcacattaccattgctagtttacaccctcattcttaaaactccaatagcctggatgcccagccatcctcttctcctgtttttggcttgttatttaccatactgctgctccttttcaggttcctttgcggtctcctgtcttttgttctgaactaaaaatactggggaggaccaagtgaacaatgatcacttctacattcttccttcagtaaatctcatctggataaatgtcatctttatgctcccaaatcataaacacatatcctcacccttgaactctcttctgagccccagcctgttcaataaaactgatttctcaacatctccactggatgtgaacttttcaaggcacaactgcttgatttcacacatcatcatccaagctccagatacactggttcaatttattgcaagaacctttatgtttgttatttactcagcctggaatgccttccccgctttcaaggctctgtccttctcatgcaggtctcagatgcaacatcaactcgttagcatgcttttgctgacacccctatctcaagtaggattgtagaagtttattaaatagtaggtgaatgaataaatgagcaatctggtttttttaatcgtaatacttaaaaatgttgccactagctattccaaactgccttgccagaaactatatattctttcccgaatttggaaacactgaaacagaaatctgttaacagagctgttgtgggaaaatgcaattggctctacatctgcccctagtgggaactctggaaactttacagcagcagccaatctagagtttaggctctgacaaagcagtaaacttcaaggtcacacagctgcctcacctgtacgatgcggctgttgggtctatgttctctaaggtctagtcccactctgaaattctatgctattatgtttcaaatattctatatcctgaatagctaaatggggaccttgtccttacatctgcttgtacatagaatgagaagagagatggagctagctgccctgatcaggccatcacagtggagaactgagggctcgaaccaaggggttgattctacatatttctttctgattccttgcacttctatcccaaaagagtgtgcctggcaaaaagggcaatctaaaaaaaaaaaaaaaaaaaaaaaaaaaaagcctcttgtgatctgtgtccctgggtggaacttagagaagaacaattgtcagtatttactttaaggccaattttacattatgaggtattttttgaccattttcttgttttaaaaagttatgattacagttttttgtttgtttgtttttttttttttttgagatgacgtctcactgtgttgcccaggcgatctcagctcactgaaaccttcacctcccagaggagttcaagagatgctcatgcctgagcatcctgagtagctgggattacaggggtgtgccaccatgcccagctaatttttgtagttttagtagagacagggtttcaccatgttggccatgctggtcttgaactcttgacctcgagtgatccgcccgccttggcctcccaaagtgctgggattacaggagtgagccagtgtgcccggccaagttatcattatagttttaacttttttattattattcttatttcttgaagctttccactatgcatggtgactgggagtgttcactgctaactttcaaggtaagtattgtacgtaagcagaatgaaaggaaaaggtatgggaagcatgatatgtaaaggatttatatcttgttaacgatggtattcacaaaacaacatgtttaaaaattaattgaaaagagatctttcttcttatcatcttcccttcctgttgaatttgacagtcaaatacatttggcattacagactttcgaacttaccagagcagttggtttatttcacaaaggactggtcctctctaaaggcacagacaaaggcacaagcaaaaactgctcatcctctgtgccaggaacatgagggcctccatatgtctggggaaaatgtgggcactaaattggtagacaaaataaaattcaataagatcactcttaccctcttctccaatcataggtatttctctaatagcataaaaaatttttgttaaattgatatgaagtggtagatttcatttacacacacttgctctgggaggctctagatattttagtaaaccaacagacatttgatttttgagcaacatgttttcccattgagcatatggagagaaatttatttttaaacattaaatagacgtgcatcttacagtaactaaaactacctaaagcactttcctgtttgcctcaaactttcttttttcttagatacagtgtctcactctagtttccgaggctggagggcagtgacatgatcagggctcactgcagcctcgaccttgtgggttcaagtgatccttctaccacctcagcctcctgagtagctgggactacagatgtgcaccaccatgtctgattaatttttttatttttattttttgtggaaatggcatctcactatgttccccaggctggtcttgaactcttggcctcaagtgatcctcatgccttggcctcctatagtttggcaagtacaagataaacggctgttgaattggatttaattcagcagccagatatctgctgtgttcagaatgagtgagcacaaactccagagaccatgtgactattatacaattatagactgcatgtccactgaagaaacagctacttgtaatgaattctttcttttgttgtagctattatgaatatatttataaggaaaaatccctaaaatacatgcttaaatatgtagtatatattatagtcaagcgatgtttttcttctctagaaaatctccctttttctttcgctatagcaactatggtagtgagtattatttactttttatatcatgatgatttttataaatacatacatattttcatttttctaagactaggaattgatccacgagctccatctaatttagtatcagtatcactgcattgatgaagtggtaacgaaggcaccatcccttattacatttaaacgaggtaagaaaaaggaaatatttcctgggccttagggagaaaaaagctcaggctcagatatacagattcagaaactgatatggtttggctgtgtccccacccaaatctaatcttgaattatagctcccgtgattcccatgtgttgtaggagggacccggtgggaggtaattgaatcatggggtcgggcctttcctgcgctattctcatgatagtgaacaagtctcacgagatctgatggttttataaaggggagtttccctgcacaagctctcttatcttgcctgctgccatgtgagacgtgtcttccaccttccaccattattgtgaggcctccccagccacgtggaactgtgagcccgttaaacctctttcttttgtaaattgccctgtctagggtatgtctttatcagcagtgtgaaaactgactaatacagaaactgaatatacacattaaaatattaaaacaattcttctttaagtaatttaattaagtcacatttgccagtttttcataaactcaatggtctcttagcaatacttcccataatgaatcagcttcaagagtttcaaaatagcatcatgggaatgtggtgtcctcttcatttgcaaagttaaaagaaagtctgccatttgtagagtgcaagaagggacaatgtggcaattagtcatcacagttgatgaatctgaagaattcaaaattcttgaatctgggtaagtctggtctttgtatgcagaaacagaagcaggtaacatataaatatacattcaatatgtgatctatctgacagataatacaatagccaagaagagtattttatgatataattaacagtgttatttttcatctagctgtgcttccatgttaatccagatgttttgctgctgttcatctttgtcacagagagaagcctaataataacaaattcaagtgatgttattatctttcttaatagatcagaggcctcttctgagtcttatactgtaatcaaatagagaacaaacatctggatttaattttcacccttctcgtgagataataaacagcacagtccaaggaaatttactgtttctttaataatttcaatactacaaattcacaggagagaaaaattatcgttctgaatgtattaaaaacactaaatccagccccttgagtcctcaaatgatcaccaattttaaaatggacaagccactggctaataatgactacacaagcctgccaaggaaaacatcactgcaggctgctctagtaagtgcttggaatacagaggaagaatgctctttgtgcagtactatttggatctacttatctgatggcattaggttatcacacacccacagggctttccagaattcctcccacttcccgcccttgacatgctgagcagtcctacattggtgacactatcagatcaaagaactaaaaatgtctttggttcccaaaggaataacgacaaaagaacaataaatgcttggaattagtgctgtggacactctgtctacaagagccagatacatcagggttttttgcctaatttttagataaacatggataaattgtgaaaagttgaaagaggcttggtcaattcctttggtaagaatcccaaactactgactataaaactgctcattatgtaactaaaattctgctgcctttctatagtaagaattaaaatccattggccagattcatttgagtcaagtgtattcaagggtattattttctttacattgctatgtcttctattgtttacttatcctacaaaagcaatggcattatgaaatcatatacgtatcctatagcatagaaagtcagacacaaacactctaacaaggtgctacaagtcaatagatgaagatgaactacatgaaatgatatctggtaggtgaaatgtagaagatgaggtaactggagacacaagaactacctggaaggtaaaaggtacgacttgggttgaaccaaaaaataatgtgagacctgaagagattcagtaaattctataaaatgtctcccctttagtgccaacaagagccagcaaagtccagtaatactcatcaggactgacgactccattaaatgcagtagcagttgacaagccctatgacttcacatatagtatgtaacaaaggcgaacagtttaacaggaggatagctctgatacggcacaaacctcagaagaggtgacgaaacaaaacaacagatggcgagaggctaaggaacagttgccatgacccaggtgagaaggaactgagagtccaaacagatctcacctatgcatggctttcttttagacactggggtataaaatgtataatccaaacaatactttttactcaaatggctggtaaagggtgataattttttttaaaaagctcacaattttaaaattgttcctatttttttaaaaagcaaacagaaacctttctttttggcatcttctcctttgtcttacatagaaacttaagtgcagaattttaaggctgattacggatgagtagaagctatggtaacttttttcccttggggttgaagtatctgtttgctggcaaataatgcaaaaaagaaacaaatggatctgctgaaaatctacttctgtatttctctcttaactaatgacaatcatttagctccaattttcatgttcatgtttccctttcttcttggctttgcttcaggtctaaattttccttgatgttcagagaaacgaagagatgggaaagaattggggtcactggaggaaagttttcctctagatggctctttattttataaagaataaaagagatacagtcagaaaatttttcagtaattcagaatatgaatgtatgcactgtgaaattaaaaactcttacttaaatgaaactacggtaaaaatgatattttagtaaagaactaaatgtccagtgaaggtctgaacaaacagtttcatcttttctagatgggaaacatgctgtgattcttcccacgtatttacaatgtcttaaagttgcaagcttaaaatcagacaatctgggaagatcactttccaaatctaacaaaacagcaaaagaaacttctccctctgagaagtgaggaagctttgctcattcaaatggatatgggatatatgctaaatggtttacaccaagctagggagcagccattcaaatcaaaagcagaaacattggtagagttcaacagtgagtcaagtcaaatgcctaaaaataggaagcaaagcatttgataattactgggagacaagatttatatatgatgtgatcattgtcaaggccatgatcaatagtagacctggctaggcatagggttaatttaattgaagaaattgaggttcacctaatccatgggttaataaatatattttaggcaaaccaaagaagaaggaacaataggctgaggttgacatttaattggcaatgccatcgagatatctggtagggcaaaaaaggcaaatacaagacagcccagtgtcgcctacacaaggtgaggaaacttcgcagcaggattagaatgtggatgcctaacttttccaatatacaaagaacccaggcaggctgctatcctgctgaacaggtatgggtaaaaatgaagttcaggccataggcaggaggagcccttaaacacccacagaaaacacgacaaaccatcattgaaacgcttgcagaatcactagacttagcaatagttctgggaatctaaccggagttgcagtttgaatggaagttaagtgtcattgagaggactggttcctaagatgagatcccagcagtagatgaaatgagaacatctaaacaggagtgaggagaatgtccactcattactgattccatatactcagaagtaggctgtgtgtaaaaagtgacacctgcctttgaaattcatccccggggttcacctggccattctcatcttgcctacccacatgctgcttgtcctggatggtcttgcccctgggtctccactcattttgatccagtgcctgtgctcctttgatgccaaagtcaggagcttggagataagttacctaatgcatcttctgtactctcctctctgcctccatcccaatttcctcaaccctcagcttgagaaagacttggatattgatatgggttaagttgtgccacctccacccactgccaccaccaaattcatctgttgaagttctaacctccaggacttcagaatgtgaccttatttagagataaaagtctttcaagttcaagtaagctcattagggtgggccctaatctacgataactagtgtcctcagaaagaggggaaatttggacacagaaatacccataggaagaaaatatgaagaagagataggaagaagacagccatctacaaaccagggagagaggcttggaacagatccttccctcccaaccctcagaaggagtcaccctactgaaatcttgattttggacttctagcttctagaaccaagagacaatgcatttccattgttcaagccacccagttatggtactttaatatgaccatcctagcaaggtaacacaggtacatctgcacaaagtgaagaatgaaggtgatgttaattagtactttccacaggcccatgttactcaattcttcatttaaacaaaatgcctctgattatatgtgtttttgttattttcaatcctttctggaacaagtagggtataaatacagatttcttgtgatctgaaactagacccacagttgcttcctctttttattcatacctgttgagttttaagtagctactattcatagaaagaaggaaaaaagaaagaaaaaagggagagggagaggaaaaggagggagagacataacaaaaattgatgaaggtgtgtgtgtgcctttctgaggcagcaggaaagagaagttctcctgtaagagctggcttaaatggagaggtgccccttttgtggcatttcaaggaaagacaaacaagccatacccataaaatgaagaaaagaacaggaggagcatatatgagccagaccagggtggagaagcagcaccaggggtcaaccagggcagaggatctgtgaatttcagactcagatcactagcctgcaggtgaaataatcattgccaggaacatgagacaggactttagcttcttggggcccatttctttgaagatttctcccaacttctcactctcactcacagcacaagttgatgaggctgagcactgaggcagttgctgggtgattcaagcaacaggaaaattaactccagtatgcctatatattacatcagagttgagggagacttttttggcctccctccctgatttccacgccatattctgcaacataatgactaaatttggctttaacatatcacaggtggttattttgcaaaaatgagtttacacgattttaaacgaaaatgctatggactgttctgtccttagccccaggatgataagtctgatcaaaggaaatgaagccacatctcctgacataagtttcctttcagaacttcccatgcaagttgggggatgtggatgtgacaggagttattctgtttctgggttaggtagttctgggttaggtagtttggctgcatttgaagaaaatggttggagactttatttgaaaatattccatagtaatggaaaagttatgcaaattcatctccctattctatatctagaatacatatgtatatatgttctagaatatatagatatgtatatctatacatacatatatatgtggattatttaagcccaggaattcaagggttatataaactcatctctctatttattttatatacatatatagagagtatatatatatatagatatactatctatctatacatatatgtatatatagatagatatactatctatctatacatgcatgtatagatagatatactatctatatatacatatatgtatatgtatatagatatactttctatatagatataaatatgtatatctctatatctgtatctatatctgtatatatacatatgtatatctatatctagaacatatatatgtatgtatgttcatatatgtatgttcatatatgtatatatgttctagatataaaagagtgatgagtttgcataaattttccattactatggaatattttcagataaagtctccaaccctttatatgtgtgtgtgtgtgtgtgtatgtgtgtgtgtgtgtatgtagtggtattgggaagggattatcactttattctttatactgttctatgttggttgaattttaaggaacttgcattactatataatctgaggaaattaagctttatttatttatttctttttgagacagggtctcactctgtcacccaggctggagtgcagtagtgtgatcacagctcaccgcagccttgacctcctgggctcaggtgatcctcccatctcagcctcccaagtagctgggattacagggtgtgcaccacctcatctggctaatttttctattttttgtagcgataaggttttgccatgttgcccaggctggtcttgaatttctagactcaaacaatccacccactctggcctcccgaagtgctagaattacaggcatgagccactgtgcccatcccagctattttaattttggaaaaaagttatagaaatctatctaataatttttgggggcagggcacggtggctcatgcctatagtcctagtactttgggaagtcaaggcaggcggatcacttgagcctagaagtttgagaccagcctgggaaacatagtgaggcccccttcccactgtccctacaaaaaataaaaaataaaaaatagctgggtgtggtggtgtgtgcctgtagtcccagctactcgggaggctgaagtaggaggacagcttgagcccaggaggtaaagtctgcagtgactagagatcatgccactgcactcaaacagtgagaccctatctcacaaagaaagaaagaaagaaagaaagaaagaaagaaagaaagaaagaaagaaagaaagaaagaaagagagagagagagagagagagagagagagggagggagggagggagggagggagggagggagggaggaaagaaggaaggaaggaaggaaggaaggaaggaaggaaggaaggaaggaaggaaggagaaaggaaaaaattctattaatggttaatgccattaatagaattctaaaaaataacaactatattttataaagaatatctctgcttaaaatacagaaaccttactagttttccacttgaacttatttctcatctaaagaagcaatgatgaaatcttgtatcttccaggcatcacattttctacgttaaattattaaatagctaactaggaatgaagaaataaaaaatggaatcatgtttcccctcttaaatcagaaacaaaagctacttggtacttcaaaatactgattgtccttgagatgtaaagggagtgtctaatgttccacatcaataatctgacccacatcagaagctattttggataacaggaaatagttatctttatcaaacatataaaagttcacattaatatgtggctgattgtaaagcgaccctgccaagaagaaatgcattagagcatttcagtctggtgacctgtacttgaggctgagtcaacacttccatgatacaacttcatctttgaggcttcaataactgagccaattaaaaccaattccaggttaaaactccacacatagctttctgggcagaaaggctctttttatagaaacaattttacttttctaaatgcacatctttaaaggtatttttatagctgtgattaaggcttggtgtttttgctaatttaaaaaggtattttttttctttttcttggatgtgtatgtgttcattagagtattgcttggttttaaataaaataggcggagtatgttattcaagtagttcataccttcccaaagccaaagttaaaatattaagttcaggaaagtaataattaacaactattcttcctaaatgtcttggacatgaaaccagagccaatttcccctaggataatgtagagtatgttaacattacaaatctgtggtttaaataccctccatgttcacagtctgtggcttggcagtgcttggagagaaaaagccacagtttgttgtctgtaacccagtggccatctgtagtgtggcaagaaggggatctcattggcatttctgtcataatgtggcctagttcctaaaacctggcatgaggattaaagtgatgaagggccagggtccaagccggagatgaagcatagcagtacacagggagactctgggggctacccggcattagcccaggaaggacctaaaccagcttccaaagagtccactgccccctgtccagagcaactcactgcaaaattcttcaagggcaaaattgtggttacaacttgatcgtaactttacagttcctgaaggcccaggacatagctgtcagttgcagagttagaatcttacctttaacagtatctggaccacaggagatgctcaatttatatgtgtcataggaataaagtgtctactaaattgccactctgcattttaccaatagaagagcacacaaatgcaaagaagtgaatcaatcatatggcaaagttttcaaaagagagtgtcctggtttttctgagtttttttgtttgtttgtttgttttttgagacggagcctggctctgtcgcccaggctggaatgcagtggcacgatctcggctcactgcaagctccgcctcccgggttcacgccattctcctgcctcagcctcccaagtggctgggactacaggcgcccgccaccacgcccggctaaattttttttttatatatttttagtagagatggggtttcaccatgttagccaggatggtcttgatctcctgaccttgtgatccacctgccttggcctcccaaagtactgggattacaggcgtgagccaccgcgcccggcaaaaggaaaggcatgcctcggttctcttttttttttttttttttttttttgagacggcgtcttgctctgtcaccgaggctggagtgcagtggtgcaatctcgtctcactgcaagctccacctcccgggttcacgccattctcctgcctcagcccccccagtaggtgggactacaggcaccagccaccacgcctggctaattttttgtatttttagtagagacagggtttcaccatgttagccaggatggtttccatctcctgagcttttgatccacctgcctcagcctcccaaagtgctgggattacaggcgtgagccaccacacctggccgaatgtccttatttttttaaccaatagcctgatagttaaaatttactagttcatgtgactacagtgagtaaggaagtcctatagaaaagtgtttgcaagagcccttctgaagcaacagaaaaaaactgatgtcaagatttttttttttcatgtttgttggccaacatcacggatcattagagaaatgcaaatcaaaaacacaatgagatatcatctcatgccagtcagaatgctgattgttaaaaagtcaagaaacaacagatgctggcaaggctgtggagaaataggaacgcttttacactgttggtgggagtgtaaattagttcaccatgtggaagacagtgtggtgattcctcaaggaatcagaaataccatttgacccaacaatcccattactgggtatatacccaaaggatcctaaatcattctattatcaagatacatgcacacatatatttattgcagcactatttacaatagcaaagacataaaaccaacccagatgcccatcagtgatagactggataaagaaaatgtggtacatatacaccatggaatgctatacagccataaaaagaaatgagatcatgtcctttgcagggatatgaatgaagctggaagccatcatcctcagcaaactaacacaggaacagaaaaccaaacactgcctgttgtcactcataagtgggagctgaacaatgaaaacacacggacacagggagaggaacaacacacactggggcctgttgaggggtgaggggcaaggggagggaacctagatgatgggttaataggtacagaagaccaccatggcacatgtatccctacgtaaaaacctgcacattcggcacatgtatactggaacttaaaataaataaataaaaataaataaataataaaaaacattaaagtgatgaactaaagtgtgtgcgctctcttgcttgcttgctctctctcttcaaaggcacataatggacaaggtgaattcactaatatccattcagtaaatatttagtgactattcacctcattttgcaaagttgaaaaagatactggctatggcctcaatagctctaactatttataataagtgctctaattacaggtaaatgtagtgttcataattttatataaattaagcacacacaaaatattagttatgcttttcaactcagaagagagctaaaaaggccatgtttcttaatgaagtatatattttttatcacaagggaaaatgcttacaatttcataactctggagagggtcagacactctagaatccagtcctattttgccttaactaaatgcttgactttgtacccgtcaatctttaggaacctcagttacttgtctttaaaaattggagttagggcagggcacagtggctcacgcctataatgccagcactttgggaagccaaggcaggcagatcatgaggtcaggagatggagaccatcctggccaccacggtcaaacctcatctctactaaaaatacaaaaattagctgggtgtgatggcacacacctgtagtcccagtttctgagaagctgaggcaggagaatcacttgaacccagaaggcagaggttgcagtgagccaagatcgcgccactgcactccagcgtggtgacagagcgagactctgtggcaaaaaataaaaaaataaaaaaaaatcagagttagacaagctgattttgaaagatttttccagacccattccaagatggccaaataggaagagctccagtctgcagctcccagagtgatcgacacagaagacgggtgatttctgcatttccaactgaggtacctggttcctctcattgggactggttggacagcaggtgcagcccacggagggtgagctgacgaagcagggtggggcaccgcctcacctcggaagtgcaaggggttgggggatttccctttcttagccaagggaagccgtgatagactgtacctggaaaaacaggacactctcgcccaaatactgcacttttcccaaggtcttagcaaccagaagacaaggagattctctcctgaggctggctcagcaggtcccacactcacagagccttgctcactgctagtgcaccagtctgagattgaactgtgaggcagcagcctggctggaggaggagtgttcgccattgctgaggcttgactaggtaaacaaagtgactgggaagttcaaactgggtagagcccacacaggtcagcaagacctactgcctctgtagactccacctctgtgggcagggcatagctgaataaaaggcagcagacagcttctgcagacttaaatgtccctgtctaacagcactgaagacagcggtggttctcccagcacggcgtttgagctctgagaaaggacagactgtctcctcaagtgggtccctgacccccatgtagcctaactgggatacacctcccagtaggggccaacagacacctcatataggcaggtctatatggggatgaagtttccaggggaacgatcaggcagcagtatttgctcttctgcaatatttgctgttctccagcctctgctggtaaaacccaagcaaacagggtctggagtggacctccagcaaactccaacagacctgtagctgagggacctgactgttggaaggaaaactaacaaacagaaaggaacagcaccagcattaacaaaaaggacatctacagcaaaatcccatctgtaggtcaccaacatcaaagacaaaggtagataaaaccacaaagatggggagaaaccagagcagaaaacctgaaaattctaaacaccagagtgcctcttctcctccaaaggatcacagctcctcgccagcaatggaacaaagctggacagagaatgactttggcaagttaacagagtaggcttcagaaggttggtaataacaaacttctccaagctaaaggagcatgttcaaacccatcgcaaggaagctaaaaaccttgaaaaaagattagatgaatggctaactagaataaacagtgtagagatgaccttaaatgacctgaaggagctgaaaaccatggcatgagaacttcgagatgcatacacaagcttcaatagccgattcgatcaagtggaagaaagagtatcagtaattgaagatcaaattaatgaaattaagtgagaagacaaggctagagaaaaaaaagtaaaaagaaatgagcaaagcctacaaaaataggggactatgtgataagaccaaacctacgtttgattggtgtacctgaaagtgatggggagaatggaaccaagttggaaaacactcttcaggatattatccaggagaacttacccaacctagcaaggcaggccaacattcaaatacaggaagttcatagaacaccacaaagatactcctcgagaagagcaaccccaagatacataattgtcagattcagcaaggttgaaatgaaggaaaaatggtaagggcagccagagagataggtcgggttacccataaagggaagcccatcagactaacagtggatctctcagcagaaaccctaccagccagaagagagtgggggccaatattcaacattcttaaagaaaagaattttcaacccagaatttcatatccagccaaactaatcttcataagttaaggagaaataaaatccttcacagacaagcaaatgctgagagatttttgtcaccatcaggcctgccttacaagagctcatgaaggaagcactaaacatggaaagaaacaatcgctaccagccactgtaaaaacatgccaaattgtaaagaccattgatgctatgaagaaactgcatcagttagcaggcaaaataaccagctaacatcataatgacatgatcaaattcacacataacaatattaaccttaaatgtaaatgggctaaatgcctcaattaaaagatacagactcacaaattgtataaagagtcaagacccatcagtgtgctgtattcaggagacccatctcacgtgcagagacacacataggctcaaaataaagggatggaggaagatctaccaagcaaatggaaagcaaaaaaaaagcaggagttgcaatcctagttcctgataaaacagactttaaaccaacaaagatcaaaggagacaaagaaggtcattacataatggtaaagggatcaattcaacaagaagagctaactatcctaaatatatatgcacccaatacaggagcacccagattcataaagcaagtccttagagacctacaaagagacttagactcccacagaataataatgggagactttaacaccccactgtcaacattagacagatcaatgagacagaaggttaacaaggatatccaggaattgaactcagctctgcaccaaggagacctaatagacatctacagaactctccaccccaaatcaacagaatatacattcttctcagcactacatagcacttattctaaaattgaccacataattggaagtaaagcactcctcagcaaatgtaaaagaagagaaatcacaacaaactgtctctcagaccacagtgcaatcaaattagaactcaggattaagaaactcactcaaaacctcacaactacgtggaaactgaacaacctgctcctgaatgactgctgggtaaataacaaaatgaaggcagaaataaagatgttctttgaaatcaatgagaacaaagacacagcataccagaatctctgggacacatttaaagcagtgtgtagagggaaatttttagcactaaatgcccacagagaaagcaggaaagatctaaaatggacaccctaacatcacaattaaaagaactagagaaacaagagcaaataaattcaaaagcaagcagaaggcaagaaataactaagatcagagcagaactggaagagatagggaaacaaaaagcccttcaaaaaatcaatgaatctaacagctggttttttgaaaggatcaacaaaattgatagactgctagcaagactaataaataagaaaagagataagaatcaaacagatgcaataaaaaatgataaaggggatatcaccacagatcccacagaaatacaaactataatcagagaatactataaacacctctatgcaaataaactagaaaatctagaagaaatggataaattcctggacacatacatcctcccaagactaaatcaggaagaagctgaatccctgaatagaccaataacaggctctgaaattgaggcaataattaatggcctaccaaccaaaaaaagtccaggaccagaaatggattcgcagctgaattctaccagaagtacaaagaggagctggtaccattccttttgaaactattccagtcaatagaaaaagagtgaatcccccctaactcattttatgagtctgggatcatcctgataccaaagcctggcagagacacacagaaaaaagaattttagaccaatatccatgatgaaaatcgatgtgaaaatcctcagtaaaatactggcaaaccgaatccagcatcccatcaaaaagcttatccaccatgatcaagctggcttcacccctgggatgcaaggctgattgaacatatgcaaatcagtaaacgtaatccattatgtaaacagaaccaatgacaaaaaccacatgattatctcaatagatgcagaaaaggcctttgacaaaattcaacagtgcttcatgctaaaaaatctcaataaactaggtattgagggaacatatctcaaaataataagagctatttatgacaagcccacagccaatatcatactgaatgggcaaaaactggaagcattccctttgaaaaccggcacaagacaaggatgccctctctcaccactcctattcaacatagtgttggaagttctggccagggcactcactgaagagaaagaaacaaaggatattcaattaggaaaagaggaagtcaaattgtccctgtttgcagatgacatgattgtatatttagaaaaccccatcatctcagccccaaatctccttaagctgataagcaacttcagcagagtctcaggattacaaaatcaatgtgcaaaagtcacaagcattcctataaaccaacaacagacaaacagagagccaaatcataagtgaactcccattcccaattgctacaaagagaataaaatacctaggaatccaacttacaagggatgtgaaggacgtcttcaaggagaactacaaaccactgctcaacaatataaaagaggacacaaacaaatggaagaacattccatgctcatggataggtagaatcaatattgtgaaaatggccatactgcccaaggtaattaatagattcaatgctaccaatgactttctccacagaattgaaaaaaactactttaaagtttatatggaaccaaaatagagcccacattgccaagaaaatcctaagcaaaaagaacaaagctggaggcatcatgctacctgacttcaaactatactacaaggccacagtaaccaaagcagcatagtactggtaccaaaacagatatatagagcaatggaacagaacagagccctcagaaataacaccacacatctacaaccatctgatctttgacaaacctgacagaaacaagaaatggggaaaggatttcctatttaacaaatggtgctgggaaaactggctagccatagatagaaagctgaaactggatcccctccttacaccttatacaaaaattaattcaagatggattatagacttaaatgttagacttaaaaccacagaaaccctagaagaaagcctaggcaataccattcaggacataggcatgggcaaggacttcatgactaaaacaccaaaagcaatggcaacaaaagccaaaatagacaaatgggatctaattaaactaaagagcttctgcacggcaaaagaaactaccatcagagtgaacaggcaacctacagaatgggagaaaatttttgcaatctacccatctgacaaagggctaatatccagaatctacaaagaactcaaatttacaagaaaaaaacaaacaaccccatcaaaaagtgggcaaaggatataaacagacacttttcaaaagaagacatttatgcagccaacagacacatgaaaaaatgctcatcatcacttgtcatcagaaaaatgcaaataaaaaccacaaggagataccatctcacaccagtaagaatggcgattattaaaaagtcagaaaacaacagatgctggggaggatatggagaaataggaatgcttttacactgttggtgggagtgtaaattaattcaaccattgtggaagacaatgtggcgattcctcaaggatctagaactagaaataccatttgacccagcaattccattactgggtatatacccaaaggattataaatcatgctactataaggacacatgcacacgtatgtttattgcagcactattcacaatagcaaagacttggaacaaacccagatgtccatcaatgatagaccgaattaagaaaatgtggcacatatacaccatgaaatactatgtagtcataaaaaagatgagttcatgtcctttgcaggggcatggatgaagctggaaaccatcattctcagcaaactatcacaaagacagaaaaccaaataccaaatgttctcactcataggtgggaactgaacaatgagaacacttggagacgggggcaggggagaacatcacataccggggcctgtctgtgggggctggaggagggatagcattaggagaaatacctaatgtaaatgacaagttgatgggtgcagcaaactaacatggcacatgtatacctacgtataaacctgcacatgtaccctttattaaagtataataaaaaaagaaagatttttttccatcaaaattatgaaattgtataactctttcaggatcacaacatttcaaccattaagtgtcacctaggaagctattttaaaatgcatatctattcctgctagtgaagtttgctttttaaaaaatgcagatcattgtataggtaatgttaacttgtcaaagtaggatgtttaatattattagccgtcttccaaatatttataaatatttaatggagttttgtacaactattgttatcatcatattaaatgcataaagatgactccaagactcaatgttgtcttgaaactatttttttttaaagcacaaagtaacaggagaacaaaatatacaaaactttcaaatatatcagaaataacattccttctttgattattattatggtgctaagaattattgttttgaaaaggagccattttatcacacagttgagacatatttcataagaaacaaaaacataaaatcaaataaaagttgttagagtattatttgtacacatgcatttccagtctgattaaaacatcttttacattaatttgttattaaatttattaattatgcataggtgtttacctacaataattatatagtcaaagaagtgtcataccattagaacacaaaatgatctcagaatatctgactcttactcaagagtttggcaattctttctcaacaaagtgttttcacaccttttgacttttacagacacaagagcaaagcactctttaggaattttttacatcttcactgaataagacaaagtccagagacagaaattttcaccggtgtttttgtatgccatgtatcacatttcctactaattgttggaacagagaaattaaagacatataattagcatgaatgtatccagaaataagcaaagtaattactagtttctcatcatgattattcagtatgacttaaatgtttttggtgggaaacttgatattgaaataattaatattcaaaatgatctttccttgtaaagaaatgtaaaggcaagcttcacttcattaaataaccatgaaatcatctttataataagttattttgaacccggaaagataaagttgtaagtgatgggtgggctcccaggtcctctgtataagtaagccgtagacaggttgcctgacagtgctcaggagctagtgttgggccgggcacggtcactcacacctgtaatcccaacactttgggaggttgggcaggagcatcgcttgattccaggagttcaaggccaccctacacagcatagtgagacctcgtctctacaaaaattttttaaaaaattagccaggcatggtggcatatgcctgtcatcccagctacttgggaggctgaggtgggaggattgcttgagcccaggaggttgaggctgcagtgagctgtgattgcaccactgcactccagcctggatgacagagtgaggctctgtctcaaaacaaaacaacaacaacaacaaagctagtgttgattctggtcaagggagcattgagatgaggatgagagagtctcccttttataagattgattccagatacaatttgaaacagctaatggctctctttgatgttttacttccattcttcttatacttttctacctcttaattcctcttctgcaatgaccctaaagtcttcagggtcccaagtcctccaaattctgacctcctcccaggactagcttcatggtgtgtgacctgagtggttgcacagggtcctgcactctgatgggccctgcacacagttttatgccctgttgtgtattaattactcctaataactgtttattttgtgctggatcctgaaaataaggtagccaggcttgccgcctatccataatgatcatgtggtcattaacagctatgcaaaagaacaatcttgaaagaatatgcatgaatatatgaatactaagttacccctcaattctctcggagactgaagtccctcaaatatctacttaggaactcggtttgccacttaaccactctagaactctgttatttcatctgcaaaataagaacagcaaattatgaactataagttccttcccatctaaacaaccacaccagcctatagggacttgtgctttttaaagggaaggtgtttttgcagagtaaaagatgacatgaaaataatttagaccatccagtagagtgctaccctggttaatttccttaattatatgtgtttgtttttgtagaagttttagtttttcaactattcattaaataaatacttacccatagtatctaccactcagtttttaaatttctccaattattatgtcactctcatagaccacagctccatgaggaaacaaagtctgtaagttacgtttacatttgctttcagaagacttgagcacagtagattcccaacaaatatttgttaaatgcatgaatgtatgattgaataaactaagtgcctactaaatgtcagctgaaaaaaatatgagtacctacttgtgcttagtactggatatccgaagttgaataagacaagatgcctactttcaaggttctaatacactaatggggacagagcttcttgcataaacccttacagactaatgcaaccaacaccttaatagaaacatgttcaaagtagagtacaaacgaggaatcctctcactctggctggtggtattaggaaaggcttcacagaggaggcaggatttgagctgagtcttgaaacttgagaaaggcaaaaggtaaaaagaacatgtaaggcagggaaatgagactgagattggcttgaaggaatctagaaattgttcgggggattgcaacaccatagtttatagaggctgagtagaaatgaaaaaaggaaggttaatcgaagtcaggcaatggacacccttccaaccataatgagtttatctggaaggttatagtgagtccttgcaagcttctaagcagggaagaagacaatggatgtcactgctgttgtgttttgaaagatctttcttattacaatattgggatgtggtctagttgaattcctacgtttctggatgtattgtaagaattccacttttttctgttgaatagtagagcaaggaatgctcatatcagccaaaattggataaaatgaaaataatctgtgagaagccccagaaaagtaaaggagctgaaaaagcaggccatgaatacggaatcagtgtaattcttggcaagatgaacgcagtggctcataacttataacaacaacaacatataacaaatacaacatcaacaaataacaacgacaacaacaaagaacaccaagataggtcctgagaatctcaaaattcttcccaagtcagtaaacaagtcaacagtagaataaagaagagcagatgaaaggaactcaaagtgccagtgacacatgtgaggagaaaggaagcaaatgaatggaaggcaattgcataattctaggtaaataacttttttaatgtgggtggagaccactgtttactaaatatgaaagattaatatcagcagaggaaggaattgtttgtttttaatccaagaggtcattgtgaacaataaaaaacaaaaaagaacataagttaccacagaaaccatttgttgaatacttaacaaatttcacgatatcaaaataattcaaaattgtacatggataatttgaaactgaatctgtctggggcagtcaccaacttctttgagatgtttccatgtatttatttgagaagaaacaaatagaaaattatcattgtctatcctcagcattatgggaaggctgcatatattcttatacagtaaattctcaactatttaaaataaattactacttatgattaactgaatacttatgattaacactgaatacttatgattaacaattgcttaattaaactacagactgtcatacaaagatcagaaactaggtatttaggtgtgagaatcacacacacacacacacacacacacaaagtgtaatatcctcattagccccaatctgaaagaatataaaagagaataataataacctgggatgtgaattgtttttctaagtttcttaagatatatgagggatttgtcacatgaaactgaaagtctggttcccccctttataagtacatattaccttaaattatacattcatggaactctaaacttcatgggctctggcgtggtcttcactcctcttacagagaccacgccaaggcctcagctctgatccaacataaacagggtcacacagccaccagcacagtggctaacagagtttttccagatgcagatgcaatttccccaattcaattgccttacttttggggagggttccatccaggttttcatggagaggaaatcccagagtttacaatgttccagacaatccagcacctgtagtgccatactttctcttttcttttcataaatttgagccctggcagagctaattaaacaatgatgaaagcaaggaaaatagacatttctgactccataaagaacttccccaaaacacaagcaggaataatactagtttagttacatagcaaagatctagagaaataatgtcaaggggtgaaagtggagacgtctaaggggagggttgcccaaggaaagaaggcactgagaggcggggcagtgacacacaagtgtccaagatggtaccgacaggagaatttctcaagggtcattgtcagctcatagcacggtccccaactcaacaagagagggaggctgattgagggagggcctgaaagaagagacgtcttactctgaggacttatgtctaaatgggctctacataaggtatagaattatatttaacgtgttcttaaagaattgctcctaaccagtgaatttctgagcatcttgaacctccttgtgggcaatgcacaaagccattctttatttttccagaaatgattttaaatgataggcaggcacacgcgcaccggctcagacctgatatttatatataaaatgcacatactctttttatatattatgaacatgtagaaacatgtacatgtaaagaaaattaacaacattaacacagttgatcactccctccttgaactcattctttgtttggctttcagaccttccttttgtcttttttcttcctaccacacaggctgcagcttcttagtctcatatgtgggactctcctcattccccacttccctcagtgttgagtgcccatttcacaaacctcttttcttcttatctgtccgggctccctgggtggtgccaaccaatctcacagctttaaacactatctctgtgctgacaacgtccaaatgttttctcctgctgtgtctcctccattgatctctacagttacatacatatactcaactcctttcctggaaatctaccaggtatctaaaatgtaacatatccaaaataaggtctcagttttcctcctcaatgctgttccacacaacagtttttctttatttcaaaactaaaagtgagaggaccaagtttaatttttttctcttatacaccaaaccgaattcatcaacacattgttttagtcttaccttcaaaatatatctagaatattaccacctctctccccatccaccgttcaacccatcatctgtctcttgacttgtcaaaaataacctctattccggcctcccagcttcccccattgaaaataaatataatattaactatttatattatatgcacttaacaaatacttatgaagtgtccatattatgaaatgcactatgctagacaatatgtagggcactgatgtgagtttgacccaattcctgtcctcaaagtttttatattctgggtgaataggttagatacatacacacaacccaatacaaagcaacagaagataattgtcatattgtgctataaagagctagaggggtttagaggaaggagaggaaatttctgattgtattggcaataaagcctttgctgaggaggttgcattgaaggtgggccttgaagataagtcaggttttaggaacagtgacttgagctcattccagaaggtgccccagaaggagatgaaagagtcaggacatcttccgagcatggaaagtagtaacatttggctgacataggtggatatatagaggagctagaggaaaaagctgttacagttaaaatggacttagaatatggaatcccagccaaagaagttgggactttaacagggaggtcaaagaagtaattttgctatatgtgtttaatgttacatcataagagtaacaaaagtaaggtaatatgtttaaaaaaattcatgtggaggtaacaagatatagagggatactttatgttttatttgtagaccttagacactcttacttttagaggcctgccacacactatatcaaaggtgcaataaagtgaatttacattacatgccatataaaatatactgacacatatataatttttgaattgatttgatttacatttgactgcttgccataatttagtatttgtaaacctttgcttttttttttttatttaactgttttctttttctatttgagagcgaatattttataggtcactgaagaccctgaaggcctgaagcactttctccatgaagcgcgatggatgaaataggttggcaaacagagaggcttagaggaccaagcactacacaaatgtaaacactttcataaatttattaataaaagtgatgtgaacaagtaatataccatttaaaaggaaaatgtgctcaaaacattgtatctacaaaaacaacaaacacatcactcattcaggcaagatgtgtatctttaaactgattttatagtaaaaaaccactcgattaaaacaaaaattcagatacacattcttcaaaaagagggcaggtaaagtaggacccaatgtaattgatttaattggttaattgccttgatcaattttatcttcaattcattaagttaggcataataatttattcatttatttatcaaaaatgtatttaactataatgttccaaaatataaagaaatgatcactgttttgtatcatacttaaatttgagataattttacacaatatttatgtgggaaaagagagattaaacccaaagggatttcagcctaaatacaataaatgagtttttgacactgttttgtgttttaataagaagagtcattaagttagagtaataaagtataaagttttttaaacttttattttaagtttaggggtacatgtgcaggtatgttacataggtaaatttgtgtcatggaggcttgttgtatggattatttcatcatccagatatcaagcatagtacttattagttatttttctgatcctctccctcctcccagcctccaccctccaatgggccacagtgtctgttgttcccctctatgtgtccatgtattctcatcatgtagctcccacttataatgagaacatacagtatttggttttctgttcctgtatcagtttgctaaggataatgacctctagctccatccatgtccctgcaaaaaacatgatctttttctttttatggctgcatagtattccatggcatatatgtaccacatttttttgtgcagtttaccattaatgggcatttagattgatgcaatgtctttactattgtgagtagtgctgcgatgaacatatgagtgcatgtttctttataatagaatgatttatattcctttgggtatatacccagtaatgggattgctgggttgaatggtatttttgtctttaggtctttggggaatcaccgcactatcttccacaaaggttgaactaatttacactcccaccaacagcatgtaagcattcctttttctccacaagctcgccaatatcagttactttttttactttctagtaagagccattctgactgttgtgagatggttttggcttttattggcatgtctctaatcatcagtgatgctgagctttttttcatatgaaagccaaggcgtcctaagcaaaagaacaaagctggaggcatcatgctacccaacttcaaaccatactgcagggctacagtaaccaaaacagcataatactggtacaaaaacagacacataaatcaatggaacagaacagagaacccagaaataagaccacatagcaacaaacatctgatctttgacaaacctgacaaaaacaagcaatggggaaaggctttactattcaataaatggtgctggaataactggctagccacatgcagaagactgaaactggacctcttccttaccccatatacaaaaattaactcaagatatatacaaaaattaactcaagatatattaaagactaaaatgtaaaacacaaaactataaaaaccacagaagacaacctgggcaataccattcatgacacaggcacagacaaagattacatgatgaagatgccaaaagcaactgcaacaaaaacaaaaattgacaaatgggatataattaaactaaagagcttctacacagcaaaagaaactcatcacagtgaacacacaacctacagaatgggagaaaatttttgcaaactatgcaactgacaaaggtctaatatccagcatctataaggaacttaaatttacaagaaaaatcacaatgccattaaaaagtgggcaaaaaacatgaacagacactttgcaaaagaagaagatatacatgcggccaacaataattagtataaaaattaatcaaggcattataaaaacatttcaatcttcacaggatgccaagctttttcttttccaagctatgatcatagccaatgatgctaaattaaaagaaagttacattttcatcaattatttattattatttcatttgacttttcagtatacttctgttagtctgaagttttcttttgtgtaatgaacttataagaaatattatacttaaaacaaaaaaggtttaaggtttttattactcataaaaaattttcaagaggagattgtgattactttatactgaacacttagcaaatttcatagctatatctccaagggtaaatgcttatccttttttgtttgtttgtttctctttcaatctattcacaaggtttaataatcaaaatttgtccttgcagtgaataatcctactctcctattaatttttttgtatatacaacacctaagcatgcacattttaatgttttctggcatttaccactttttctgtaagattgcgttgatgtcaccccatcctacaataaccaacactgatatgttcattttagaaacataaagtttaatacagtatgttcacatttaaaatgtagttaataaaagtcagtcaacaagttctttttaagtaactataaaaaattacaaaaaagccttaaaatgttgtcactatctaaaagaagtttataatccaaagagttcagccatttattttcttagttgtgactaagtgactccgtaagccacctgttaaatggatcccctttagttggtcttgaatagcagaaaatgtatgtactaattatgtgcatttaaagttttaatacccctttattatactattgtcctgtatttgcttttacggttatatttaaattgagtaaagttccagaaacattcattattcttaaaagcaaatgaaactctgcattgcagtctgactgctcattcataattcagtatcccagcctaaaacattatgctcaaacaagcacaaatattggcaaaggtgaaatattgaatggctactgttgcagctaaattatgtagcaatctctgtgtgtgctttaatttcctagccctagaaataaaaattaaaagcaggaaaaatagtcagcaattatgggtgtaagctaaataagcaagggagtagtgccaagttgcaattattcaaagctgcatgctctttattagttatgcacaggtctgaaatgacaatgaaacccaaaaatggggaaaaaaaacctcaaacacattagttactcattatacatatctagacaaagaaaaaggattctaggagaatgttcttatgaatttgaactttgaaaattagcaactctggttctgtttacgttaatggaaatttacttttcctcaaatttgtcttaattatctgggcaataataccagccctccatttattaggatcttgggcacttgtttggaggttccagcaggtaagcagggttactaaatacccttgacagaggacagatctcctctttctgtggagattggcccctctttggacttaaagcattagtaaatatgcacagtgacaactgagagcaagagacctgcacgtcaccaactgaatcagcagaattaatccagctgatcaatttgtgaagtcacactcgccagatcactttcacttcctgccatttcacccagtttcctttgatgcaggctagatgtgttgcattttgtagcagtacagactttacattttgtagccaacataacctatagacatgaagtaattgataccaaaggctagtgataagtatctagtgctcaggagttttgtcttctgaattttcaggcttactcttctaactttgtcaggtacccttatgccaccttataactctctcttttatagaaataaaagctaattaatgcaataagtatagttactttattgtgtaataaaattactagttttatacagcacagagtgtacaaaactattaacattcctccaaaaatccggatagttagaaaaatttgcaggaaaaaattgaacaaattatcaggctgtgccttctcatccagttttcttccatgactatttgaatggctcaccatatcacagcatttataatttttaaatctcctttagtaaattatctcattgagcttcacaacagttctgagaggggctaagcagatgggagcaatccacattttgcaaatggggcacctagacacgtagatgttaaatagggcatccactgtcacaggcctatttgtgtgatagggtgagaggctctagctctttcctccatgccacagatttctcaagcaaaactaaatctactaaaaaacataataaaacacaacattaaatcatccatactcttcactttcctctcacccctaacccaattatcttaataaaaaggacttccactcaaactaatatcagaatgaagagtagagtgtttgtaggaacacagtctgattctgattgagtttattcaaatttgctgtttgcaactttcacttatggtcaagatgtatgtcatccagagaatgttcacatctaatatattcaaaggaaaatctgctttactaccttattatcttccccacacttttgtaagggactcaccgacttcctttccatcatttcatagatgatgtcattgaggcacaaaatggttcaacaatttaccctcagacaaacagccaagacaaacatagacagtggaatggaactcaaattcagcattgcatctacccaggtgaagatgtacaacttaaatctgagatccttggtgctggtcagacccaagcagagaaattttcagcccatggaaaaggtctagacccatctatatattcagcaaggatattttatctaacaaggctctttctggcatgacatgtgggattggtcaacaagaaataggaaacatgtaccactcacactgaagcatcacaaaccagtccaggcagataaacacgagtggggggtcacttgaacacagaagctctcaatcaagttggtgatctctggacagacgtggagaaactcctagttccaccaatatcctgattttctatagctgtgagcatgttctgggtcatgaataccccgatttaagagcttggtatgtatttgaaggtcaagaatgcttaactggaaattactgctatgcacagcaaatgcattataagcaaagaaagtgggtctgtgacaaattaatatcattgatactgtgcaaacccacaatgatcatttgttggagatactagaaaacctaaaagtcaagctataacattatgtttaagctttcttagcaaagactagcacaaaactcttctaaattggggtatttttataccttgaaaccatgcatttgaaggctgggcttatgacattgaatatatcgttaggattctaacaatgaagcagtgaatatatcattgggattatgacaaagaagcaatatctttagataactacaggtgataattatatttgtttcaaggaatattgaaacataaatgtaaagaaaattgacaattagaatctgttcacctatgagtttctatagtatttccctgttagttttcttctagaaagcagagaagagcagccgggcacggtggctcatgcctgtaatcccaggactttgggaggccaaggcaggcagatcacctgaggtcaggagtttgaggccagccgggtcaacatggtgaaaccatatctctactaaaaaaaaaaaaaaaaaattagccgggcatggtggcacatgcctgtaatcccagctacttgtgaggctgagggaggagaatcgcttgaacagggagatggaggttggagtgagccgagatagtgctactgccctccagcctggaagacagagcaagattccatcttaaaaaaaatcaaaagcagagaagagaaccactgttgtttgttgttggagaagagcatcactgagggatgcaggactagtctgtaccctgccacgaacaattcatcttatcacatcgtttcatctctttgggcctcttttgcctcatttttcttaaaaaaattctaaatatctaagggtcttctagttgggaaatgccactggttcacctatttgacaatagcatatagctatatgtccacaacttgtccataatctatcaaaacaactgaggatgtattgtcactggtattattgaacaacagcagcagtacatttgacaataactcttaattcccaactggacaatgaataaccatgtaagacatgctaatgcagacacaaaattacaaaaaaaaaaaaaaaagctgtatttttatcttttccttctatgtaatgaatacagcatctgaagacagcatggccctgtttgaaaacactggaataaagacatccatcccattctgggctataattccatgaaattgagtaaaaccccaaacaaatttaactgattgtgggttaagatggtatttgaatttttttaaaacctgaaatttcttccccctaccttgcagcctctgcatcacattggcgatatcccgaggacaccgggaggcccctctggaggttgccatggtccctccggaagcacgaagccaacaccaagagactcttcactggaggcagcacagggctacaccactctagaaaacatgcttggacttttctagatctattctgtcataaatgaattccaggcctttgcagcactcaacaaggaggcagctctcccaaagactgaactgcttctttttcttcttccgttttaagactgtcctcttacatgaactcaagaacctgaaaaacaaaaaagaaaaggtacaacataaaaaaaaaatctacgaaggtcaccacagtgctaaaaggagaaatatttctatttaatttgaatgcctggtccattatcaagtgaaacaacttagtgaaaagcacttataaactacaaagtactatgcaaatgttaggaattcccatgatatttaataaaataaatacataaatgagacatataaaataaaattgggttgctaaaagaagaaatgttcactttcattccatgttttctttttaaactatcaactttttccattgatctatgaaagtggtttcccttatactaaaaacactcaattctagttttcaatatgcacgggttctctagtctgctaatttagcctgctttgcacatgttttgctctgttgcgttgtactctttccaggaatgggaccaaatccttgtttctcataccaatttgatgaattaaagcagtataaatgtaaaaaccatttaattctaaaaatttgagtttcaagtactccaattttagaagccaaatgggtatgatttagtttttttcctccctatgtataaagactcaagagttttaaggctagggtggggtgggtgaagcagagtggacattttccttctaaattctctgcattggttaagtttttgtttttgtttttgttttgggacagtctcactctgtcatccaggctggggtacagtggcgtgatctcagcaagctccacttcccgggttcaagcaattctcatgcctcagcctcctaagtagctgggattacaggcgtataccaccacgcctggctaatttttgtgttttttagtagagacggggtttcaccatgttagccagactcgtctcaaactcctgacctcaagtgatctgcccacctcggcctcccaaactgttgggattacaggtgtgagccaccgtgcctggctggttaagtttcattgccgggggggggggggggagggggaggggaggagggggtgcagtgggctttgggaagaggtaggagagtagtcgttgaaatcttgatattgcaaaatgtactttaaataagaatttcctaaccctaggtttagctgaagagaaggtattgccataaacgaaataattagacagaaagaagagggggtgaataatgcaccaagagaaagaaacggcctccgaagaggcccacagggaggtgatacttgattacagttcccattgcatttctaggttatgatgatgaaggttaaaaaaggaatgggggaagagaggaagaaggggagaatggcaaaagcaaaactcctaaagaaagctcatacatgtgagatggtgcaccttcctgaaggaaaaaagaaaatgagaggagcctgtgagtgctgtaaaaattatattataacttggattatagtccataaaaggactttgctcatgaaggattggttaaataatagagtgcaattatgaattacaatttattttaaaatggcattactaatactattatatattggtatctggtcagaatgtatgaatgcaaagctagtaacatgctttttagcctattatctaaaaaaaaaaaaaagatgcaaacctttgcacattgctgctgccccatgtgcaatgcatcagaaggatgtactggagcaagaaagcattactaacttagcaagacatgggacagcgatgcagtgaatggaagtcattggtaggaagatagaggcaaacttctcttggctacttgaaaggagtatatactagaagtaggacccaatacttggtgtcttataggctagagaggtacttctcagtgggtgactctccaagggattcttcatggagaaataattacttgtggttgggctgtcacatacatacctatagccctgctggaattgtgtgcccattagcagcctgtatatcctggggaaaaatattccacctgcccacatacaaaagctatcttaatttgggagaataatagatagtgaaaagtgcctgaaggaccttataaatggatcccctaagctattaggaagttaggttttcaaatgcaaaaatataactttctgaaatcaatcaatcaaccaatctacctattatctatatcatttatctgcatgtatgttaaagacattcacttcatttcagataccccactccaagctgggctcagcactggagctcacagatgattaacacacagtccccaccttcaatcaagaattatggaattaaaagggatttcagttaaatcattgcaacagaaatcactctgcctctatcctcttctaattcacattcacatagcttggtagattaatctgaaatactgtgcatgccctctctctctctcgttacattaaactcagaatttccctgcatgtgcccagtattcatccagtcttactttcacagcataactaacacattcagagtgccagagctcaatgctgggattactaaggtggatatgacacagagactatttttgaagagcttaggacacagtgggagataaaacatagaaaagataatacaaaaataccagggctaagtgcaaatacaaagatgtgaagatacagaggatggtggctaagccagtgtgggtgttctggaaaggtgtccttcttggcaaggagcagacacttgagctgagtcttggtaaatgggttagtcactcaggtgaaacatacgaaagacacatcctgggcagggtgaagagcttgagcaaaggcctcagcatgagaaacagcatgactgggacatggaactatcaccagtcagacactgagaaactctacaaggtgacattgtggaaaagagggcggagagtgaggtggtgtccagatggcgcagggccctgagtgctatgctcagaagtttggttctggttctctagcaggcaacaggaagccactgagagatcttaagctggaagtgagaaggtatgattgggattattctagctatgattttaaaggatgtatttgagaaggacaaaactggaagatccagaaagatcagttaggaaagtatctcaggaatccaggtagaagatgaccaaagacggaaatcagacagaggtagcagagtgagtggagaatcaaatataacacagctttagggaacaaaatttgtaagacttggtgattggtcacccaggggtggaggtgggtataggtagaaggaggtggggtttccagagtgtatatctgaggagtctcagatgactctcaggatttggggtgccattaattgagctcagcagaagaggggccttataggttttacatccaaacactctccccttcatgcttcatatctttggaacaactcaggagcaatttcttcattaccccttcacatcacccctctgaagaacactttcagctgaacaaatggaaatacctagcccaggatccacataccacttgaagcttttcctaaacacaccaaccaacactcaccattattttccactgaggcctctaacatcaacgatccatactatcctaggtacaatttggcttctatctttcactactgctagtcttacctcactctaaagaaacagtgaacatttcactggtatagaggctataacattgcaaaatctcattcattgacaccaagtatatccctgaccacatcctaggcccccgatatatattttttgtttcattgaatcaagttcataatactttacatttatgagaaaatccccagaaaacctcttcctcttcaatgcaaaaaaaagtggatgcaatatccttcctttttcagacattaaacattttgctttcatcattcacatgtacacatatttcctattttgtgaaatcatgattttcttgctttttactgatactttatctaattacatgatttaataagaaatttaaatgatgttaataaaaagaaggtaataaaaggagactgggaattaggaaatatcagttctaggctaaactttatcccagctagttgggtgattttgagctggttctatgcatgaaggtcctcaacaactacctattggaggagagtgtggtaccaggaaatgcacagactttgatctaagaaagacctggagctgaatcttaattctatctcttactgtgcacgcaggcttaagaaaaatgagcttttctgagcccttctttcatcatctgtaaaatgaggtatacttatgccaaattaggtttaattttatcctgcttaaattaatttttttaaaagataaatatgtcatgtttccagcagattgattggcatgtagcagagtttcagcaaatactagtttccattttccttcccctgttcccagtttctccagctgcaatatgagagacggccctaaaatgcagaggtactcccaagtgtgctcttctgttccaaaaccaatagcagcacaaggcagagctaaaacaacgactggtgcaaggtcatgagatcctccaacagactgtttacctagcagtgttctggctatggacatgacagaaccagaacaccagaggcagatccagaacatcaataaactcactattcccaagattattaaaacagtttttaataggtgcaggatactgcgggagcacgaaggagagggaatgaagagtgaagctaggcattgggatggaattggagaatttgatggacattcatgggctgtataccaataaatagtccctgcaccatctccaaatttttccaggggaaggaactaagattatgatgcagctaaatacattcagaaaggtaagattcctgtatttattatttcacaataaatatgtattgagtagctatttgtaagggaccatggtactgagtaaacagcagtcaacaagagagacaagcccctcttacagcttatgtgccggtagaggaagatgatataaacaatgttacaacaaaggagggcaagtattgtaatggaaaagtccaggctactatggaagcaaacaaaacacccacccaatcaataaccatctgctgcattttttttttgttcaggacacagagagaatttggactatctgctatttgggatgctcccagttgaaaggcatactcttcttaggaatttggactacctgctatttgggatgctcccagttgaaaggcatactcttcttaggaatttggactacctgctatttgggatgctcccagttgaaaggcatactcttcttaggaatttggactacctgctatttgggatgctcccagttgaaaggcatactcttcttaggaatttggactacctgctatttgggatgctcccagttgaaaggcatactcttcttaggaatttggactacctgctatttgggatgctcccagttgaaaggcatactcttcttaggaatttggactacctgctatttgggatgctcccagttgaaaggcatactcttcttaacatcactccctgtgaaaaaacacagttgtgaaatagcacaactcaattttttctgtctcttggcagaatggacattggctcttaaagcagtttcttgtttgtgtgactaaaaaggaatacactaagaaaagcactgaagaaatactactgagccacaagaatatatataagcaatgcaactgaatttctaggtattaggaaactactgcagaaaatttcaaaccctgcaatgaccagagacaacgtggctcatttctaaccaaaaagaaaatgaactgagaacataaacacataaacagattcacaacagcaggaagtacagatattaattaaatgtctaaacatgtataagaatagcactaatattgaaacccactattgaataaaatttttagtcatgaataaatttcagtttcccttctattcaagtcttttgctgaagagagttcacatactgtttaattttaaatttaattatttttttctctattcacccattaataatggtactaattaatgaatactaagatggctaaaagagaagaacagggatatctttgaattaatgtaagtatattactaataaatgtgtgcaggttatcagggaacaatgctgtttcttattcactagtatgaattatacagagtaacaataagaaatgatcttttccatagaagaacatgaacaagtaagcaaaagacaaagtgtatagcagaaatcagcatgaaagatgttcagtgtcataattaaattttgtttattgtaagcctaaagtataaattacaaccaaagacatctgcaaccttctttttttcccttgctacagtatattgcacaccttgccaaacattagttctcgttagattagaccacaaagaagtacacatttaagaggagacacacagaggacctcgcagaggcgtttgggccctgcatgcctgtcacattcagaccacagggtgtggctgcagtagctagagctggagttgtgaaaatgccaccaaccttgcccagttatgggcttcctacatcctgtgacagtcacacctcctttcatttccaagatgctgtgtgtgcagcatagttatcagaaagtaggcccagtgcagcaccaaacaattcttgaacatttttaaatggcaaactagctttttccaatctcctctccctggcaggaaggactcaagtaaaaaagagttcttaaatgaggtcaatgaggacagaagaaaaccagtttgtgaaaatcattagttcagaaagatgaaagtgagactataaaataagagctaggcaaatatttccaaagcctagcaaatattgttatctgggtcagtctgaagctgtttcttaatcttcagcatgaaacatattaagttagtatagatctctcacattttgttctaaatctgccacaaagtaatgaacagaaaagaaaaaatagatatgtattttgtcacactgttccggtgatatcaggaactttttagccatactacaaatcttttttcaccatggggaataaaaagcctctcaaagaacaatcgtcatgactcgtgattaaattcgcattttatgaagatgtaggtcatattaatgacctttgcctcattgaaaattattatactttctcttgcataggtctggcttctgtatacgaatgttgtctttaggaaagtcattctcagatgaagacaaaaaatggatgggcattaaagaagagaaaaataattcatttttaactttcttaacattcacaggaacatttcagatacaagttttccaccccaaaacgaaaagctcagaaatgaacattgtgggatgctaaggcttcattgctgatatttccctctgggctggacctgactctatttacggaagggggcagaacttccagcatccaaagtctgggatcccagtcagcacacccagcctgccttcccaaggggcttcttcctgtgcggctgatggctgcttcgttttgcacggatgcctgcccgttgggatgcacctggccgcctgtgcaccaccatttcccagaactcctccgccagcaatgcaagatctctctatgtgaaacgtatctttataaagaggagacgaaagttctcttgccctctagtgcaggctctgccgggaagcaactgcaccatgacagcgccgctggagtctgacgcgccagggcctccgcgcagccttcaagccatttccctcccccagcccttcctaaaatagtcagggggtggaggaagggaggctcctagaatctgttcaacgccctacctctcccatctgatagtagcaacagtaccgaccatcacaataagaggctggctgccttttgcttctgcaccattggagcccaggagatgtgccacaagcggaaatgacaactcagagagggggatattaatagggacatctacgtacgagatgcaaagaggctccccaacctcctagtctccttatctatgagtatcgcacacgtacacacatcactgccaccaccccctcccatcaagcacgcagagccccagcgtgcaggcacaaacttgctgacaatttgtctgcaatgtgttcgtcttgcacctctctctcctctccctgtctctgtctctccctgtctcccagtctctgtctttccttttaccttctctctcggcctcgttcagtttcccagcagcaaggcgaagcgagcgaacgcttcctcccggctctctgcgcccaggctcggcgggaccccggggatgcgcggctgtccgcccgccctgtcgccgggatcgggcgcggtctgcaggactgcgggagcccagccgccctggtgacagaggacaacaatctcagcccgctgcggccggcggccgcggcccggcgcccgcgctcaccctggctggctcgcccacactcactcccgcgccgggctgctcagccgcgctccccgccctccgcgaccggttcctcctcccggctgctcgctggggggtgaggcctcccccttcgccctcccccacgcatctactgctcctgtcgggaaggaaggtcgcccaggccggttcagcctctgggcagggtccctgcaccgccctggcccgccacaccccctccccggctccgtgccccgcgccccgcgcccggctccgggatgcgccggtgcctggaagagctgggggcggggacccggaggctcgcaggcttccctacctcctggagatgcacggccttgggcgtttctccgcagctgcaaagctgtgctgtgacccacccgctcagcgagcctttataccgggaccacctcccgggggtcgaggtgggaaggaaatgtccctgagagccgggacgcgctgcctccgctgcctggaggagctgcgctgtcctgccagctaacttttgcccacggtttccactgcccggg

SEQ ID NO: 1383 - DNA, 152655 bp, Homo sapiens
tggaaaaaaaaaaaccaaaacactttaatttttaagacaactgcaagcacctcaaacaatggattattgttacaacacttgttagcttttcacaatctagttattgcaaaggcatatggataaatgttaatggacaaagtcaaaaacgaggcaccttaatgaatgtaaaatttaaaataaaaagacattcaatccactgacttctaaaagaggctaaatatacctctatatattacattctaaaattgtattgcctactatggtttgtatcctggagtctacaattaattttaaggaaatgcataaacaaaactgtgtgcaacctgcaaagggaaaatcattttctcaacttcgtttcatggaaagacaatgaaaaagctagtaaaatttgttgtagccacacgtaaagctacctatggaatgaatgtgatcactgttatctttgagctgtgagaagtattctgcccactgcactgcaaattgtatataccataccttgtgttctagacaagcatgatcatgcttttccaaaaatatatgtattttttcattccacacaattaacacgtttctccaatttaatctatgtagagcttaacttacagcgcccagaggaggcaacatgacatggtactgagccatcacatttttaaagggaaattgctcttctttaaaagtacttttaaaaatatgcaaaatcacaaatgggactgctaaattataatgcatattttagaatgagaaacatatcttttcttcctttaaagtgccatatagagaatgacatcttataacccagagccactttgtttaaaatccaatgtgaaaagactgttatggaatgaaaagtttgcacaactccttggagcagttaaagtccgctacatgcaacataggctacaaagcactcaagacttggtagcttttctgaaatttgagtccccctcccatatttaatggaaagtaacatttacagggtgcatttacatacactataatacaggaatgatgtccctttgccagaagataaaattgtacatttccttgctatttcttggttccaacttgataatttcttaagattgtaaattatatagtactcagctaaaatatttcttcataaatagttacaaaacctgccaaaacacaaaggggaaagtatttttcattcaaaaaaatgacatttgaatgtcacacaacacaagaaacaatgcttagagacatgttattgtttccagaagaaaatggtcagtaaactacttagctgaagacaaaagactacccttccccaggatcacagtgcacaaaaagcaaaatgtcaaacaacagtacctcaaagcaaaataaaggtctgaggatgaagccagctcacttgtaatcctgttaaagaatgagagtcaccgtttaggtccaatgtactgggaacatttgctagctcagaatgcaatattggtagaatttgctaagaattcaaccaaggatgccgaaggcattcgccagctgaggctcgtttttctggaaccatttctaacatcgggatcaggaaatctgtaaactgtgcagcatcttcatggggccagccatacttttccacaagtacatcaaagaggctccagggcttcagcttggtgatgtgtcgcagttctcctacaggggaaaaaacaggccaatgtcaagaaagctccaaatctgcattccccattgttggtccagtcaggttcttttcagtgaagcggacaaccacctgctcaacacttgtacagcaacaacaaagaacaccagcttttccccactaagcaataatcattacatgtacatatgaccaaggcatatttcaagtaagcctggtggatctaaatagaggttaattaatagttcattcacattagttctaagcttctttaagtaagtggagtgggctcagtttgcccagagtgttttcttttccaaaggttgaagcaagccactctcatttcaacctgggatcttccgtaaaatttgcaaacttgaggccaacccaaatcaaacaccattcatgtctacgcatttgttgtaagatctaagatcctaggacattaatttgtaaaccttgaagttatacttcacaaactgtgctagctgcagtatgaaaagtgtcggttacaggcagctttggttgacataacagaatgactaacaagctagtaaatggcctacgagctgtaatggtcatttcataagagaaaaaaaaggttatttttaagtcaaaactgcaataaagggctgagggcagtggctcactcctgcaatcctagccgtttgggaggctgaggcaggaggatcccttgagcccatgagtttcagaccagcctgggtaacatagaccagaccctgtctctacttaaaaagaaaaaaagtagctgggcacggtggtacatcccagctactcaggaggctgaggcaggagcattgcttgagtccaggaggtcaaggctgcagtgagtcaaggtcatgccactgcactccatcctgggacagagcaagcgaaaccctgtctccccataaccttttcaaaaaggcaataaactgtcaaaagctccagataatttcactgtgaataactcgttttctctgcctgtttgaagttttcataggacatcccacccctgcccacagacctccttaggtgcccctcagtgcatcctgagcagcttctgcagaggaaacacccccctgtgcccacacctcagagcagccaggtctcggtggggggagagaggcattcaagcacctgcagggcacacttcatgcaaggactgacttctctcccctttcaactgctttaatttaaacaaggtacatttttttcatgagatgcatcaatagataatcagtgctctgctcacaaaggtgttctcaggaggcttgttctgtttcacccatttattcgagtcaacttggaaaagccctcccgtttaaaaacacaatgaaaaggaaagagcattacagaaaagtataagaacaaaaggggaagtagcctacaatcctacccacaactgctcttcttttgtgtctattgtgaagagtgttcttacacactagtatgtctacaaagttgcaatcatgctgtgcacagggttccgtataaagaatcttttaagagggctgcttgctaaaggggctgagatgtaaaataagcttctgtttccaatatgaggactggagctagagtaaagcatcgcatccagactagacatcaggtctgtgttgatgaagaaatgaacctgtaatattagaggcgggaaaggatctcctgttgaaggaaacacagtctccataaaaacaaagtctgaacagagactgcaggtttatccctctaagcctgaaattccggctctaggaatccagcccaaggagataaaccctggttgcaccaccccaaattcatgcctaatatatgctggcacaaaattatatgtactcgcaaaattacgaagagccagtaatagtaaaatggtggttaaaagaaaaccaaggtagattcacttaatagtatttaatattacttaacaacatgggagaagatcatggtacaacattaggcagtaaaagaacagtcaaactatgtcctacagataatcacaagattattaaaatgctcattaagatggaaatcaactgaatcaaaacatcagcttttgttagtaggttatttcaatttccacattttctgtaatatgactatattgatttagactgttgatctcaccacagcaacagttaaagcaaactaagaaagctcacatgtgactaaaccaagttctctgggaaagggagcgaacttttatgacatgaatctattctatctcagaaaaaatactctccaggtttgcaaatataggtaactacagagaagcactgtgtgctgagaatagtaaaggaacctatttctgaggcgccaggtgttaaactaagatccatcaacaaggcatcttttaagtacaatcttccatgaaaagagaagttttaccactataaatgcttaacagctgcatagtaacagtgagcaaaacaatataatagtgaaaggccatgagaaactattcatccataactaggcatactataaactggtaaaaatattcgcaaggagcagtaaaatatctaactacttttaacaaggtaaagactgtgcaaagaagcagtctataaacaacagtatatgcaggagagtcctaaacacctatggtcctgagcacagagcagcactgcaatataacaaaacactgaaccgcctctaaaaaaaaaaaaaatgtgtggactttttttgtggaaaaagtttataatataatgcaaaggaaaatcaactcacccagatgctataatgattatgtgtgcaaacccttaagctcagtataagaagtaaccttgccctggaaatagttgataaggttacttaaacacaaagcccaagcccccaactctgtatctattgctaggagacacaacaagagtgggctcactgaatgagtgagggtctcgagtccatgagccagctccagccctgcagatgatgcccaagaaatgtagccacctccatcacttagaatgataattaagaataagaggggaaagcatattttaaaaacacattttcaccatttgctcttactataaaagtagcaccctaacaagttaaagaaatgtcatcggccgggcacggtggctcatgactgtaattccagcactctgggaggccaaggcaggaagatcacctgaggtcaggagttcgagaccaacctggccaacatggtgaaacccgatctctaataaatacaaaattggccaggcgtggtggtgcacacctgtaatcccagctacttgggaggctgaggcacaaaaatcgtttgaacccaggaggcagaggttgcaatgagccaagatagcatcactacactccagcctaggcaacagagtgagactctgtctcaaaaaaaggaaaaaagaaaatatatgaagacgtaaaaaaaaaaagagagaaaagaaaatatatgaagatgtgtttcactgaaacaagttttgcaaataactagacaactgtgacaattttagtttcttaaagttccatttctagcctgtcctccttaaagaatgtggaatatcacttcacccttcctgtgactatcagctgtcaatctcagtatcaactcacacacacacaagcaaacatgagcctggcagccaattgtgtggtccccaagagccccttaggcttctgaatttgctctgagaaacagcttgaaagagccaaggaaaaccaacaggaagcaggctctgaggaagggttcctcctgcagagtaaaggctttgtgacagcaactgtactggccagtcctggacttgcagagtccttctaaggaaacagggaagttctattatacttctcttgaatcttaaagtggtttgtgaaggaaaatacattattttatccatgaaattgtcatattccagaattaaataaagaagcccatgaggttccacactacatgtgggaggactctaaaggcaaatcctggactatatttacatgaacactggtaattacaaagcaaaccatgatataaaactgatgagcatcaattgtgtacacgtagaaagtaaacctaccaagaaataccaatacaaagcaagagacaatgaagagatctgaatgaattcttacacaagtagacaaccaaatgtaggtaaatattggagtttaaaatgtgtataaaccctacctcacatcccatacaaaaatcaactcaaaataggtcatatgcctcagagctaaaactaaacaattcctagaaaagtaaatcttcatgaccttgaagtaggcaatgatttattagatgtgacatcaaaagcacaaattgtaaaatgtatataaattggacttcatcaaaatttaaaaatttatacttaaactttcacatgtgtattcaagagaaacggaaacatctgcccacacaaacttgtacattaatgatcatagtagcatcattcataatagccaaaaagtgggggaaaaccaaacgcccatcatctgatggagggataaacaagaggagtggcagtgacaacgcccagcctgtgtagctgtcaaatgcccacgaaagagctttctttgctctttacagcatcaaaagaatctgttgctttttaggtattcaggagataattttaaaacactgtgacaagttcagctcagacactaaatattaaaaatacagaatacagtatctctttttaaaactcagctcctgggttttagccctcagttctcacatttctcttgatgttgtccctgactcagggaaacgtggattttatgctgctgcacagaagcttcttgcttttgaaattttcaattgtatttaaggtctgtagtctgacacacacacatacacacacgcgcgcgcacacatgcacacaatcactctcttttatcccaacacactcgatgctgtcatctagagaccagttttttttttttaagtaaactgtctcatttgataatcccattatccacgcagcaatttttactaaaatatgcctgctgaatggtcagaaaaattcctggtgaccagcccagtgaggtctgctcctggctgcaccgtttttcctaccatgatctgagggctggaaagcttctggggaccacccacttcttgaagacaggacagggaaaaaattcatggacgtgctgatttctattggaccacctatcaacacagtagtttcttaatgctttttggtggctcatgtccagcaaattaaccttaagagggtgagagctgtaattacattccctgaccaaaaatacagctcaatttttaactttctggccaaggaatgattcaaactagtaatgatcatgacttcttaaattatacgcaaggagaggagacaaatgagctgcatttgatgttcaaccttaacacacagaccccactcttctctggctgcgtggcaaggatgaaaatctgcctctgacccagaggagaaagagcgggaaaacctcctgggaaggcactctccatcagtaactgctttcaaaagtgatacggcatatcaacagctgttttaaattttgttatcagttctagcacaaagtattttagctattttaggaaaaaaaatttaaatggatatttttaagattccattatttccaaaattatggaaattatggaatttcccctatattacttatgggaacatgccaaaacacatgtttcacgcagcaagccattcccctcatcctaagagacaacggtgaaatctatttccatgaccggccctcattcctcataatgttatcctgtgacttctgtaaaaaccctaaatcccttctgatctctactgccattagaaataataatcaggaaagaactgaagtcccaattcccagtcatttcaggggatttctcacctagtcacaaacggtctcttatatccaaaaacaggaaaaaagaactcgaggtaccacaggaacaccaagtgaaaatatttttggtctctcattaggaaggatgccaaatgcattttaactctgcaggttaccttcaaataagctgctcaaaaagaactcgatcacgtaagtcctaagtatacgtggtgatgatggcagtaacctggagatacacatccacaagctgtctcagggagcaaggttgctgacaggcccacgtggaagctgccttccagccatttatggccacacgcaggccgctctcactgaaaggaaccatcacaggagtgacagcccaagagcagatgcctgcaaccagctccatgcctgcaggccgctgacaggccctgccttccaacaactcagtgacttcacttgatcattcaaggcctctctttctgtccctctttccttccttcccgctgtgcacagtatggagtcctcgatcccctcaacagacagacgattaacaaagacaaataaatgcacagccaggcgcagtggctcacacctgtaatcccagcaattgggaggccgaggtgggtggatcaccttaggtcaggagttcgagaccagcctggccaacatggtgaaaacctctctctactaaaaatacaaaaattagccgggcgtggtggcaggtgcctgtaatcccggcttcttgtgaagttgaggcaggagaatcacttgaagcctggaggcggaagttgcagtgagccaagattgcgccactgcactccagcctggacaacaagagcaaaactccatctaaaaaaaaaaaaaaaaaaatcaatgtggttctccaaatttagctaagtaaggtagacagagcatctgggactttcagaaatttctaaaagtccatgtcctactcacatcaactttaaaagttctttattaagggctgtcacatccaaaaaaaaaatctaacctgaaaaatatgaaggaccaactacactcatcacaaaaaagtacagcaggctgggcgcagtggctcatgcctgtaatcccagcactttggaaggctaaggcgggtggatcacttgaggtcaggagtttgagaccagcctggccaacacagtgaaaccctgtctctactaaaaatacaaaaattagctgggcgtggtggtgtgcctgtaatcccagctacatgggaggctgcggcaggagaattgcttgaacctgggaggcacaggttgcagtgagctaagattgcgccactccactccagcctgggcaacagagcaagactccatctcaaaaaaaaaaaaaaaaaaaagaatatagcacttagaaggagttcttttaaaaatactcctagggctcttgggtgtttttataaattactaactggggactatactgggcaaataaacagttggaagatcagtaagaactacaacatgaaaataatcaccttaatacagtgtggcataacacaatgggaatgtaggatgtcatttttaagaatgtgaggtacgcagcatttcacaggcctacacccactacagaaataacccaggcagaccaaaagcaatgtccctggacgttccctaagtccagtctctaggccacctctgttctactacagagagtccatgaaatggaaagataagtctagctggcttttaacaatcacctaaactcctttttataaataatatacagattggtaacttggagtaaaagagagaagcggaggaggaaaaaatgctgttaggaaggctgttctcttacaaaattcttactccaggtatcagatgggtcaggtttatttcttgagagctttcttcggaagaattccccagttgtgaaactccagatctttctccactgcccaatcacgaatgcacaatttctccttttgggagaagactatgctgaaaattagtgttgcataaataccgttaccttttctggtgaaaaactccttggagtatttccccaacatagcgtattttcgagggactttccccagcagttcaatgatcaatgctatgtgatctgcattgggaaacattgccagcaaaacagaaacacacgacagtttaatcagtacactgcatgcagacactaccaccgcccgcgcagacagaaacagagcgcaacttgaatgaccaaaagtacaggccttcctcgcgttgctggattcaggatccagagctggagggcacaggagaggggctggtgaacagggtgaccgcagcacagggctaaatgtggtcttccctgacaatttttctatcagcataggaattctgctgggttgcgtttcgaatttaggagaaatgcctttgtcaccattaatgctaaaatcagcagctgctcttcagtttctgtctgcatcgtggcgcttttcaaaaagaagaggtactacctctgcgattgaagaattcccgagaatattttccagatagagcaaagtgccttggaatactgcctagcagctctatgatgtgggctatgtggtctatggaggagagaaaaaaaggatatgggaatgggaggggcaaagggaaggatgggataaaagaagagggaaaaattgaaattagtaaaaaatcagaaatagattcaaatcaacagtgtctgcagcacatccatgcagaggcttgtgggaatggcaggcctcaggcaccacctggagcagtaacagtgactgaggccagctcaccccaggccaccccagcatcgcaagcaaataagcatggagatggtcaggtttacagatggcattcaagccagaattcctgggttttcaactcagctcccaaacaggacagagaaatgggcagcacatcaatggtcaaaaggaccacatagaggcttcaggtctgtatcatctgtcttctctcagccagctgggttcctgccctgtgcaaggccaggaagagccgctggtgtagggcccctgagggctcgctggagtgctgcctgtgctaggcaggctctgcccattcactgagactgagggggcatcaaactcaaaggaaaagcatctgaatttggtgtttgaaaaccaaacacatggctctatttcagtacaaaaatacagtactctacagaagttcagggctggcagaagacctagaccgaggtattcagcaggcaccaatactcaccttcgtctctggaatagtcttccccagaatgtggttcaaacaaataatctcccgttgccagctcaaatgcctaggatacaacagacgacatgctaagcacttcagagactggcccccaagtcaacagctttttctccttatagaagagaccgccactttatgaagatctgaatcaaacaaaatagcctcctgaaagtgctcaatactaatttttttctttcttccacattcaaagaagtttcagaagtatttttacatttctaaggaaagatataagagctatgtattctcttcattttgcaggaagcaaaaccaaaacgtcagtgagtcagccgcacctgcatgcaggcctggccagagcgcggtatgcactctataaatggtagaacgagagttcaacccaggactcaacaaggcccgtctgactccagcacctgcctcaaccactataatagccttggcctctgtatagcagacactgctgcgtcttttaggcgaagaccttcatgttttagtaaccaaggactattttcagtatctcatcaaccattttcatcatcatttcattcatttctgattcaaccaaaggaaaacctggaaacaaaaaagaccctctttgtccccagggccagaggaagcagatggtcttgcagacccttttgtggatgtcacggagcactggcttcctgggtggccactggctgtccctcagcatgccagcatgtagggaacacatttcccttgctcacaaaaaaaccctcaaaaacatgagtttaagctagtaacaatatacaaaaatggcaactgctactgctctgctgatcaaagagaatgttttaaaagagaaaaaaagaataagctaaatcccatttctggtttttctcatagctgcttctattctgaacggatcttgctgtcccaaaaggtgctcagaggcccaatcactgatgcctgtggatctgtgactgccctccccattcccgccccaaggagccaatactggggaaacttcactgcatcaacctaccttctttttctttcaatgaccacacagtgctggaaaggcacctttaagggaaggctcacctgcctgggtgaggggccacctctcctggcactgtctttaacaaaccaagagtgagtgcagtcagcccaggaccacatcttttcaccttttttaaaaaaaaagactgcctgtcaatcacttgaaggaaggaaggatggtgacaagatggcttccagctgaccgagcgataagcattaatttatgaactcaggatccctgccctgaacctggcataggtctgagcaagacacggacatgtcacatctcagcatggtgagctggtggtcccagcactgtggatgcacgaaggcaccagcagaaaacccaggaaagcccttatgtagggcctctcctttccacccaataaacaaagaagacagttgggccaatcccagatgagggcaggaaaacctcataactggccccaaatccaagtggaacaactagattacacactcaatggccaggagagtccttctagcctgggaaacaatcaattcagtatcttacaagctaagagaaaaatctgaaaactctaatgggacaacgaggacttgaaaagcctggatcaagttccaagctgcttttcaacccctgccttgagccctatgctaactaactcttttaattaattttcaaaatgacttcaatctggttgcatatatttctttttctttcatattttttagagaagggacctcgctatgttgtccaggctggactcaacctcttgggctccagtgatcctctctcagcctccagagaagctgggactacaggcgcactacactgcacccagctttgtacatatttcttactgccaaaatatgtcaggtatgtattctttgaaaaaaatcatcattttgattagcacccacatattcccaagaaaacatgtatagaagccaatcaatgaaataatttttttttgagacggagtctcgctctgtcacccaggctggagtgcagtggcacaatcaatctcagctcactgcaagctcacaccattctccttgcctcagcctcctgagtagctgggactacaggcgcccgccaccacgcccggctaattttttgtagagacgggatttcaccatgttagcctgacctcgtgacccgcctgcctcggcctcccaaagtgctgggattacaggcgtgagccaccaagcccggccaaataattttctttttttttaaaggaacaaggaagatgaaggctgtaatgctacccatttttgattctttggagagtggcaagattctcttaacaatacaacatgtacaacagggcaaatgcacattacaatgaaaaaaactctgccttcaactcagttactcccagtataaccttctattgcccaggctgagtgcagcggcacaattttggctcactacaacctctgcctcctgggttcaagcgattctcctgcctcagccacctgagtagctaggactataggcacgtgccaccatgcccagctaatttttgtattttcagtagagatggggttttgccatgttggccaggctggtctcaaactcctggcctcaagtgatctgcctgccttggcctcccaaagtgctgggattacaggtgtgcatcacctcgctgggcctaagtataatctttattattatttttaatacctgggaactccggattcttctctacttggctcaatcccctcaaagggctcttccctggacctacttgtttccagattcttgggagaccaactacctctctcctaaaacattctcctatgctgaagtatcccgattctgaacaaataagatcacgtatttgttctgtaatgtgaccagtgccgaagaagtctggtgaagtttgttggaatggcttttcttgtttctatggcactgaccaggactcaccatggagttcataaaaagtcctatcagagactctaatacataaatgcagagaaaccaatgcttcagccacaaagaagtttcagattatatgtacttacactggaaggtgtaaagctcaaaaaaaaagtaaaactcaagaaaagtaaaacagatccaaacccaacatacccttgctgtggtccctcattctgttgtgcttctccagctgcagagcctaaagctgtcctccctgacaatagccaatggctaccacccgtcagctctcattcccaacagagtctctgtgagatttgatgctatttataaatctcaaagacagccgggcacagtgtcacatccctgtaatcccagcactatgggagaccagggcgggtggatcacttgagctcaggagatcaagaccagcctagacaacgtgacaaactccatctctacaaaaaatacaaaaattagccaggcgtggtggcatgtgcctgtagtcccagctacaccagaggctgaggtgggaggatcacttgagcttgggaagtggagtctgcagtgaactatagtcctgccactgcacttcagcttggggaacagagcaagaccttgtctccaaacaaacaaacaaaaccctcaaagactatatataggctttaccaccaagaaccatctgtggccttatgacagcttggtattatgaggtcaaatttaatatattaaatgtcctatttttacactacaacagaacgatgaggtaagaaaaactgcctcattgctcctaggttctctaggaggaacaaaagaaacctctaaagccatgacttttggggggtggggcaagcagtgaatgagggcctgcccctttccaaaaaaaaaaaaacctcccttatgacaaccaactgaaaaagcaaacctcataagccgtcctgacagcactgagggagcttatgcttaattcttgggaagggggcaggtgagaagacagaaaggcttttccttgggaatctgttattgatatttatgccactgttcacagcaatagcatttcaagaagtaagcaggacagggaaattgtatggagggacaaacgttcatctaatggaaggcaggtcagataacctggtataaaattgtgctgaaagctccattaacccactacatccgtgactgcgtcctatttttctggttatatcaccaaacttaataccccaaattagaagcacagcatttcagagttcaaagagtacttagcgcctaattcggggcagccctgctgctagtggccattgtggtctaacctccccacatcctgaaatggcccctgctccccgactcccactcagtgtctccgcagctcccgttacactaactcccacgtctcagtctgcctgctggggtcacacagagagggtcaaatgcctctccacacagcactctctaaattcaaagtgaccatcattggccaccggttcttttaaccgttcttttctatacctagctaaggcagggacttggtttttgatatggaagaactttaatacctttaataatttaaacgttattgtctggtattatccttaagagcaacgagggaatagaaaggcctggtgtttcaggacctatctggccatgtgctgactcagatcatgctgagtcaaagctgaaagacagaaagcaccctctttttctcctatcagctggcactatctgctcaacaatgcttttacttgagcattagaggaggtaaaacacagtaaattcaagaaaattgttaaattaacctctgaataacagaaaattaatatatttattctgcattccttttttcagtgagaagaaaaatgctaagccttgcacacaatcttttcttttaaatattggaagaatatggataaaaagcagtatggaataggaaaagcatgaaacccaacagcaagcaacccacctttcccaacacggaacgcctaagtaaataccactgagaaaaagctgctgaatgggccaggaaacagggcagaggaagagaaccaggaactggctcgcaaatgcagggccctttgtgttcaccaactcacaggttcagggtcaatgaccaaacgatgccaggcagggccaggggagtttacagacaatgcaactgtgcagcacaaaaccagcagcaaaacaggcctgacagatagaagaagaggcttctgccgccctgtggaagccgtcatctcaaccactctgggaacagactctgtcagagggagtgggcgttgctgccactgtttcagaagaggctagacatcctagaataagccagaatatctgctagctcttgctttataagggaagagagattatgcattggcatctggggaaatcccttccagtctggaaaggtgaggaaccctgcatgtctggttgaccaggcagaggcttacctggaggggctcccacctgcccgccttaggcagtcttcccctggagatgctacctcatcttcctccacagtgtgagtgaagggaaaagctccctataccctgcacattttcagggaccacaagtgaagtcactgtgtcacaacaactgagtctgattcatggggctgtgggctgtgcagggccttaagaagagaccatgtctctctcacaagcccacaaccacaccaaacacccagggcccgcctgaggaggatccttccacttcttaagatgcctgcggcagcaaccttcccctcacccagcccacggtggatgacccttacagtcagaaaaactgaggtcgcatgcctcagagagactcagccccatccagagtgtgaaaggaacgagccaattcccatggcagcaaagggcacagccgtccttaccatacacgccgtgctccagatgtccgcaggggtgctgtaccccgctcctattaaaacctctatggagcggtactgacgcgtctggatgtcttccgtgaagtgtttatgctggaagggaacaggctgcattaccacggagcaacacagacattcaaaaagtgtcttcgcacacagaatcaagaccaaaggttttagaaagaaaactctacttaccacccaacaagcatttcccaggtcagcaatttttactctaattttatctgcattccgcggatccaggggattcaccaacaagtcagctgcccgggtttttgctggcatgagcaaacagcaggacagttagtgatcgggataggtggtttgcatgtgtgagcacagtgtttgccagggtcagtctcctttcctcaagagtagtggaatgatcacttaggcctggaatactgtaaattaaacttgacagaactaaaattgcttgttctccacctctggaaaatactccagaaaagagcaaactgggctgcccacaggacgccaagggcactgccttgacctttctctttttatccccagtttcttcgggtccaggtcagccctagaacaagccagccttgctgtccccctgtctgcagctttgtggcggctcttcatggtgtcaatccatcccttcacggcccagatcgagcttgctgatgcattattacaaggaacatgaaggtagaaagaacactgctgtgggggccgatcactctcagtgacacacagttccttggacgccacaagacatcagggtccctggcaccgacacctcacacccacatcatcccctacagttcccactgcttgggctgagcacacacagatctcaaggggtagatgactgttgattaacaaacacagattaaaggcagggactaaactattctggttttgttttagacaaggaaggtcccagacagaggtctcctgagatggcctgggccataaaggcaacctctgaggtcagtcatgaacttgtcatgtacatgagcagtcattctaaattccaggatgactccagggaatctcaaaggcaggtatagggccagcttcccagagattctggggccagatcttctcaaacaagttcagatcatgcctgtatcaagcagagttaaccaaggggcaagtgacaaacaaaaataatctggtgaggcccagaaaaatagtccttaaagtcagcatcttcatcaccaaacctcagactgacctacaagatcagatttctggtaaagatgaaataaaaccaggacttttatttactgtataagtaattttgaaatggtatttaaaaaccaagcagaaaagcctgttcaatgtagaacattaaacactgatatgattcgggtttgtgtccctgcccataactcatgtcgaattgtaatccctagtgttagaagaggggcctggtgagaggtgactggatcatgggggcagatttccacgttgctgttctcgtgatactgagtgagttctcacgagatctggttgtttaaaagtgtgtagcacgtcccccttctctcctcctcctgctccagccatgtaagatgcctgcttccccttctaccatatttgaaagtttcctaaggcctccccagccatgcttcctgtacagcctgtggaactgtgagccaattaaacctgttttctttataaactaccgggtttccggtattttttacagcaatgtgagaacagactaatataaacacctacctaggagagcccctttgtttccttgaagctgggcactgctgaaatgaactaaacctctgttggggtacatacgagctgtgaaaccagggtgcttggggaggctctgattcttcagcaagccccataagaggaaggagggccagccttgcaacttgccgtaaggcagtgaacaggcaagggcctcaggacctagggtgcccacacagctccctaggggggctccagaggacgccaagagaattctgaccagtatcttaaccctcaagacctgttcctctagcatgttaatcaaatgagccagccaggtacagatattccctgcttgctaccttccatatgcctgtttccttctttataaggattctgcacagcctcaccaaaggccaggtatgagctcaggaaaagaaacaccagaactcagcaaaaattcagaaagaaagcagcacaaagaccaaaaaagaaggcaaaatgaatatacactgattcacctggggctgagaacagaggtccaggataaatataaaaatgctgacccaatgggtagatgaacaacactagacatgactagatgaatgccccgtatgtcatttaatcaagaagaatcagcaagaaggaaaatggaatttgaggtttgaaaaattggattcaaatctaagtttcaatatctacaagttgtaagactggcaaatgacttaaactctatgaggcttggtgttcaggaaaagaagaatcggaagggaccaccccttccccaccgaagacactaaaaacccaaacacaggagagtcaggacagcatctgggcgcctggccagacgcaggggcttccctctgctgtgaccagctgaaccatcgtctggggcagaggctcccaactggtcagtgagggaccagagagcagcagcagagggaaggggaggcccaagagcaagttccgcccccacaaacaactcaaatcataggtctaatgagaagagggcgaagcccggttagacatattgtggtcctcctgagccacagaacgatgtgatttctttttctccatgagaacagtagccgagttggctgttatctgagggcactcaagtggaaggagatgatctgtaatctgccaccactctgagatgttgtttttaaaaacatttctcaggagctgcttaattcaatcacgctagaagaaatatactttcaaagacccatcacctcacatttaaatgcagggaatttttttttttttttttgagacagagtctcactctgtcgcctaggctggagtgcagtggcgcgatctcggctcactgcagcctccacctcctagattcaagcaattctcctgcctcagcctcccgagtagctgggattacaggcgcctgaaaccatgcccgattaatttttgtatttttagtagagacggggtttcaccatgttggccaggctggtctcgaactcctgacatcaagtgatctgcccaccttggcctcccaaagtgccgggattacaggcataagccaccgcacctggcctaaattcaggggtgtttcttgtacttaatatccctcattaaggttcactgaacagaatctctttggtgacatgctgttatcctcctggttcgggtttgtaaacagttacttagcttctgatgcgttccaaatgatgctaggtaatgtatctcaataacttaattgtataaaaacacaacaggaggtaaaagagattttgcttttctttcttttctcagtatgatagttcctgaactaaggtaccagactgctacattcccaagaagtccactgaaacccaactggaatgcttttgtcacacctcctctgactgagtcaccacagtagtgacctgtcacacggtttccttcttacagataatggtgacacaaaggacaaactggagctgtcttccttccaaaatgaaaagcttgcaattgcactctgcttccactaagaggggaatgagtggaaagctttcacttcgggaagaactgggccccttaagtcaccttctgatacgctagtctttgggtgacactgtggtcactcattccacaagaagctatcctaggaactattagatggtagccaacagtgcctcagcataatgagacagctgctgtcacacgcacataacacatggagctaggcacacactgactctttacatcataaggggtccttacaaggacgacaagaatatcccctctatatggaggaggttcactatgaggcccaaggaagtagtggaactaagagatttaatgttgccacctcaaccattcgtgcaacaaatatttactgagtaccttctgtgtgctaagcatggtcttggtactgggaacactgtaagaaaaaaacacaagctaaattaggaaactcgtgtactggttgaaaatatgggcaataaggcaaataaacgaggaatccacacatcctgtcaggtagctaaacaggctatgaagaaaaacaaagcagagaaaggagatggataatgccaaggctgttcaggggagatcttttctgagaaggtgacattcaggagaggtctgaacaaaggcaggcatgaaagtaagagaagtttgaggcaaaggacacgggaagtacaaaaatcctaaggcagaaacaggcttgcaactttgagaaactttagaaagaagccagtgtgaacggtgtagaatgaattagggaaacagagaatgggtctggagcaggcaccaacagagacctgccagggaacacactggagagtttgtcagcttcagtgaaggacaactcagggcatcactactctacatgggaaacacaatggagatcatgttggtgaggcgagggtgggtaagggggaagaagttaagccttaaacagttctctctggactgccagacagagacagactggggagcaaaagctcaagtgataggagcacggaggctgtgttaacagtagcctagcaaggactgacagtggtgtgggtccccatcgagtgacacagaaaggattccagaaatagcccacaggtaagaccaacaaaaccaccctgttccagggcctttgtccttcagatgtgttgagccaagatacacactaaggctctggcagctgatcatctaagagggaccatcctcttctcaaccttcaatggctgccaaattactctaggaaaaaagtgtaccttctttagcctggcatttaggtttcttcaagttcctcaaactggccccagtctttcttctactatgccctaacatgtacattctgccctaaagtcaggatctacacaaactcttcattgtttctcttgcctcaaattcacgaagtaccgtgtggtcaagtgcaagactctaggcttataccccttcccatgcagaaaacaaaacacacctcccatgggggaggctgctcttgcttatcaaatggccaagctgcgggcgaaaactgagtgcttccaaacaaaggagatcctgtccctggtacatccctagaatttgccaatattaaaatgctcttcaagacctccagtttctacctgatgcaacaggtattggggatggtatgtgtgttggacacagtaaaattgtgactataaatggaaaaaagcgggagaaaggaaagagaagaagaatgtaaaaaggtatcactcatttgtttgttcgttattcaataaatatttatcttagcactgaatcagatgctgaggatgcaaagataaaaacacactgcactctccaagagttcacattctaatgagaagacagacagtgacaatgagcactgcccatacaactaagacaagcatggccagcaggagcagaggggaaagagaagtaagcctgctggggatacaggaagccctcacccaggaggcaggctactgtgttggatcatatcctagatcaggaaaatttaaaaagaaaattttagaattattgaggaaatttgaatatggaataaataatagatgatattaggccaggtgtgatggctcacgcctttaatcccagcattttgggaagccaaggtaggcagatcactcgagcccatgagttcaggactggcatgggcaacatggtaaaaccctactttctctaccaaaaatataaaagttgaccagacatggtagtgccaactgtagtcccagctacttgggggctgaggtgggaggatcacttgagccagaaagcagaggttgcagtgaaccgagatcacgccactgcactccagcctgggcgatagagcaagatcctgtctcaaaataataataatataaaattagtgctattcttacacgttgtaatagtattattgttacaatggaggacgttctaattcatctctcagaagatgaatgcttaagtatttaggagtgaagtatcctaatatgtgtagcatgcagtgtctgtgtacacaaagtatatgcaatgcggcaaaatgtgaattgctcaatctatgtggaggatatacagttgtttattgtactattctttcaaaataaaaaaatacacagatgctctaataattccttcctgcaccttcctggatggtgctggttatgcagggatgtacactctccactgtggagaccactgctgtagatgatggggagctgtggaaactgtgagcaggggaatacactgatcgggtgagcatactgcaaagacactctagcagcaccatggaagggcatgctgaaaggcaggtggggagaaaagctggagagaacacaaagccaagacaccagtaaggaacctccataataggagaggcaagcaatgacactgcccactttagggacaaggcaagggggacccctacttaggaggtatgactggcaaaatgagatgatttactggacatgagagaaaaaaagaagacatcctgatgatcaagtttctcactggagcaacaagaaatggtggcaacaagtgtaggaaatacagtatgtgtagcaggttggcagggaaagttgtattctggttttggacatgtaaggtttgaagtttcctgtgacacagagatggagctgtcatgtaaacaataggataagtcttatgacttgcctgggcctccaatgatgaccatgtggtaacaagcagcaattctgctcctttacatggattgtgatgaccaaggcaacttacattcaatgggaaatttttcaatatattattattatatgttatttatgtacctttgccattgacctgttttatttaattcagtgctactaacaaccttagaggtagccatttctttcttttgatagaggaatgaaccaaggctcagacagggtaagaaaccaaagttccacagttattaagttttgagctggggtttaatctgatatgcaggtgcctctcggtgtctgcaggggaactggttccaggacatcctgaggataccaaaatccacagatgctcaagtctctgatataaaacggtgtagtgtttgcatataacctacatatatcttcctatacactttagttgatctctagttatttataatacctgctacaatgtaaatggtatgtaaatagttgttatactgtattgtttagggagtaatgacaaggggggaaaaatctgtacatgttcaataaagacacagttttttttcccctccaactatttcccacctgaagttagctgaacacatggatgggaaatccaaagatgtaaaacccatggatatggagggctgactgtacttgaagccactgcagcccaagctaatacttgcaaaataagtatgaataaaaaaggtactttgagctggtcatggtggctcaggctcgtaatcccagcactttgggaggctggggagggcagatcacctgaggtcaggcactggagaccagcctggccaacatggtgaagctctgtctatactaaaaatataaaaattagccgggcatggtgacgggcgcctgtaatcccagctgctcgggagactgaggcaggagaattgcttgagttcaggaggcggaggttgcagtgagctgagattgcaccactgcactccagcctgggcaactagagtgagactgtctcaaaaaataaataaataaatgaatgaataaaatagaaataattaaaaaggtactttgtaaattactttctatatgaaacttcagccgggcgcggtggctcacgcctgtaatcccagcactttgggaagctgaggcgggtggatcacgaggtcaggaatttgagaccagcctgaccaacatggtgaaaccctgtctctactaaaaatacaaaaattagccgggcatggtggcacgcgcctataatcccagctactcaggaggctggggcgggagaatcgcttgaacccgggaggcagaggttgcagtgagccgagatcgcgccactgcactacagcctgggtgacagagcaagactcaatctcataaaaaaaaaaagaaacttcaagtaagagaaaaattgaactgcaacagcaacaataagtctggataaggtacctctcactactgccctttcccagaaattaacctacattctatgtaagcaccttcaaacactccctggaaaggggaacaggagctgaccacgtccagccaagtaaagaaagcaaatccttaggaggattcatcatagccagtgcgtaacaaagccagcttactcggcgtgcaattccagactgctggaaccaaaggggctgcagaatgtcgggctgtttgcagggctggctcatcaattttactcgctgtgtgttaaacagtcttgtcagtagagggagcagagggaggtttcagagcttttcccccataagccagtatggaaaccagctgtgttacccagttttcacttactagagtcacttggcattcactcccaaaataaggctttgaataagtcaagccttcttaggtaggcaagaacacaagagccaatctataatctgtcatcacatttaaatccatgccaattccttgaaaattacaatcctgggccagttaccaatagtagggtcctataatcaggaacaactatcaaaagacaatatgacacttctttctcaatagagtcaaagaggaggcataattttcttgaatagaaacaaaacaaaactaaactaaactaaatataatgacattagatggaagaagatacgaattttaaactaaactacacattctagaaaggtgtaagttgctaaaactggaaggtttttgcaaatgatgctgctgactaaatatattaaaaatgaaaactggtcagaaataagatttggtatgcagagagcaagaaatagcctaatggcatagaaaatttatttaaatcacattacttcttcaggagtataaaagtaataaaactgatcagtacacacacacagggcttggccacttccagccaattccttcacagcatttgttaaaggcacgtccctggagtcagcgatggcagacagttgatgggaagaaacacttaccttttggcaaatccccagtactggaggctgaaaccgttctgcttctgtcatgggatggactgctctcctcttgctcagtaagtggtgatccctcagaaagcacagagccgcaggccacaggttctaaggatccagagaacaacgaggtggaaaactctgggaactgtgactcgggaattttatgtcgtccatttggcaattcaccattgaattgttcataggagctgctatatgtgtaatcactttctgcatttggctcatcaagattatattcctcaggatttgggcagtcttcttcatcatcatcttcatcgtccagttgctgctccagtgagaatgggccattctcaatatggccattggttttaggtgattctatccacgtagggtctatgttcgcaagttcctgatctacatcatcttcatctttttcaatgttttctttctcagcatcttctttctcttcctggtcctcagcttcaccttaagaatttgatgggtcaagaattagaacttgttactctccttaatacagcctcattaagtacttatctccatcaataaaatacattttgaatatgcttatgtaccacctggtaaacacctcttggcttttggggtaaaaccttcaggttttctaaatctcatttttcattcatttagtaattggcctgctcttataagaaaaagttagctttaagggaaaataactctttctaaataaagttgcacttccatttctaccctctataatcttcagaaacagacttgtggtgcattacagttaggtaaaaagttaatgacaaaataaagcaccatcattagcatgatagaaacatggaatttctcaattattttacatttttaaaaactattttgaaatgttaacatatttctggcatacagttcacaaatgaagtacgaggctatttcccatatttcccaatagggagttggagagaatcatccttgtcatctgcagcagcagcacaaatcagcccccatgttgacctggcagaaccctactaatggagctctgagaaccccatgcagcccaggttccaggccccactgaccattgtcctttgcagtctctgcctcagccgcctcctctaatcctgttgtttttagtttcacctctgggcagtattcgccatcctggtcattggaaggtgcagctgaggtgatgttttcttctattattttcctttcagcttctcgctccaattcttctatctcctgcaggcgcttctccaataactcagcctgcctcttctgtttctttttcagttttttctttttgtttttagatatttttcctatctatgttaaggaaagaccacaggtcagtattcttctttttaaagcaccacgatagtataacgactagcagcatggcaaatagcaataaactctgctttctcatgccatattctattaaaatcccaaacccagacagatccactttgtggtaaggcttacgataaaatcaaagggaaagcagtgctgactgatatcacgtactaggtctactaccaggtcctgccctcagagggatatagcttaaatccagtaagtcttcaccattcaaactctaagagaactgaagttcgaaattctcttggccttaaaggagaagctcctcttgcaagttttatttgctgctgtctatatacaaagtaacaacatcccagctcctcaatgccaaaaatgaaacaggtgcccgagcaggtgtatgtcactgtgtgtttgggtctcacatatgaagctcttagcagccaagacaacatgaactgtaagagataagcctatgctgcaaagggaaaaaagaaaaagctacagcttttgtctgcctcccgtcatggttacctgacttgcaaagcactggcaatgacagcctccaacctttcaatcaatcagtaaattcaagcagctcaagccagggaagaactatgggaaacaacttgagcttctcagcaggccaggaagcttaattattaaagctccctcttgttccagaacttacattccaaatcaagagctgtctcagtaaaaatagtgttttgttgttgttgttgttgttttctttgagacagagtctctgttgcccaggctggagtgcagtggcgtgatctcagctgactgcaacctccacttcttgagttcaagtgattctcatgcctcagcctcccatgtagctaggactacaggtgcacaccatcacacccggctaatttttttttttttttttgagatggagtctcactctgtcgcccaggctggagtgcagtggcgtgatctcagctcactgcaaccgttacctcctgggctcaagtgattctactgccttagcctcctgagtagccgggattacagacgtccaccagcacactcagctagtttttgcatttttggtagagacaggatttcaccatgttggccaggctggtcttgaattcctgacttcaagtgatctagtggcctcagcctcccaaagtgcagggattacaggcgtgagtcaccacacccagtatctaataaggacatagtgttttgacaggaccacaaaatagatcagtctctttcttatttaacatccgcatggaaaaaattagaacaacagcttcagaaaaacaggtaacttagcagccaatcagaaataatgtaaagtggttttgaaataaaaatacttcaactccatcacctcacatttcactaaacttggccaccatagtccagaaaatgcataaagaagacaatttttgaaaggctctaactatcccaactctgcacagatcattaaaacttaacaagacaggctgggcgtggtggttcaaacctgtaatcccagaaatttgggaggccgaggcaggcagataacttgaggttaagagttcgagaccagtctggccaacatggtgaaacccctctctactaaaaatacaaaaattagttgggtgcggtggcaggtgcctgtaatcccagctactcgggaggctgaggcacaagaatcgtttgaaccagggagggggaggttgcagtgagccgagatcgcaccacttgcactccagcctgagcaacagagtgaaactcagttttcaaaaaaaaaaaaaaaaaaaattaacaagacattaagtcttacctatttgaggatacacagcttttataaatgtgtctaccctttaaatacacaacttttttataatttgaacaactcaataataaacggtctcttttaacatggtgcatataaagtaatatgcgtaagtacttacaggtttctgctgtggagccgtactcactaaaataaaatcaaacaaaatctgtatttagcagaaaacagacacatgccttcatgtaggtcattcgaattgcaaagtgaaataattattgtcttttaatggctatccaacttcaaaaactattaatcagagcttcttaatcacaaggatctagagtaagtttatgccactgaaacaaatgagtgactcctgaagtcacagcagaagttactcatactgagccatttctcttatttatctaaaatgaaatactaatacatctcaaacacagtcaagctcaagcaccaacagatcacttaagaaaatggaaaagaatacatatcacagtcattaaaccaaatttgtttaaaatataatgaaatgaacaatgtagatgtacatcgatatttggaatctattttgcaagctttctataatttaaatcaaatactgcagttggtatgcagcaaatagtctaggaatcacatgattaaacccctacaccagggtcaaaagcttaacaggctgggtccatgatctaaacaacaccctgatggcagtaaaggagatgtgaagagagccccaggcagtcccaggagcctcagccctttagtatccatgcttgcctgacaacacacaaaggcacagatcatggtgtcgaagagtgagaagcacagtccacacttcactgcaccacctccccgaccccgccccagaaataaagatatcccaatactcaggtcacttgatcttcttcccccaccatcaggccttttctaactaactccaaatctgttgatacaactcaggttgacatagctatgctaaatggacaacaagaatttatgtacacaaaattgaagccagaaaaatattctgatgactaaaggtcagctacaggaaagctgttactatgttctcctctgcagagaagctggcaacagaaaaaactgttcaaatatagatgaagcagcaactacaaatttaaatggccttttaaagggggacaaaagtaaatacttccaatattaaaatataatgtagctggggcattttccatttcaagggtgcagttatttccagcaattaaacttttccaaaatcttccttatgtgtaacgtttgattcagataccttcaacaactgcaactttgcaagctcccaatgcccccacactgaaatgaagctggctcagctccctcacctgcagaccctgaaggaggaggagcacctgctttctgccactcagtggcctcagctgccattcttctcacatatgcatcatccacacacatcaagatattttccggctttatgtcagtatgaatgatcttgcacttactgtgtaagtaatctaacccttgaaggacctggatatagtaaaatcaagagagaagataagctattaatatctcattatataacttttatttatttgaaaaacatgtaatacaatgccagggtacaaagtttgataaacacaaaaggatatttagtaaaaatctccctcccatgcctacccacattggaatccagctctcctttccataagcaaccagtgtgtataatttcagagattatttatgctcgtggaagcaaatgcatctacatacagttgaaccttgaacaacacaggtttgaactgcatgggttcccttatacacagattgtcttccacctctgccactcctgagacagcaagaccaacccctcagcctactcaacgcgaagataatgaggatgaagacctttatgatcatctacttcatatgatctatccacttaatgaatagtaagtatattttctcttctttatgattgtcttaacattcttttctctagcttactttgttgtaaaaatatgctatataacacacatacaaaatacatgttaattggtcatgtgatcattaaggattctgatcaacagtaggctagtaattcatgtatcatacaattgacccctttaggtatacaattcaatggattttagatgtgcgactatcattactatttattttttaaattttttatgtatttattttttgagacagagtctcgctctgtcacccaggctggagtgcagtggcacaatcttggctcactgcaacctccgcctcccaggttcaagcaattctcctgcctcagcctcccaagcagctgggattacaggcgtatgccaccacgcctggctaattttttttgtatttttagtagagacggggttttaccatattggccagtggtctcgaactcctgaccttgtgatccacctgtctcgacctcccaaagtactgggattacaggcgtgagccaccacacacggcaactaccaccactatttaaatgacaacattttcattgctccaaaaagaaacaacatattcatcagcattcacttcccatctctctcctaccccttctaacccttagcaaccactaatctacttgctgattctggacatttcctataaatggaatcatataaagtatttttttgtaactggcataatgttttcaagtttgactcttgtgcagcatgtattagtacttcgcttattcttattggcaaacagtattccactgtatggagatacaacattgtgtttatcccttcacctcatgaacatttgggttattttcactttaggggctataaaaataatactgctattcacactcgtgtatacatttttgtgtgaacatactttttttgaggggaggtatatacctaggagttaccgtacttaggtcatatggtgcctctatatttagctttttgatgaactgccaaagtgtcttccacagtggctgcaccattttacattcctatcaccaatgtatgagggttccaattcttcgccctgaacaacacttactatcgttttttactttatccacccaagtggatatgaagtatcttgttgtagttttgatctacatttccctgatggctaatgatgtccatacatttttaacactgcaagagaaggggggcttgatttaaatagaaaatagccttggtatctagacaaccctacagcattatactaaaagaaagtgatgaaccaagatattcatatttctcatattaaaacaatcaaaaacttacagtgtcagtgacctaaatacaaggtcagtgtttttctataattatttccactggagaataattttttcaattatttccataaacaaaatttatttttacaaaacagatcatgttctcatataagcattagaaattccaaatgttaagcaaatattacatcaatgaccattcaaacaatgaattgaataggcattttgttcacaagagacaggaagtgttatatgtttcacatcatccaatgtagggaaaagagagatccgactgttactgtgtctatgtagaaaggaaagacataagagactccattttgaaaaagacctgtactttaaacaactgctttgctgagatgttgttaatttgtagctttgccccagccactttgctccagccactttgacccaacctggagctcacaaaaacatgtgttatatgaaatcaaggtttaagggatccagggctctgcaggacatgccttgttaacaaaatgtttacaagcagtatacttggtaaaagtcatcgccattctctagtctcaataaaccaggggcacaatgcactgtggaaagctgcagggacctctgcccttgaaagctgggtattgtccaaggtttctccccatgtgatagtctgaaatatggcctcgtgggatgagaaagacctgaccgtcccccagcccaacacccataaagggtctgtgctgagatggattagtaaaagaggaaagcctcttgcagttgagatagaggaaggccactgtctcctgcctgcccctgggaactgaatgtctcggtataaaacccgattatacatttgttcaattctcagatgagagaaaaaccgccctatggtgggaggtgagacatgtttgcagtaatgctgccttgttattctttactccactaagatgtttgggtggagagaaacataaatctggtgtacgtgcacgtccagtcatagtaccttcccttgaacttaattatgacatagattctattgctcacgtgtttgttgctgaccttctccttattatcaccctgccctcctactacattcctttttgctgaaataatgaagataataatcaataaaaactgagggaactcagagaccggtgccggtgcaggtccttggtatgctgggcgccagtcccctgggcccactgttgtttctctatactttgtctctgtgtcttatttcttttctcagtctctcgtcccacccgactagaaatacccacaggtgtggaggggcaggccactccttcaatccaacactgaaatattcccagtttaatcgacagtggaaggcatctgatcaacagtaagctattagtagttagcctactgttagtagaagttaaagtagcattatgaagtgagagggaacaaagattttacaaggaaaatgaaaacaggaatacctcttaaaaacgatcaaaatccctacaaacatttaaaacaactttaccttacagagtatttttacataaattcactgaatgtgcatcgcctgagctcctatcacatgccattattccaggtgtttgatatataaaagctcccaggcttcatgttgcttacagtcctcatatcctcacagaggttaccaattcaggacaggaaatgagtatgacgggtggggtaattggccaaaaaaaaaaccaagatgaatcatgggcatggcaaatatgatttaataagatactgacaagttcctagtaagtaccagtgaagtagataaaactaggataagattttaagacattttttgccttagaatatttactgttttggataatactgcaattaggatatgtttaaattacatttaaaatgtcaaggccgggctcagccttgccttgtaatcccagcccttcgggaagccgaggcaggcagatcacttgaggccaggagtgcgagaccagcctggccaacatggcgaaaccctgtctctactaaaaacacaaaaaaactgcacaggcatagtggcacaggcaaggtagcacacgcctgtaatcccagctactcaagaggctgaggcacaaggcggaggtcacagtgagctgagatcatggcactgcactccaacctaggcgacagaataaaactctgtctaaaaggaaaaaagaaaaaaagcaaataaaatgtcaaaggaccaatagtaagaaagataacatgatgtaaaatatttccatggagaacatggttatacttttgaaggaaacacaatccaatgggctcatgttattcaacgacattcatgcatcttcctggtgcaaactgaataatatgtggagttctatatctgaacaacaaaagagattctgaaaagtacaagaaattaatggataggcacattgatgatgtccagcccatagaggtcaaaggaatacgatttttgaaaaatcgttttccaactaaaattgtatttcggtatcaaatactatctcaaggtaaaaatgtcagtatctttctttcctaaaatatatttgaccattttctcatgcacgagagttgtcctatctttccaccttggcttctttcacagttcaaaggttgattcactgtgcgggaggctgcacagttaagagttaatgtgcctcagtgtgcaaatgtgttcacatgaggtcccaatgacaatgatgcacctcatgacaagcaagaagtgatctcagtaaaaacttaaagttccagattttttttaaaaaaaattggctattgcactcaactaggctaactttcctaaaacagcaatgggcaataaacacaagaaaaatactttgccactgggacaaataaagttagttaagataattgaaaccattaaaggaaatggcaacagggcagcgttaaaaacatgaccttggattcagactgctcttaaattactgctcaaccatttactcattgtgttacccctgggcaagctgtttaagctgtttgagctttcattctcatctatgggagggggaaacacctgttacacacaaatgtagcaataagctttagaaataatctacggaaaactcacaaaaacaaagtctagcacacaagaaacttaaatggtaaaacgtatctaagtcagaagacttgtactgatattgacttattgaattatgatttttcatcactttttaaaaattaatttctttttagagatgggatcccgctatgttcccaggctggagtgcagtggctattcagaggtgtaagtaaagcacactgaagcctcaagcttctggcctcaagtgatcctcttgcttcagcctcccaagtggctgggattacaggtgtgagccaccacatccagcttcctaagtcacttattaaagttctctgggttggctggcacgatggctcacacctgtaatcccagcactttgggaggtcaaggcaggtggatcacctgaggtctggagttcaagaccagcctggccaacacggtgaaaccccctctctactaaaaatacaaaaataagccaggcatggtggtgcatgcctgtaatcgctgctactcaggaggttgaggcaggagaatcacttgaacccagaaagcggtggttgcagtgagctgagatcgtgtcaccacactccagtatgggcaacagagtgaggttctgtctcaaaaaaaaaaaaaaaaaaattatctgggtctcagttgtttccatttctaatataaaaggactatacttgataacccgtatggtacatcccagcaacaaaactttgattccataatttaattttgaactacttttttctttttttgagatggagtctcactctatcacccaggctggagtgcagtggcacgatcttggctcactgcaacctccacctactgggttcaagcaattctcctgcctcagcctccctagtagctgggattacaggcacatgtcaccatgcccagctactttttgtattttagtagagacggggttttcgccatgttggccaggctggtctcaaactcctgacctcaggtgatctacacatttcggcctcccaaagtgctaggattacaggcgtgagccaccatgcctggccagaactactatttttaaatggttttattttcaaaaataacatttgtctttccagtgaagttttaagtaataatgcaccccagaatcaaccaacattgacgagaactcctacaattatttatacaggataactgtgacaatgggaaaaacaaaaacacaaaccaaaaggaatcatgtttcatccccatggatagatctccccttgcaaaatctgacagagttaagtctttactaattctttcctctgttgcttttacttgtcaaatcacagtatgttcatctttcttgcctaaaaaccttaatacggctgggcgcggtgactcacgcctgtaatcccagcactttgggaggccgaaatgggcggatcacaaggtcaggagatccagaccatcctggccaacatggtgaaaccccatctctactaaaaatacaaaaattagctgggtgtggtggtgcatgcctgtaatcccagctattcaggagtctgaggcacaagaattgcttgaactcaggaggcggaggttgcagtgagccgagatcgcgccactgcactccagcctggtgacagagcaagattccgtctcaaaaacaaacaaaaaaccttaatacttggtgctagcagcaggaggcagcagagatcctttggctgccagggaagctgagatcaacctaagcccagacgagccagggacgtgactctcaatcatcccactcagggagccatttcacacacatgaggaacaagtgccaggtttctctgggtaaagtcagactttgagttcagcagcagtgcggaaaagaaggctaagtctagggctgggagctagaagccccgagtcccattccaaattaactagctacaggttcagagaaagttccttcttttccttgaacctcaaattcatcttcaaaataaggggcttggttaaaatggtctcaaagcttgctttctgtacatcaacatttgtgtcagataccatctattactggtcttcgcaacacaaatctgctcctctccaccacaacttgattgaaataggtcctgtaatcttgtagataagtcggggaacagtcaagcataatgtggagactcctctaaagactgtctccctggccttgctcacagcccagagtgcaaagcttcccccaaaattctgaactgtaaaaagaaatagaatgagagcaactttccaaattatgctctgctactggtgataagcggtggactttcttcctcccacacctgaacaaaggacacagagcagggagactctgtctcctcctactctgtgggtaacagaacctaatgaagcacccagagaaacccacgtgggcagccagatgggctggcagaggaaggaggcgaccccaagcaggagttcttcattgagaatattaattacttgtgggcgtgcgggacaccagaggggttctccgcaagcctagaagtttcctgctggaaacactgagggttccactagatttcccttccacagtgaaacacacaaggcaggtcccaccaactgcctgtgaaaaccaagatgttaaactcaatggaggagcttggaaatacctgttaacaataaaagaggacaagagccagagacacgctcaaaccaaaaatccaggggacggcgtccttacccacattgtcctgaaatagcctctgctcctttttctttcatctctaactggtgagaattaatgagaaaagccagcagctgtacttctgaatgtcatcaggaagaaagttaaagctgctgtgcccagcactgggactgcacaaagcaatggctcaggaaagcagcttagtcccttgaaacagagccacctcaccacatttcctgagtcaagggctcaacatcctgaggagaattccaagtcaatacagcatcgtgtgcactaccatgctgaacaaacccagtaatatcaaaatgtttaccaaattgacatgaaagcttctggtctgaacttgaacaatactggttcagtcataacaaaatttactgataaacagggccactgaaagaattacaatggtaaataaatactaagtgtagagagacaaaatcagccaatgatacaggtgagaggacctgcggggcaccaccgtggctctcggcatactagagggttgcaccccaaagggagaagtctggaaaaacattgggttttaaaggtctcatctggttacatattataatatctacttcataaaatctaatggctatactttttttgtttgtttggagacagagtctgtcacccaggctgaagagcagcagtgacacaatctcggctcactgcaacctccgtatcctgggttcaagcaattcctgcctcagcctcccgagtagctgggactacaagcacgtgccaccacacccagctaatttttgtatttttagtagagatggggtttcaccatattggtcaggctggtctagaactcctgacctcatgatctgcccgccttggcctcccaaagtgctgggattacaggtgtgagccaccgcacctggcccacccttattcttgtttgtctgtttgagtcagaatttcgctattgtcacccaggctggagtgcaatggcacgatctcggctcactgcagcctccgcctcccaagtccaagtgattctcttgccgcagcctcccaagtagctggaactatatgtatgtgccaccactcccagctaattttttatatttttagtagagacaaggtttcactatgttggccaggctggtcttgaactcctgacttcaggtgatacacccacctcaacctcccaaagtgcagggattacaggcgtgagccactgcacccagcccccttattcttaatctccacaatcaaactacaaattatgcattactatttcgagtttacaaatgaggaaacagactcacagaggctaagtaactgatcaggagtacaagatagaagtgccaaagctatgatgttaaatcaagtctgtcaccaaagcacaatacaccttacactttctcttatcccagtggttctcagtgagaggaaaactggcaaagttcagagatatttctaattgccacaatcagggatggtgacagctgatactggctctgaggggtagatgccagggacgctgctaaacatcctatctggtctgaagtgccagcagccctagggttgagatggggcctacacgtagttatgggaccaaatgtgagctgaaggcatttcaagaagggaaggcatcctcttaattgggtactgtgagaagcctttgtcacaatggtgggattttcgttgagtcttaaaaatgtgggtagacaaggatggcatttctggcagcctagaacaaaagagatgatcaaagatgtggagataaaaaacggaaaggtgcccttaggggtcaagatgattaccagtgagtactttctctaaactacctacaaaataaaaccagtaaacattcatgaatgaaaattctggtaaatctgcacattataaatgtttgggacatctttgaacattcataaaaaacgtaagctggtagattccagagggaaatagggtacctgagggacatcactttttgtctgcaaggggaaatacaggctgacaccagatgatagaaaatcttaaacaggttcccagaaagtgacttaacttctactggacataggcccagtacaattccaaacttattacaggctcataataagtttattatataaaacccattatataacggccaaaatggtaaacccatgagctctgaagccagactatctgggtttgaattcctgcttcaccacttagcactttttaagcgacttcctaactaggggcaagttacttaacctctctgggcttctgtttcctcttgatgaaatcaggaaagtaataatacccatttcacagggttattgtgaggaactcaactatgcaaagtactcaaattatacctggcacatagtaagcactgaattaactatttgctactattagcattactatctctcattacatctttacaataaactaatgaggaaggtatcatttttgtttgttttttgtttttaaagagacagtcttgttctgtcacacaggctagagtgcagtggcaccatcatggctcactgcagccttgaccccttgggctcaagtgatcctccgacctcagcctcccaggtagctgggaccacaggtgcatgccatcatacctggctaatttttaaattttgtttggtagagacacggtcttgcgatgttgcccaggttggtcttgaactcctggtctcaagaaatcctcccacctcaaccttccaaagtgctgggattacaggcatgagccaccacgcctggctggtatcattattttccccacttttattgatgatgaaattgtggtttgcagaagttaggtaacttggccaaagccctttggtgaatgtagggtatatttgatgccaaacccaagctcttaacaactccatatattgcttcatgaaggccaagaacataaagcttcagcaaacaggcaatgggaagccactaaagaattctaaatgggaatatgagtcattaaagcaaggttttacttgcaatagaaaggagaataaactggaaaagggaccgggaattggatgggctgtatgcacagagagccaagaaaagcctgtgaaaaggtactagctggaggtgataagggcctgaactaaagaggacagcaacagaaatacaaagaacatcaagagtaaaagacatggcaaaggagagttcaacaggcgggttcctggggaagcacagcaagtgatagagtaaggagaatgactggaacatggtcggttatccatgactcttaagaagaaggtctacagtgaaaggatactaagaaaatactaagaaaattggtctgctctggcttgttctgggaaatgatataactgtgtcagtctgcaataaaaaatcttcctagtactacccgggagaaagaaatactgaaaacataggctgaatcaaaggggttgaagggaaacctcaggtaagtagattattaactggagtatgtaatttcttgaacaacttactacactgaaagttctgcgtaagcttagggggaaaaaatccagattccatgataatatttttcttaaagaaagatgggttcacacacacaaaaccaaaaccaaaccaaaattccattaacactgcatataagaacaaagtgcagaccacatgacacaatcaaattttcagcttgaatttctctgaactaaagaaataatataagagctctttctaagtttccaccaaaaacagggtacatgaattacagtgaggataacacacgcattggccaggtgtggtataatcctagcaactttgggaggctgagatgggaagactgcttgagtccaggagacaaagagaccagcctgagcaacacagtgagaccccgtctctacaaaaaaataaaaattagctagcacggtggtgcatgcctgcagtcccagctactagggaggctgaggtgggaggatcactagagcccaggaggccaaggctgcagtgagctgtgactgaccagtgcactccagcctgggtaacagaggaagaccctgtctcaaaaaacaaaaacaaaatgaagaacacaggttaacttatttaatcttcggttcattcaacaaggatgcactgaggttccactgaacctcagattttcatctttcaacttacagactccttcaacttgctaaggctatattttcttctctagaagataaaataaatgtcaatggctcatctgtgaattcacctttttttttttttccctgagatggagtcttgttctgttgcccaggctggagtgcagtggcatgatctcagctcactgcaacctccacctcccgggttcaagtaattctcctgcctcagctggcagagtagctgggattacaggcgtgtgccaccacgcctggctaatttttgtgtttttagtagagatggggtttcaccatgctggccaggctggtctcaatctcctgacctcgtgatccacccgccttggccgcccaaagtgctgggattacaagcgtgagccactgcgcctggccaaattcaccttcttacacactaagcctaaagggtggtggtgtggtcagtcacttaaggcaacagcaagcccctctgaaagcatgaggttctgggaaatgatggagcctgcgggaaatacatgcaggcagctatttctgaaattattcagtatttgttagaatgtgtaattcctttaatattttcaagatttatcaaaaataattaggagattcttcccaagttttaacaatatggttttatttttttgtgtttttttgtgtttttttttttttttaaagactttagagttgctgctaaatgttacaaataatacactagtcttatttggggatcaaataattccacttaacatactaatttctgccctcaccacataacctcttctacattaaagttgttcatttgagatatcagcctgtcgaaataatgaataaaaatgctactatttgaaagctaagggcaaacagatacagtactgaacaaaagttagccataaatctaggcccacatgtatacctagcataatactacatagaaacacctcaattcaactgatatagaagacaatgtagtgaacttttccctctccagcccctcttctcaagtaacatctgtcatgttacagaataagctgccaattttccatacaaggctgggtgcagtggttcacacctgtaatcccagcactttggaaggcagaggcaggcagactgcctgagcttaggagtttgagaccaccctgggcaacacggtgaaaccctgtctctactaaaaatacaaaaattagctgggtgtggtaccaagcacctatagtcccagctgctcaggaggctgcaatgagctgagattgcaccacttcactccagcctgggtgacagagcgagactccgtctccaaaaaaaaaaaaaaaaaaaaaaaaaccgtacaaaaggaagaagagatgaacacacaggcaggctaaacaaagttatctgcacacaaattcaacagaaatatcaaagatgcttttactacacaaatttaaacttcaaactttttacaggcaatgagtagaatacatactgattccatgcagaacactggaatgggcaaacactgctaattaggaggagttcttccatctacgcatactttcattctacagatgtttactagagcatcatctctaagcctgaccctagctgagggttttcttctggcagggcaactgaacaaaacacacatctaatacagtaatttctatatgagttaaacatttccatttttttccccagctttactgaggtacaactgacaataaaaactgaatatattagtagtgtacatgtcttgaaatatgtgtacactgtgaaatgattagcacaaaacagctaattaacctaacccagtatgacatatagactctgtgtgtgtgtacatgatgagaacattcaagtctactctgttaacaaattccaagtacacaataatgttaactatagtcatcatactgtctattagatctgcagaatttaaccacgttataactgaaactttgtacacaactcttcaattatctattatttaatctccatccaaggatacttagtaaataaacccagtaagttatttcttctaaattacttcctaatgaactaagtggatgttttatagtagatactgaacaaaaacaatgtaattgtaccatgtcacataccttaaaaaaaaaaacgacaggcaaaaaacgtatgcctgacaattacatgttgttcccttcacaacacaaaatatcattaaatactgacttaataagagttcaaaatgttatgcactgatacatatgtaacatacataacatatatacattatgcactgatacatatgtaatacatatacatatttgtaaacagcattcatgttgaaagcctaaccaattaggtactagggcctaggggctgccgtcaaaagtctcacctgtcgaatgatactcttcacacaacgtactgggaggccttgatagttggatttgatgatccacttgaggagatggtggccaagtacttcgaagaccatgcagacatctgggacacagttaaggatcgtttgtggatgcactgcctggagtgaggcagttattgaaagcagcaccattgtgtcacttgcaaagcacttattactttataaaatacaacatcaaccctatcagtaataccaaaagtgagaaaatgttgtatctcacttaaataacaagaactgacattactaaatacaggtgtttcccagtatctcaggagattggttccaggaccgctctcagataccaaaatgtacatatgctcgcctcttcagtaaactggtgtagtatatacataacctattcacatccttccatatactttatttttatttttttttgagacggagtcttgctctgtcgcccaggagtgcagtggtgtgatcttggctcactgcaagctctgctttctgggttcacaccattctcctgcctcagcctcccgagcagctgaaactacaggtgcccgccaccacgctcggctaattttttgtaattttagtagagacagggtttcaccatgttagccaggatggtctcgatctcctgacctcatgatccacccgccttgggctcccaaagtgctgggattacaggcatgagccaccgtgcccagcccatatactttatttaaatcatgtctagattacttataatacctaatacaatgtatatgctatgtaaatagttgttatactctatttcttaatttctactactttttactggtgtttcccaaatatttttcatccaacgtttattaaatctatgaatggggaaccagcagataaaaaagggctaagtgtacttactctgtgccatatattatttcacgtgtactccaaacaaccttaggcaataatgtaattaaccccactgtaggcatgaggacatggcactttctaggtgtagagtgcacttagaaagtgccaggtggctgagccactactcaagcctacactgagctgcactctcacccatctcagcacactccctggaaatcagcctgatgaaacaggcaagactgaaacctcctaggaactgacatgaaacaaatacagagctccagtatctcaagtgtcctaactgcctgcctaaatttctacttgataagctacataaaacacattataaaataaaaatttagtaaacacagttaagacctatttaatcttttccttgaataatatcttacattatacaactagatcaattttaatactataggcaggtgttaagaatgtatgatcaccatttaagacatggtattaagacttaatctatagtaacaacatctcaggaatctggattttcttttcttaaaaaagacagggtctcactacgctgtgccaggtggactagaactcctgggctaaagatactctcttgccttagattcccaagtagtcagtactacaggtgaaaaccaccatgcccagcttaatttttttttgagacacagtcttgttctgtcacccaggctggagtgcagtggcacgatctcagctcactgcaacctccacctcctgggttcaagcgattctcctacctcggcctcccaaatagctgggattacaggcgtgtgccactatgcccagttgatttttccagttttagtagagacagggtttcaccatgttggccaggctggtctcaaactcctaatctcaagtgatccacacaccttggtctcccaaagtgctgggattacaggcatgagccaccacacctggccccaacttaatttttttttaaaataggtatttcagccttcacaactatgatacctccaatttcattatatattcatgtcattcatacaggaagattacaaatggctctgaaaccctttgagaacattttattcatccctggaggcttacatttgactttagaatcaaaaaaagtagttgatttaatcaactataataactgaatatgctatattaaaacaatattattttaaatatttttagtgaaaaaaagaaaaatctttctatactgtttaagaatgtaagcactacagatttatgcgcagataatctaaagccagaagtttcttactatttcccaggctcattacaaaaacggcagattatttaaggactacatttagcagcaggcatagggcgaggcccaggatatcccaaacataacctaagtcttctcaaagcactggcatatctggatatgatgattacttcgcattttgcttaacagtaaaaatacccactagaacgtatatttcaaaaacctctatttacccacggattaagtagtttctccaaagaaatgttctattagctgtcccaagaaggaccttgcaagtcggacacagaagaagtgagtgctctgccgctatctgcttactgatttatctatccaaagggaaaaatatactcagcagttagcagaaattaactggagaaaaaggacgaggtaacattagcagccactggtacttcctagtatactcaagatgaatttctaaaagaaatatgagggattttcaaaaagtctatggaaaatgtgtattttgaaaacactatgcatagatttcaaaaatttttttgcaccaaaataaactcatactagtttgttaaagtatctgaacaggatctagtttgaggcactcgcaagataagacatcagtttgaaaaaagcctctaacagagcaacatgaattctaaaatcaaagcaataacaaacatcaaatttatgatgaagcttgggtgaaaaaatggtgaaatcactgatgctttatggtaagtttaaggggacaataccgcaaataaatcggcagtttacaaatgaataaccggttttaagaagggatgagataatgttgaagatgaagcctgcagcggcagaccatttgcatcaatttgtgtggaaaaaaagtttgcggccgggcatggtggctcacacctgtaatcccagcactttgggaagctgaggcgggcagatcacctgaggtcgggaattcgagaccagcctgacccacatggagaaatcccgtctctaaaaaaataaaaaataaaaaataaatacaaaattagctgggcgtggtggcacatgcctgtaatcccagctactcaggaggctgaggcaggagaatctcttgaacccgggaggcggaggttgtgctgagccgtgactgcaccattgcactccagcctgcgcaacaagagcaaaattccatctcaaagaaaaaaaaagtttgcaccctaattgaagaggacagatgacagcacaaacaacagccaacaccacagacttcacgactggttcaacttatgcaattccaattgaaaactgaagttgagcaaactttccactcaatgggtgccaaaaccattgttcccagatcaagacaagagcagagctttcaacggaaattttaaacaggtacgatcgagatcctgaggcatttcttcaaaggactgtaacaggacataaaacatggttctacagtatgatcctgaagacaaagcacaatcaaagcaataactaccaagaggtggcagtggtccagtcaaagcactagtgaactagtgaagaggaaaggtcactgcaaccgttttttgggatgctgaggcattttgcttgttgactttatggagaaccaaagaatgataacacctgcttattatgagagctaattttgagaaagtcagtgaatgctttagcaggaaaatacctcagaaaacttcaccaaggagtccttctccaccatgtaaatgttcctgttcattcctctcatcaaacgagggcaattttgtgaagagtttcagtggaaactcattagacatccaccttattatccttatttggctactcctaatttttgtttcttaatcttaaaaagggcacccatttttcttcagttaataatgtaaaaaagatttcactgacatggttaaattcctaagacccctggttctttggggagcaactaaatggctgatatgattgtttacaaaagtgtcttgaacttgatgaaacttatgtgagaaataaagtttatattctttatttttgtcttttaatctagtttttctatgaacatggtgacattcccttgtataaaaaccttctcaaatatatagagtgaaggaaatgcttccctagttgatcatgacttagtagatgcataaactggatgtcattttggagtttaaatctgggaaaaagccttatccttaggcttctgacatttgtgaaagtaaaatatcaaaatggtggatctgttccaaacatgatataaagagcaaaaaatctgaaagaagccagaagaccacagctactgacacaacctagcacccatcagtcatgtgcctctgagtaaagtggtccgattttcttgaaccttggaaaatgaaagtactgcctactccaggcacacaaagggctatctcagaggatccaacacccacataaagaaaaagtactcatgacactgaaggcatcatctcttctcttcatttttgctttcttctctgagctacaggttttgggatactttgctctctgtcacttctccctggagctaccctttgccaactcctcaggtagaggaaggataaggataacatgccaaccctttctacaatcctaattcacttcctcctgagtccccatcaaaaccaacaagcatccacataacttagtagcatggtcaaaactgatattctcaaaaaagaaaggaaagtcaagggacacctttgcttgtcttcttcctagacacacttccaaagataactagtattagtgagaggtgaagccagctggacttcctgggtcgagtggggactttgaaaacttttctgtctagctagaggactgtaaatgcaccaatcagtgctctgtgtctatctaaagattgtaaatgcaccaatcagtgctctgtgtctagctaaaggattgtaaatgcaccaatcagcactctgtaaaaacgcactgaccagtggtctgtgtctaaaggattgtaaatgcaccaatcagcaatctgtaaaaacacactaatcagcactgtgtctacctaaaggattgtaaatgcaccaatcagcactctgtaaaatggaccaatcggcaggtccatttctccaacgtgggcacggacaaatgagggaataaaagctggccacccgaaccagcagcagcaacctgcttgggtccccttccatgctgtggaagctttgttctttcactcttcaaaataaatcttgttgctgctcactttttgggtccacaccaactttaagagctgtaacactcaccatgagggtctgtggcttcattcctgaagtcagcgagaccacgaacccaccgggaggaacaaacaactctggatgcgccacctttaagagctgtaacactcactgcaaggtccgcagcttcattcttgaagtcagtgagaccaagaacccaccagaaggaaacggacacattacgactaaggccatccatccttttaaaaaacatgagaaacacctacacttatagctgaccaagaaacactttcctctgttaagaatcactaacttctgtcaggataatttaaatactctgtggatcatagtctaacaagaaacagaaaaatgtaaattgagcaaattaatctgaaactgaacaactaaagtaagtgaatacagacttaggagtaaacaatattgttaaaaatgattcaaatatgtctttaaaagttcatttttgcaataccaaggaaatctgtattaagaagtctccaataccaacgatatctgacgagatatcaagaacccgttaatgtctttggtgagttttaaggttatgtttaaaagttcatatttttttcaaagattcacaatgacacagaagtaaaaggacatgacttctaggatttgctctataataattcagcaagaaaagatagatggatcaattatggccagaccatgacaattattaaacttgagtgacgaatttacaacaatttactgtagtatgatctctttcttatatgtttgaaatttctcccaataagtttgtaaagaaaaacaataaaggtattttcgatcaagcactggcttatgtcagatttatcaaggagtatagaaaatgcagagtatagaaaatgcatcattttacttttccttaacttttgcaatatagataaccaggaataaaatcaagaaaaccaaaatgtttccatactcacctgacagaaagatgagcctctgcaggacaattatttgaaaggctcagttgtatcattttggaaaaagaatttggcaattattagtactattcagaactaagagcagtcaagcgccaccttgggatgtggacatttacagagcatttttccttttatcttaaccaatgctccattttcacatggtgctttgcagccactggggcacacacagattgtccttatgcactggttttagaaagtttaaaacacaaagaagtggtgctgatgtatgcttttatctaccaccacaaaaaaaactttaccactattaatgggaagagatcaataattaattccacaccaaaattaagtcaagttgttgtgttaaaaataagtttctaagatgctactctaccaaacaccccaaaaagccatgaaaactattctaggtggaccacttcataatacttgacaatgttcctagagtgtttatgttgaaggtgatacagcagtaaacagagattataggagcttgaaatattttcattttttaaaaggtaaaaatacaaataaatcaggaagtaaaggatacgtatcccattcatgcctgaaatcttgaagtcgtcaatgagctggaccaccatgtctttgtttgggtcactgggatcactttctcgaacctatgccaagaaaaatgaatgcaagaacacaggagtttgagacaaagcatgttttcccattataacaccaatactgtttaaataaaagtatattttaaaataaaaaattcatcacaaagttataaaaaataaactttatttatttatttatttatttattttttgagacagagtcttgctctatcgcccagtctggagtgcagtggtacgatctcggctcactgcaacctctgcctcccaggttcaagtgatactcatgcctcagcctcccaaggagctgagattacaggtgcccaccaccatgcctggctattttttatatttttagcagagatggggtttcaccgtgtttgccaggctggtctcgaactcttgacctcaagtgatctgctcgctttggcctcccaaagtgctgagattataggcatgagccaccgtgcccagccaaacttgactttaatttagtattacccagaaaaatctttctgtaaaattttaagtcattaagttttcttatatcattcacatttttaaagtacttacacatttgagcaattttatttcatccaaggctgtctccgtataatgctgggcactttttacaactttcattgcaacaaatcttttccccctaaaagaaaaaacaaaaaaagagtctatttatctatattatcagtagaaagaatcactggtatccaggttgagcatccctaattggaaaatgtaaaatccaaaatgcgccaaaacctaaaacattatgagtgtgtcaacacgatgccacagtgtaaaattccacctctgactgcaatcaaaactcagtaaaagatttgcatgttgcacaagattatttaaaatatcgtataaaattgccttcagggtatgtgtatatggtgtatatgaaatataatgaattttgtgtttagatctgggtcacatctccaagataggtcattgtgtatatacacaaatattccaaaatccaaaacacttctggtctcaaagcatttcagataagggatattcaacttgtaatgagatctatccaatacacagaaacataagctttcctttaaaatagtacttttcaaatggtggggccacattaaatagtagtatgggtcaagacaatctcttttatgttttgttttgttttttccctaattaaaataagactagataaacatcagagttatcacgaatattacacaccaacctaatagtgaaaaccattctcttttaacacttttgtttcagtacacacacacacacacacgcaccaaatgtgtgtgtgtgtgtgtgtgtgtgtgtgtgtgtgtgtatggagtagcaatgaagtttcttactatgggtcatggctttgaaaagttaaaaatgactgatttgaaacgcctatactatacattatgtttgtctgatatggatgaattactagaaaaataatataatcccagtgtaaaacaatttcaatgaattaactttgaaataaagctggaagcaagtaatattttaagatttcaaatgaacttcaaactaaggcagggggcaggaaggaatctagccagctgaggcaggcctgtgctaagcacttcacatacctcaacaaagcagtggtgaccctcagccataccttcttagaacacagatgttgaactactccaggaaacaaatgcacaaatgacaaagaacacttactgcatatcccagcacagccagacagtagagaagtgcccccatccaagctttctaataacatgataccggccattgaagaggtctccaattttcactggatgatatccaccttaaaaaacaagaaagaaagaaaaaaattcaaaatattcgaaaagtagtaataaacatttcatctcttttgtcattcttgatgtcattaaagaaagctctacataatacatgcagactaaaacatgtttaataatacaacatttttttcaggaatatctttcaacaagaaaaagtgttggctggatgtggtggcttacacctgtaatctcagcactttgggaggccaaggcaggtggatcatttcagatcaggagtacgagaccagcctggccaacatggtgaaatccagtctctacgaaaaatacaaaaatcagcagggcatggtggcgagcacctgtaatcccagctacttaggaggctgaggggagagaatcacttgaaactgggaggtggaggctgcaatgagcctgagtgaaaagtgtgcgactgcaatccagacagcctgaccaaaaagtgttctatgaattcctattagacttcttgttttaatttaatttaaagaggcaatgaaccatctagcacaccgtaatgataacttgaggttctctatttacttatttatttttaagacagggtctcactctgttgtctagactggagtgcaatggcatgatctcagctcaatgcaacctctgattcccaggctgaagaggtcctcccacctcagcctcccaggtagctggaactacaggcacacaccaccatgcccagctaatttttgtattttttgtagggacagggtttcaccacattacccaggttggtcttgaactcctaggctcaaacaatccgcacatctcccctcccaaagtgctgggattataggcatgagccaccacacctggccaaggttctgtatttcaatctaggtgtgtacgttatgcacataccagctcttggtatttaaagactttttttctcctaaacaagttaaattcaaatctttttggatatgtgcaagaaaactgaccaaaataaacaatgtttactctgtataattctgcatacattaatggtttattaataactagaaactgtacaatgatgtcttaatttaccctctaacagggcttgttcctctcatcactcttctgccaactcctaactcctgcctggaaacattcctcacaaatgaagaaatgaggccgggcacggtggctcacacctgtaatcccagcactttgggaggccaaggcgggcagatcacctgaggtctggagttcaagaccagcctggccaacacggtgaaaccccatctctactaaaaatacaaaaaattagtcaggtgtgctggcgaactcctgtaatcccagctactcgggaggctgatgaagaagaattgcttgaacccaggaagcagaggttacagtgagccaagatcaagccactgcactccagcctgggttacagagtgagactccaccaagaaagacaagaaagacaagaaagaaagaaaaggaaagaaagggaagaaagggaggaaggaaggaaggaaggaaggaaggaaggaaggacgggagggagggagggagggagggagagagagagggagagaaagagaaagaaaggaagaaagaaagaaagaaagaaagaaagaaagaaagaaagaaagaaagaaagaaagaaagaaagaaagaaagaaagaaaggagaaagaaaaagaaaaaggaaagaaagaaagaaagaaagaaagaaagaaagagaaagaaagagaaagaaagaaagaaagagaaagaaagaaagaaagagaggaaggaaggaaggaaggaaggaaaggcaggcaaggaaaagaaaaaagaaaagaaagaaaggggaggggaggggaggggacgggaagggagaggaagaaatcagctatagagggcaccctattaaggtagattcttgagggcaagtagggtgcctcactgatatctggcatgagaagttcttcacttcgcatttttaagcagaataagcaagctacaaactagcatggataatatggtacactttttgtgaaatacggaggataagatgttaggaatggacattcctgggtataaaattactcttaagtctctttatctacattttattctttttatctatgctttttcaatttcttcaatttttctaaaacaatattttactacttttttactttggaaacagatttttcattcttttaacatttgcttttttattgtaaagatgttatttcttttttaatctgcagaattcttacaaattactcaataaagatgtggatggcttgtgcctagtcttaagagctctagagcagttataggaagtatctaaccagatccttcaatatattcccagagggctctcaataatacttcaagaatatatttctgaacatttaaattgtgttggattagtgaagcaggaatctgaccagatactgagttcgtgagattcttacccttctactgcctctgcacttgcttgtcctggatttgaatctcaaggtgtatgacaacattttgggctaaatatatgaactaaatgatagtgaattaggaataaaatgtagcaaattattaaatggcttactacttagaagattaaactaaaattaattaaaagaaatgagctctgagtttataatacagttatttatttatttatttatttatattttttgagaccgagtttcgctgttacccaggctagagtgcactggccatctcggctcactgcaacctccacctcctgggttcaagccattctcctgcctcagcctcccatgtagctgggattacaggcttgcaccaccacacctggctaatttttgcgtttttagtagagacagggttttgccatgttggtcaggctggtctctaactcttgacctcaggtgatccacccaccttggcctcccaaaatgctgggattacaggcatgagccactgcgcccagcctacaatacagttttcaaaccattaaaattaacattcaaagcaggaaatgaaacagtttatccagtataattaggaacactgtgcgaggcactttattttcaaaactatgttccatgaaacaaaaataaactataatatactgcaggtgttcaatagaggagcaggggagtaggaaggaagaagggagaagttctgtttgagaaacgcagtgttgaacaaagaaaagcagatttcttgaccataggcctaatgttttaatacagagtgagaacctttaagagaacagaaaatgctgcatattcctgacatacgtgttcatggaattatttcttcagagacctagttacattttataacacaagtatttaggaaagactgatctaccataattcttgaaaccaccatacaaagtagatggtattatttctacaatgctacagagaacaccaagtatcatagattatgaagtactaggttcacggctggaaactaggtatgactccaaaacccatgttttatcaactagtaagaaatacactccaattttaataactagaggactgcttcctggtcttagtacacagaaaacatgggatgtcttaattaaaatctatatactacttaaacgtacattattgctaatatttgtcactaaatttaaaaataatttatgcataaaaagaaacctgtatcactagtatatgtttcagattcaaattctcaattagccgaagtgtatacatgtgagcaaaaacagaagagcactatttccaatgtaatcacagtgtaagcatagcagctccttttctcaagggctttgaaagctaacaacaacaaaattactactggagtaaagtatccctgaagccctcagtctagctaaaaatattatctctataaaaaggcaaattacacaagaggggcattttttttttaaagagatgcgggctagctctgtcacccaggctggagtgcagtagagcagcacgaacagggcttactacatccttgaactcctgggttcaagcaatcttctcaactcagcctccaagaagtacatgccaccatgcctggctagtaatagtatttttaaaacaactgaaagtataacgcacttaacttacttctattttgaaaacgtgatatacacaatttcaagtctatgtatattctcatattgtaactcctggtttcctacacaatcaagtatcttctgaccattcatttttcattcccttctcacagaatggcagccttgctcacagggcatctcctctaacacccatgctgccagaagagtggtctctgtccccgtgcaccagaccacactaacctaatacccagggaatctgaaaaaatgaacactccagtaactccaccagaaatgaccccaattccctgggcttagttaactatgtgcaccataatggctattagcaatggaaccccatggtctaccacattgcccagcacacaagaaaacaagtacagtcactagacaaagactcaaactttattcagtttgctgcttcaccagagaacagaaaaggagtatgggacaataacactgctatggaccctgctaatagcattaggcagggtgccagaaagcctcaggcacttgaagatcaccatgacttaagagtttggttgataacacctgtacacttcactatttgtactatttaatataaaaaccatgcatttatcaaatagttgtgtgttggtgtttttttttttttttttggctgcttaaaaaaacaaatcttagccgggtgcagtggctcacacctgtaatcctagcactttggaaggctgaggcaggtggattgtttgagcccaagagttcgacaccagcctgggcagtacagtgagaccctgtctctaataaaaaaaaaaaaaaactcttatcggattacaaacacaaagagaacaagaacaaactgttaagtaaccattaaattcattgctctggtttcttctacttccatgcctctagcacagccaagatttctgtaactaaaactctacctatgctaataagaagactccaaagaagaaaattttaaaactctcctttttacctatttgggagacttactggccaaagataaaggttcccttttccttgcctagcaaaaatagattctatttatggagttaaccagaagttcagaactccatgacaatgttctggaagtattttcaacaaagtctctttattttcttaataaagataatattaagtattacctgagttccgctgagaatgctttctcagccctctgattgtggggtttctctacataaccactgaaaactttcaaaggactagggaaagctgagaatcacccccaacacacacaatgattaaaaaaaggaaggggtggaaaaaagaaatttgttcacagtaacataacataaagacacattctgtgtcactgaagattttaatatttccttcccccaaaactgataaaagcaagcagacataaaatcagtaaggatatggaagatttgaacacactatcaaccagcttgacctaattaccatttatagatcactacactcaacaacaaatactcttttcaagggcacacaaaacatttaccaagatatataatgtactagaccataaaacaagtctcaatagaaataagaggattcggctgggcatggtggctcatgcctgtaatcacaacaatttgggaggccgaggcaggtggatcacctgaagtcaggaattcaagaccagcctggctaatgtgacaaaaacgcctctcttactaaaaatacaaaaattagctgggcgtggtggtgcacgcctgtagtcccagctatttgggatgatgaggcagaatctcttgaacccaggaggcagaggttgcggagtcgagatcacaccactgcactgcagcctgggccacagagttaaactccgtttcaaaaaaaaaaaaagaaagaaagaagaggattcaaatcacacaaagtatgtcctcagaccataacagaattaaattacaaaccaagaagagaaaatactcagaaatttggaaactaagtaacacaattcaaaaataacccatgggataaagaagaaatcaaaaagaaaatagcaagtatttcttacattaagtgaaaatgaaaacttaatatatcagaatctatgaaatgctgttaaagcaaactcagagggaaatttatagcactaaatgcctataccagaaaagatctcaaaaaagtaatcttagtttccaccttagaaaactaaaaaaatagcaaacttaacccaaagcaaacggaagaatgaaaatataataataatatgaactataaataagtaaaacaaaaaagcataagaacagtcgagaaaatcagtgaaaacaaaagctggttctttaagaaaataaaagcaattaacaaatttcgggccaggcagattgggcagtgagagaaaacacaaattaccatcatgagcaatgagtgaggtaatgtcactatgtatttttgaggtattaaaaagatagaagggaatattatcatgttatacctatacatgtgaaaacttagataaaatggacaaatacctgaaaagtcacaaaccactcaaggtccaaacagaaaaaaaaatctgaaaaaccatgtatctattttaaaaaatgaatttattgttcaaaatcttcccataaaaaatgcattggtatattttatcttgatattatgaaaaaaatactacaaattcctcctaaaaagtaaaaaaagaggaaatacttccagttttgatcctatgaagccagcattttttattccaaagccaggcaaagacattataagaaaactgcagaccaattttcctcataatgtggatacaaacgttccagacaaacgttcaacaaatcaaatcaaataatatatcaaaaggataaaacatcatgatcaaatggggtttattccaggaacacaaacttgggtcagtattcaaaatccaactgatgtaattcatcataattaatatgctaaaaaagaaaatctatatgatgagcacatcagacacagaaaatcatctgacaatatgaaacattcattcttgatcacaattctcaatgaagcaggaatagaggaacatcaatgaaaagcccacagataacatcagatttaactattaaagaccaaatgctttccccctaatatcagaaacaagataaggatgtctgctctccccatttctagtctgctgttttggaagctctaactagtacagtcatgcaaaataaataaaaaggcatcactgctggaaaaaaaagaaataaaatttatctttattcacagacaagccacagagatgtatgtggttttgcatatatgtgtgtgtgtgtgtgtgtgtgtatgtatatatgtgtgtgtgtgtgtgtgtgtatacgtgtgtgtatatatatatatgcacagtggcatatggttttacatacatatatatagatgtatgcatgtgtgtgtgtacatatatatgtatgtgtatgtgtgtgtgtgtgtgtatgtatgtatgtatgtgtgtatatgtgtgtgtgtgtgtgtgtgtgtgtatatatatatataccacgcctggctaatttttgtatttttagtagagacagggtttcaccatgttggccaggctgttcttgaactcttgacctcaggtgatccgcctgccccggcctcccaaagtgctgggattacaggcgcaagccatcatgccctgcctagtcatatattttcttgagtgaagtaagaatctgttcaatgattttgatcacttttctaatggactgtcattttcttatcactgtagatattccgtatacatgttaataccttcttggttatacatgctgcaattccgctaatattaaccacttccaaaaagtacctggtaattgtcaggaaagtgattaaatcaggaaaaaaaaacacataaaaaagagctggtaaagtgaaaataaaaacatgatatgcagagatatcaatgaaaccttttgatgacttgctttttttaaaagcactgagaatagacggcatgacttgctattatgtatgcactaaccaccacttttcttcactgaaaaaaaaattatttagaacatatgcaaccaatctttttacttcaatgaaaggatatctttagattattaagatgtgtgatacaatgtaaggacacaaaggactgcaagaaaatcttaaaaccttagcatatttgttgtcaatgatgttcttatgaatattattgaaatatctcatttacaagataaaacaaataggtaaatgtcatttaaaaaccaagattttcaacataaaagagttaaaatgtaagtttttaaaaacagtacaaatgatgtgtcaatggaggtttaccaattctaacaaatgtactactctgaaggaggatgctcatcctgggggcggctatgcatgcgtcagggcagggagttcataggttatcactgtgctttcaattttgcagtgaacctaaaactgctcttaaaaaaacaaaaacaaaaacagaaaaaacaggctaggcacggtggctcacgcctgtaatcctagcactttgggaggccgagacgggcggatcacaagatcaggagatcgagaccaccctggctaacacggtgaaacctcatctctactaaaaatacaaaaaaaaattagccaggtgggcatagtggcgggcgcctgtagtcccagctactcgggaggctgaggcaggagaacggcgtgaacccggaaggtggagcttgcagtgagctgagatcgcaccactgcactccagcctgggcgactgagcgagactccgtctcaaaaaaaaaaaaaaaaaaaaattcacaacacattcttcctaagatttgacagtcacattccctgagctgtgaagaaaatgcctgtaggtgatatcaataaaaatgtttcaatctaagaaaacactactttcctcatcagtaatttaaagcacaatttaaattacattcaccacagcaaaaacactaataataataatactaaatataaaaaaagcatcaagactaaggacgtttttaaaagcacttagtagcaaccaaaaatataaacaataatgaagcctctggcacaaccattaaactcccttgaaactggaagaaattcaaaagcagtcaatcagagaagccattgttatttaagaactcttgaatacaagtcaatctctgttattacagtcaaatatttcctataacagtaatgaatgggagactgctctagaggaaaaaccagagcaaaggctaatattccaaaagacacgggaggattcctacttatctacaacctaaaaaagtaacaacaggctgggcatggtggctcacgccgctgataatcacacatgaggcaggaggatcacttgaagccaggagttcgagactagcctgggcaaaagagtgagagtcccccatcattccaaaatttaaaaaattttgctgggcatggtggcgcatgcgtatgatcccagctactccgaaggatcacttgggtccaggaggtcgaagctgcaatgagtagtgatgacaccactgcactccaacctgggagacaaagtaaggccctctctcaaaacaaaacaaaaaaaacaagtaacaacaaaaattacttaagggtaagataaatataaatgaaaacactattttcctcattagtaatttaaaccacaatttaaattacattcaccacagaagaaacactaataataataatactatcaaaaattatgctgtggtgaatgtaaattgtgctttaaattactaataaggaaaatagtgttttctttttataaaatataaaaatataaatggattcagaaaccatttttgcagtgaaatcacacagattaaaggtcagtccgttgattgagcaaccctgaatacctaaaatgttcatgtcaaggccaacacataattctaaacccctgcctactaccaattacttaacagatatttatgcttgaattcagggatgtcgatttgaatatcagcattggcatttactactataacattaagccagttacttaacctgtgtcagcacttgccccagctacctcactcaaaactatacctgggtatatattatgtgccacgttagtgtttactgttctgccagtactctaacccactgtgactaatgacagattaacaaatgagcaggtcagagttaagagtattgtctatggctatttaaaactgtaaaactaactggcccaaagcataatccgattcactacagtagcccaaatagcaattcaggtatgataatttacagctggtaaatgtcacttaaaaaattaaaagaccagggatggtggctaatgtctgtaatccgagcactttgggaggctgaggcaggcggatcccttgaggtcaggagtttgagaccagcctggccatcatggtgaaaccgcatctccactaaaaatacaaagattagccgggtgtggtggcgcatgcctttaatcctagctactggggaggctgaggcaggagaatcacttgaacccaggaggcagaggttgcagtgagctgagattgcgccattgcactccagcctgggcaacacagtaagagtccatctcaaaaaaaaaaaaaaaaaaaaaaaagaataaaatatcttggagtacagctaaccagggaagtgaaagatctctacaataagaattacaaaacactctcaaagaaatcagagatgatacaaatggaaaaacagtccatgcccatggacaggaaaaatcaatattgttaaaacagctatactgcctgaaacaatttacagattcaatgctattcctatcaaactataaatggcattcttcacagaattagaaagatcttaaagtccataaggaaccaaaaaagcccaaatagccaaggcaatcctaagcaaaaagaacaaagcaggaagaatcacgttacctgatgtcaaagtatactaaaaggtgacagtaaccaaaacagcatggcactgatgcaaaaacaaacacaaagaccaatggaacagagtagagagcccaaaaataatgccacacacctacaaccagctgatctttgacaaagctgacagaaacaagcaatggggaatggacttcctagtccataagtggtgctagaattacttgctagccatatgcagaagactgaaaccgcaccccttccttacaccatatacaaaaatcaagatggattaagagttaaatgtacaacctaaaactataaaaaccctggaaaggctgggtgcagtggctcacgtctctaatcctaacactttgggggaccaaggcaggcagatcacttgaggttgggagttcgagaccagtctggccaacatggtgaaaccctgtctctactaaaaaaatacaaaaattagccaggtgtggtggcgcatgcctttaatcccagctactggggaggctgaggcaggagaatcactttaacccgggagatgaaggttgcagtgagccgagatggtgccactgcactccagcctgggtgacacagcaagactttgtctcaacaacaacaagaaaaaataaaagcctggaagataatctaggaaataccattctggacataggacctggcaaagatttcatgatgaaaatgtcaaaagcaattgcaacaaaaccaaaaactgacaaagggaacctaagaacttcctgaacagcaaaataaactatcaacagagtaaacaacctacaggatggcagaaatatttacaaacaaagcatctgacaaaggtataatatccagaatctacacagaacttaaacacatatacaagcaaaaaaccaccccattaaagagtgtgcaaaggacatgaatagacattttcaaaagaagacgtacatgcggccaataagcatataaaaacctgctcaacatcactaatcattagagaaatgcaaattgaaaccacgatgaaacaccatctcacaccagtcagaatggctactaaaaagtcacaaaattaacagatgttgtcaaggttgtggagaaaagggaatgcttatactctgcaggtgggagtgtaaattagttcagccattgtggaaatcagtatggcaattcctcaaggaaatttaaacagagttatcattcgacccagcaattccttattgtgtatacaccgaaaggaatataaactgttctactgtaaagacacacgcacgcacgtgtatgttcactgcgacactattcccaatgacaaaggcatggaagcaatgctcatcaacagtagactggataaagaaaccgtggtacacatataccatggaatactatgtagctataaaaaaagaacaagatcatgtccgctgcaggaacatggatggagctggaggccattcattacccttggcaaactaacacaggagcagaaaccaaatacctcatgttcccatgtataagtgggaagtaaacaatgagaacacaaagacacaaagaggggaacaacagacactggggcatacttgaggatggagggtggaagaacagagagaattagaaaaaacatctatagggcactatgcttattacctgggtgatgaaataatctatacaccaaatccccgtgacacacagtttacctacataacacatgtgcacatacatgtacccctgaacctaagataaaagtaaaaaaaaaaaaaaacagaaaacacacacacaaaaaccaaatgtaggctaaaattcaactgagatggccaggcgcgggggctcacgcctgtaatcccagcactttcgggggccaaggcgggtggatcacttgaggtcaggagttcaagaccagcctggccagcatgatgaaaccccaactctactaaaaatacaaaaaaattagccaagcgtggtggcaggcacctgtaatcccagctattcaggaggctgaggcaggagaatcgcttgaacccaggaggtggaggttgcagtgagccaagatcacaccactgcactccagcctgggcaacaagtgcaagactctgtctcaaaaaaaaaaaaaaaaaaaaaattcaaccgtatactctaacagcaaaaaagaggaaagccctgacgtaaaaaaggatagcatgacgacaagcacagcagtttaaggtgaaataaattaactatgtttgaggctgagaaagaaaacaagaatggtacattgaatcagactttgaagagccttgagatttgtgcaaaacttgtgactttgtttccccccccgccttttttttttttttttgagatggagtctcaccctgctgcccagactgaagtgcagcggcacaatctcagctcactgcaacctccacctcctgggttcaagcaactcttgtgtctcagtctcccaagtagctggaattacagatgtgcaccaacatgcccggctaatttttgtgttttttatttatttatttttaagtagagatgggatttggccatgttggccaggctggtctcaaactcctagcctcaagcaatccacctgccttggcctcccaaagtgctgggattacaggcgtgagccacagtgcctggcaagttttgactttgttacttgtaaggaaaaaattaacaaagtatttattagaagatttccccttatctcttatgaccagaaggagggaaagtaaactactaatctaaatatatcccaagtagtatcatataaaacactacgaagacaactgtataggggaaaaaaaaatcatatttctattacaatgtaaaattaaaatgtgtagtactcaaggcaaactagtaagaaagactgagctgtgatagtatttacaagatcctgagccaagctatcacgggatccacaaacatttatgaagttaaagttcactaaaagctccatacatttacaaagctggaatcaaattctagacaaagaaaattatttaaatacaaataaggatctcttatgtttttatgactaatcatctttttttgtcattttagtgctataagtttgtagctgtgtaaaaaattttcttcaatatactgatactgatttttcagaaaaaaccctagagaataagagctcacaatgcaaagtcacattactatacaagccaataactaaaatcctaatctacattctagtctagaacactccagaaccatgtctcaataccaagagtactttagaacacaattttaaatgcacttggggatcagcaggaatcctacaactgcacaatggttaacatatcagatcgtaaatggctagcgggttttttttgtttgtttgtttgtctatttttgtttttttgagacagagtctcactctgttgcccaggctggagtgcagtggcatgatcccagatcactgcaatctccacctcctaggttcaagccattatcctgcctcagcctccagagtagctaggagtacaggcatgtgccaccacacctggctaatttttttgtatttttagtaaagatggggttttcaccatgttagtcaggctggtctacaattcctgacctcaaatgatctgcccaccttggcctcccaaactgctagggttacaggtgtgagccaccacgccctgcgtggctgtttttaagaggccatgtctagagatttacttgactctgtaatttgggaaacaagctgttttttctcatacacacaaatacaactaagtgttcaacttcgctgaatgtattttaagtatactgataccctgtaaatctcagattccataactaaaaagagttaacgtacactattaccaatttttttttttttttttttttgagatggagtctctctgttgtgcaggctggagtgtagtggcatgatcccagctcactgcaacctccgcctcccaggttcaagccattctcctgcctcagcctccggagtagctgggagtacaggaatgtgccaccacacctggctaattttttttgtatttttagtagagacggggttttactatgttggtcaggctggtctcgaactcctgacctcaaatgatctgcccaccttggcctctcaaagtgctgggattataggagtgagccaccacacctggtctattactaatatttttcctttatttcttacatacataatgccagacacagctatttctctctttaggataccttgacagaataatccaaaccactgttacaaaatatatgttgttataaaatttacccttaaatttctatggaaaccaaatacacgatctttcaagtccatttaactgtctagttaagacgcttaatagtattctataagctaagtgtcccagaggaatgctacagatttgatttttcaggtatactttgtattttaatgaaagcagtctgtatgtctatacaggcctcttccttgatttaggttgctagaagcttttaacttcagtgttcaaaagaacaatattccctcagtgcttaaatgtatataacagtttgtatgagatttgtataatgaaggtcagtttggctggatgtaaaatatttgactgacattttctttccttgagtatgttaaatgtacttctctagtgtcttctggcctaacattttgctgcaaaaatacttaataacaatctggttatcccctaataagtcatgtggtctttccatctaagaattttaccactttatctaggctgcaatgtttattgggactttatgatagtttttatatattatttctaattccttcttattcttaaccttctccttgtttcatgggcaaaggaggagtagacattctatgagatcattaaaaggactttcctccagaataaagaacatgagcttgagtacatgaactttagtacgtgaacttggacattgtttgtatctgttcaaaaactttgggctcatttctcggttcttaattatgtttcagataaataaatgtataatatattgaattatgaactgaagaaacataactgatcttagaatgagaaagtcttagctgagtcaaagtagaattcagaaatcagaatccacttaagacatgagatttcttttaaaagaaaaaattaaaaaaagagaaaaagaaataagatttatatctaaaagaaaaaattcttagtaactaaaaaaatttaacaattaaaataactcagaaaacagctctctggctgtttaaaactaaaagccctaattatccacattccaacctcaaaatataactaaaaaattaagttccttccaaaggttaggacctatttcaggctcctgctgttcatggagtgcaagggtatatattatagcacatatccatgtctgactcataactgaagacatgttcccaggtgtatgttacgttctcttgtcaaaaaataataataataatacactgtaaataatctaaattctaaactactctaatgaaattcttaattattctaaaaaatgagaaagagaaaaaaggtcttagagacaaactgactacaaaaagaataagtaaaaggtctctatgtggaaaacaaaactgatttttgagcctcactcgaaagccccacctagttttataatccaagaataattcatgctttccagtttaatcaccatcaaaaagtctaactcatgcaccaacttgtacatactcctttgttaggcacccaacatagcaatttagacatacttagtagactctaggcttagaaggcttataatccatgccagacaaaaagagaattagataaatacatgtcctaaaaaagggggttagtttactgtacctacataactataactacatatatttggaagtctgcatctttttatagattttattcccctagaatgttctgggctatgggacgaatatgtctttatcagtcaactttaggtttaatgtctgcaaaataaaggtttcatcttgatttatataaggtattttcaaactacacaaatctctatttctatgaatgttgtatcatttgacagtaggaagaatgcccttgcttataggtttttactttttaaattttattttagattcagggagtacatgtgcaggtttgttatgtgtatatattacacaatggtggggtttgggcttccggtatacccatcaaccaaatagtgaccattatacccaataggtaattatcaagccacaccaccctcccaactttgccccttttggagtcctcagtgtctattgtttccatctttaagtccatgtgtgcccattgtttagttcccacttacaagaaagaacatgcagtagctgattttcagtttctaagttttttcacttaaaataatggcctccagcttcatccatgttgctgcaaaggaaatcatttcattctctatggctgctttattgatttcttgttgctgtattctgacggactgtgttcttcaacaaaggccgaaacagtatctccccaactacctgctcttctactatcccttctactctgatgttctactatcaagaaatggactctaatcatgaaactgaatgagcgtctgatgtgcttctaaccaaaaagaatatagtggatgagactgtgtgacttttgaggctaggtcataaaaggaacacagcttccactctggaaggtgtgtgttacctttgggaactctaagttgccaggtaggaagtatgactgctctgaggccaccatgctctgagaaagccaagccatatgcaaagggcatggataggtgctccataaggctgtcctagttgtttatctttctagcccaggggccagatgtaagctttcagttaattctagtccccagccatgaagccacatcaagcccttgagatgtctcagttgaggccccagataccgtgaagcaatgggcaagccatcccagctttgtcttttctaaattcttgatacataaaatcatgaacaaaattaaaaaggggtttaaggctaagtttgaggataatttattatacaacaataatcacaacggtctttattctgctcaccacaacagctatgcaaaacctcctcctcggttctgcaggtaagatgtgccttcaatctttaaaagactgatcaactagctccaaaaatcactcatttaattcctttgttgctggcctttcaactctactcaaaccttatctcttctgcctagaaatatgcccagatatgtcacactaaaataaatgctttttcttgcacaaatctgaccccactccctagaagctacaatcatttcattgctaaatttcaccgaataatctgctatgctttgctaatatatcctcaccttgacatctgcctgactcatcactggccccacacatgagtctctagagaattccccacaggtagttcactgttcctgtcagcttttaccttcctgaaactgaaatttagcttaaactaaatgctattattaaatccttccgtcttgaaaactctttttttatacctcagaccatatagccttggaaagaccaccaccatctcagtgtgttaccaacacaggcaaaattactattgtccaagggaaggattttggtgtgggtgtctgaccagacgttcaggtttaaagtctcatggtgaatatgcgtggtgtagtaagcagagctgaagaggccattgacaggatcaatcaaaggttttttaaaaaaataggtaaaactcattcattataatagaattacagaagcaagtaagtcacaagaaaaataaacataaaagggacaaaggtgagtaaattataaccaagataggattgctggtgggaatatacagtgacacagccatctggggaaataatctgacagctccttaagtgattaccatatgacccagcacttccactcctagatacataccaaagaaatgaaaacaaatgtacactttaactcatatacaaatgttcacagcagcatattctcaatagccaaaagtgataacaacccaaatgtatatgaactgctgtgatacatccagaaaatgaaatattaatcatgaaatgaatgaataaaatacatggtataacaagaatgaatctttaaaacattataagtaaaagaagccaaacacaaaaagtgatgtattgtgtttgtttatatgaaaatgtccagaatagagacaaaaagtagcttagtgattgctaagggttgtagaggggaggagaatagggactggctgtcaatggacagtcatttcttctggagaatgatgaaaatgttctggaattttaaagtggtgagttgcaaaattatgtgaatatactgaaaaccacacaattgtaccctttaaagcagagaatgttatgtttgcaaattatatctcaattttttaaaatgtatgagggaaaaaatagcatgttttcaattactgcttcctagtcaacataaaccagacaaaaaatccccaacaaaatctggaactccattacttcatttcactcttttcaattccaggttaaaacaggatccaaaacaaagaggaaaaaattttaacaattctactgaatccagaacatcaatgttaaggagtgaaatctgaataaagaactctaagaatacagtccatttttaaattagcaccaaatgggaaataaaagagaaaagatattactcgtaacaggttctgtttgtaaatgtttttagaatactaccttagatcccaaataagaatcaaacatgcctgggcccttaaagagaattggtggatagccccaactaacaaaaagacttgcaagagtgttccagcttttagctgggagcataaaaggaaaaaaacccttatgctacagtgagcctaaagggggtggagggaggaagggacagagaatgagctaagaagaagccaccatgttaattgtcgacactttctaaacccagactccagccctttcctcagctgctgccaaggggctcagtacttctgggaaagctacagtcacactggggagaggccctcacttcatccagcaacttgcactgcatccaacagcagcaccagccccgccactcgcccgcaccacagcccctgaattcgcctgcatctactccaccctcattcttcactatgaacgaggtgaccgtcacagaggataaatcaaggccctaattaaagtaggtggtgtaaatgttgaaccttttcggcctggtttgttggcaaaggccctggcctatggtgacatcgagagactcatcctaatgtaggggttggtggacctgctccagcagctgctgctgcatcaacagtaggtcctgccctgtccagagcagctgctccagctgaggagaaggaagtgtaagcaaagaaaaaagaatctcggccggatgcagtggctcacacctgtaatcccagcactttgggaggctgaggtgggcagatcacttgaagccaggagttctagaccagcctggccaaaatggcaaagcacagtctccaccaaaaatacaaaaattagatgggtgggctggcggatgcctgtaatcccagctgctcaggaggctgaggcacaagaatcacttgaacctgggaggcggaggttgcagtgactgggtgacagagccagactcggtctccgaaaagaaaaagataaagaaaaggaaaaacaaagaagaatctgaggagtgtgatgatggcatgggctttggtctttttgactagaagttcttttataactctttttacaaatttttaaaaaattaaactggactccagggaccagtgggtgaggccactggctataggggtggtgggcacgctgtggcgtgatggcatggggctgttgcagacatatgaactggtctctcaccactgccatgccacacaactgtgctctggcactgagtacagtggggacagccttgtggcagaacgccacagcattctcttagtgggtaatggcagcaccagcaggagcaggccaggagcaggaaggaggatcacaacagatcacacatggggactccggtctggatcctgcgctccctctggcgacttccagatccaaaagggcagattatgcaggggctgacaagtgaggacaagagccactgacatctggaatgactgcaagtatgactgcccatctatattcaaacaatataaactttgggttacacaactgaatgtgttcaggaatgtgtcattcagaataacaccacggctgccatctcagtccactctaggtcaaaatgaacacatatcttggttgctctcctacctccttgactgctatgtctgtttcttgtacgtgttccttttcctcttgcattccattaaatttctcaaaggcttgtcattgaacagcctctctgcatcctttttttgtttgtttttttaaaccacttaccattatatgatctgttttacctatcaaatctataatatctgtgtaaggtttgggaacagtccaccaactgccttcccttctgacatgaatcacagagtttgggggtcccaaagaccatcctcacgttcaataatgtgccacactgttagactatcaggtgtggcccaaggcacccagatctctatgcccttggaaggctccaaggacaaaggctagatatctctttaggcaaggttaaattctttactaaaccacctgcttgctgatacttctgattctccgattcatatttctaaccaccttcttgatatttccatcaacagtcaaactcatcaacatcttccccaatccaactgcgacttcactgtttctactaataatgccaacattatttcaccttgtttaaaaagctatttttaattagtaagccataattgtatgtatggggtatgatgtgatgttttaatatatgttacactatttttttctataaggaattgaggcagcttataaaaccacaatataagatacaaaattagaaagaaattggggcacagaaaaaatagcccagaaaaagtaaaacagaataatgctacagtgaagttaggatacagaatgcatgctataaattactgttcacttgttagaggtgggctgcacatttggctcagagctttttcatagccaaacgatatccaatgcaaaaaagaaatgacaaccaccctgagacacatagggagaccccgtctctatcaacatttttaaaatccgccaggcatggtgactcatgcccacaatcctagcactttgggaggcagaaacaggaggagattccttgagctcaggagttcaagaacagcctgggtaacatagtgaatcctgtctctacaaaaaaatttaaacatcagccaggcatggtgatgcagacctgtagtcccagctactcaggaggatagcttgagcctgggaggttgtagtagtagtgagctgtgatcacaccactgccttccagcctacgcaatagaatgagacactctatctctatggggaaggggaagaaaagcagtttcataattcagagtacactaaaataaatgatgcccagaaggtactattcttctgattattccaggacttagaagtgtgtggggttttctggtcactgccctccatactcaacagattgttgaataataaagacggtacctccataacattgtttgcttttgtcttctccttgtatcttctctctctttaatgtcaatcaactaagatttcaaattaagcttccttaaatatagcacttccctctttaaaacctacactggttctttttatccttttgtaaaaaaaaacaaaaaaaacttttttttttttaaatagagacaaagtcttaatatgttgcccaggctgtcttgaactcctgagctcaaatgatcttctgccttggcctcccagagtgctaggattacaggtgtaagccaccatgcctggtccacttattccttttaaaagctccacttctgcttctgcttttttttttttttttaatttccataagttttgggggaacaggtggtgtttggttacatgagtaagttctttagtggtgatttgtgagattttggtgcacccatcaccgatagagtatacactgaacccagtctgtagtcttttgtccctcatccctttcctaccctttccccctgagtccccaaagtctacagtgtcattcttatgcctttgcatcctcatagcttagctcccacttatgagtgagagaacataggatgtctggtcttccattcctgagttacttcaattagaataatagagtctccaatcctatccaggttgctccaaaattcattactttttatggttgagaagtactccacacacaccacagtttctttatccactcatttattgagggacatttgggttggttccacatttttgcaattgtgaattgtgctgctataaacatgcatgagcaagtaacttttttatataacgacttattttcctctaggtagatactcagttagtgggattgctggatcaatggtagttctacttttagttctttacggaatctccacactggtttccatagtggctgtactactgtacattcccaccagcagtgtagaagtgttcccttttcactgcatccatgctaacatctattattttttgattttttgattatggacattcttgcaggagtaaagtggtattgcattgtgattttgatttgcatttccctgatcattagtgatgttgagcattttttcatagtctattggccatctgtatatcttctttggagaactgtctattcatgtccttagcccactttttcatgggatttttttttccttgctaatttgagttcattgtagtttctggatattagtcctttgtcggatgtatagattgtgaagattttctcctacgctttcggttgtctgtttactctgctgactcttccttttgctgtgtaaaagctctttagtttaattaagttccaggtatttaactttgttttgatcacatttgcatttaggttcttgatcatgaaatccttgcctaagccaatgtctagaaggatttttccgatgttaccttctaataatgtttatagtttcaggtcttagatttaagtccttgatccatcttgagttgatttttgtttaaggtatgaaatgaggatccagtttcattctcttacagatggcttgccagttttcccagcaccatttgttgaatagggtgtctgttcccttttttgtttgctttgtcaaagatcagttggctgtaagtatttgggtttatttctcagttctctattctgttccactggtctatgtgcctatttttataccagtaccatgctgttttggtgactgtgctcttacagtacagtttgaaatcaggtaatgtgatgccttcaaattttctctttttgcttagtcttgctttgactatgcagactctttttcggttccatgtgaattttaggatggttttttctagttctgtgaagaatgacggtagtactttgatgggaattgcaccgaatttgtagactgctttcggcagtatggtcattttcgcaatactgattctacccacctatgagcatgggatgtgtttccatttgtttgtgtcgtctatgatttctttcagcagtaaaagcacatattcttctgtatttacaaagaaatatatgctcaatgcagaaaacaaagaaaaccaatacaaagaggtaaagaagacaaaaaccaaaaccctacaatccagatgtaactagctactatcaatgttttttaaaattcagatatttacatgcaatgaaagtcaaaggttttatgtgtacgattccctgctttttgacaaatacatatactctaatcaatatacagaacatttttccaaaatctcactcttgaagttccctcccagtcacattctttgtcaggtaaatgtattgcaaagagcttctcccagtctgaagctggtcttttcatttttaaaaatgtcttttaatcaggaacagtttttaattttgattaagtctaattaattttttattttatagttaatgtttcttatatgctctctaataaatccttccctactcccaaggttgtgaagatattctcttactttttgctagaaactttacagttttaactttatatttaaatatatgatccatctcaacctgataaaggtatctaaaaaaaaactacatattcactgtaagattagaaacaagacaagggagatgtctattcttaccacttctattcaacctcatgcataaaagaatgaggcaaaaaagaataataatttataaagaatcataaggaagaagaaaaacctccatttgccctgaaatgatgaaatgattgtgtgtagagaaaacctagagaaatttacacatgcacaaacactaataaataagcaaacagcatagttacaggccacgtggttggtgcataagaatcagttacatttctataacccatcaaaaccacaccaaaaactacaaaacatttctgagaacaataaagacctaaataaacagacacaataccatgttaatgggttggaagattcaatattattaaggcgtatctaaaatttatatgtataagctgactctgaatttatacaaaatgcaaaggatcgagacaggtcaaaacaatcctggaagagaagcacaaagctggaagactgacactacccattcaaggcatgctatacaaagctatagtaaccagacctttagagcaagcattgaccaaaagagggatggagcagatggagtccacaaacaaacccccatacattctgtctactgatggacaaaggcaagcaactgaataggtgggggaacaagtcttctcgataaatggtgctgcagcaacaagataaaagtatatttcaaaaaaacacctcaggcctaccacatactgctgacattttggcactgctcttttgctaaatatatttttattttttgtttttatttttttgagacagagtctcgttctatcgcccaggctggagtgcagtggcgcaatctcaactcattgcaacctccgcctcccacgttgaagtgattctcctgcctccgcctcccgaggagctgggactacaggcgcgtgccaccgtgcccggctaattttttgtatctttagtagagacagggcttcgatatgttggccaggatggcctcaatctcctgacctcgtgatctgcccacctcggcctcccaaagtgctgggattacaggcgtgggccaccatgcccggcctgctaaatatgttttgtaaaaagaggagagattataacaccaggattctgtttctactctgctttctttcggttttctgtggggatttttggtaatattttgaagtgatgctttaaagttacttcaccacaaatttctcacactcatctctatcctctacatgatgctcccaaactgcttttaaacctaatcttctaccatcaatttttagtttccccatttgttaggaaaacacaagcagttagggcttcttacaccttgttctgcctccaggatttagtctgagtagtgccccatactctcaacatcatccaaatattctttactgacaaagtccctttcagttttttataacatcttttctgagtcctctattcaaatataacattcttccttttagccctcacatatcttcccttttctcacttattattaacgaaccacacttagatgaaaaaaaagatatttgagcagtctattcattcagtcactattcagcaggccacagattgttctactggggtgccagggaagctagacaggtcaaggctctgcccttaagtagctggcattctagtggcaaagtctaagaggccataatctagaaagtagggctgtttctcatttacctctatgtgccctgtagtaaagtacaacgttttgcacatcatcaagcctcaatgaataaaccatgaactcacctgtcatgctatttaaagcttgtatcataaatatccttgtcaatttaaagcaccaacagatcaggagtcagaatctccttggtctccataaaagaaatgtaatgaggccttatgtaataggttcaagagcatctattgctttgttcacatagataggcagggtttctttttaaggcttgaattaagccaaattaagccaactaataaatgaaaagcatagtgaattaagtatctgtgcagcattaatgattttaagtaaaagaactgtgaataaagaaaggttatctttctatcaaaaggaacagaaagtaaagaccacacgtctataaaatacttcagccacacaacaccattttaatagacaaaaacaggcatttctatggcagagattttccatctgggcactgctgacattaggagctgagtaatttctgttatgggtaactgtcctgtgcgctgtggaacctttagcagcatccctggctctgcccaagagatgccagtagcagcccgtcacggcaagcaaatgtctccaaacattcacaaatggactcccaggggtcaaaaccgcacccagcgaagaacctctgatgtaacacagccaacattacttggctgtacaaatatttcttttgtttgttattctttttactgtacaaatatcaattctaaagcagctttaaggttctttgcttttttttccttaaaaaacaacacagattgggcacagtggctcacacctgtaatccctgcactttgggaggctgagacaggcggatcacttgaggtcaggagttcgagaccagcatggccaacatggtgaaacctcatctctactaaaaatacaaaaatcagctgagcatggtggtgcatgcctgtaatccaagctactcgggaggctgaggcaggagaattgtttgtacccgggaggtagaggcagtgagtggagattgcagcattgcactccagcctgggtgacaagagtgaaactccatctcataaaaaataaaataaaataaatcaaagtcatagactcggagggttggggggcagggagggaaggagaaagggaggagggatgccaatgacagcaaatagccaccaacagtaaattttgtgagttattaaaattcaaccagtctaccgttttcacagatggaaaatagacacacatgggtaaaggcaatttgtgtataggaagaaactcatctgacatgcttctagtgtgtatacttataatattttatgctctattttgaagaaaataatgtccctaagtttttacaggtaagaaatatatgtcactcaaatgtgtgtgacaggttaagtattccggagaactatggatgattttaagaaaacgtgaggcagaaacaaaggccctatattctgatctgccagtcagcatgccagcctgctcatgccgacatgccttccccagatccacctgaacatcagcactctgcctatcccgtacttgcaacccaacactagagaaaatgcctttatccaaacaaaatacgtactgcattatggatggttcaaatgcagtggagttaacaaactacagggccttgaccaaagggaacctttcagactagagagggggagatacatgaacacagaaataaatgtacaattccacactatgataagttggggatgcgggggacaataccgtgggtaataaaggaaagggtctgattagaggtcgaataaatgcatttctaaggaaatgacatgttttcataccaagtcagaccacagctgttgatgtctccagaaataattcaagagatgaaaactgtacaaaggtgccaacttatctaagaatgatttaagagagcaacaaaactcatgtctgaggacagctactacaggcagcctgatattgcaaggcaatgttcctacagtcaccatttagtatgtccttgtagcaggtatacaccgagggttctggaaaaagttaggaacataaggtagttcaaagcaatgattccgcttatattgcacgtatagtatgaagggtgccttcatgtggttatatccttggagttttagaaggatgatacatgcagaccttagaatggagcagattttagtgttcaatgtgcagaaaaatcactgatgaatttgttaaatatttggattcctaagtcccactctcaaggattccaattcaggggtttacagtgcagcctaggaatgtttaccaggcaccccctactgcctctgaaaaccccacatgaaacacaaatcttcccacaaaaggaggtttggctgtgacacaggttttttttgctcaaactcatgaaacaagcatgtatgacacaaggcctcccgacagtgtttgtttacaggctgaccctgcccctgatcttggtaatccccagggcttggaagcagaatctgaataaactgcacagcctactgctacagcttgtgcccagacaacagaccagaggtgatatgtaaaaaagataggcagtgctgacagctctctctccagaggttaaggaaacacacccaacatgagacacggtcagggagttaagggagccagcactgatgggtatagacagcatgaagtacagatgagaacacaatgaaagaagaatgatagaacagacagaagaagagtgaaactcatatttcttatgagcctcgtatcagatactgtgtcatgaacttcatatatttcatttaaatcctcataaaaatcttaggtattaacattaatataatataaattatcatatcatagatgaaaaaccaaagcctaaagagaaaggaatttgtccaagaagacggagctacaaagcaacacagccaggttttgaaccaaggctcaggaatcagtcaataatgccataatcctcttggagatctaagataacgcgagtaggaacatggctgtcaggaaatgaagagtcctactccagagagaataccaaggcaagtaagtacacaagagcaatgaacaatgcttttgcaatatcagaactttaaatatggaccctcttattaaaacagctgagggttcatacattttaaataagggaaacttgtaaagatgaggtaaaaagttaagatgtaatctagctgatcataaatgatgaaggcttgctgcagctcttgctgagtagtgggatcacaggtgacttctgccctccaacccaagtgtctacatttcctgtgatgaacaaattttatttttaaaaagaaatacatgtgatgtcttttgttgttaatttttttttaattgtattttgaggaaactgagaagtaattgagggcagagactctccaggaatgaagtcaataaaagcaagagaaagaggtgaagtatcagaagaaaaatgatacctcagattacataacacacactaccagcctgggaaagctctctccccttcccatcctggaccattaaatcccaagccatgaggcagggccaatcaacaaaggatgtcagagcatgagttaggtgagaagggaagggagagacatagtgatggtgactggtgattcataccatacagggaaatcaatcaactaagtcaacgcaatgaggatgggaagagcccagactcttactatcagagaaagaaaccacaaagatggaaagggagaacaccaggctgaatcttctggtattagaggtatcagattaataaactcatggatttcaaaacatatgtaaatatataaataaatataaacataaaggaagcaggtgcatatgtttgtgttcctagctctgtactgagatctgaaagtgacaagccaaaagtaataagcacacctaatgcccaggtctagctttctaaatattattgtttaatttaaaaaaaaaaaaaaaaaaagcaggattctctgtgaaaagagtagactccagggctgggataggaaaaacacaagatgaacctggcatatcctactgtacttgaaggtaaagaaatgatcaaaggaccgggcatggtggttcacaccggtaatcccaatactttgggaggctgaggcaggagaattacttgaggtcaggagttcaagaccagcctggccaacatggtgaaaccccatctctactaaaaatacaaaggttaaccaggcgtggtggcatgagcctgtagtctcagctactcaggaggctggcacgagaattgcttgaacccaggaggtggaggttgcagtgaaacagagatcacaccactgcactacagcctgggtgacagagcgagactccatctcaaaacaaaacaaaaaaataaacgatcaaagaacgattgaggcatttcaaaaggacacagaaccaatctgaaggggctcctaagaacaaaatttgggataatctaagcatcaaaacatataaggagagtaagtgatcataacccactgaataaaacagagatccatgaatttatcagtccacccgagacagaaagtcagcccggggtggcggcgggggtagggataaatatttgaatgggttatatatgtagtctcaaagtaactctcaacaaaatacttattactaggggaaaagaacagctgtcagggatatctggcagacacaatcttgatcaagtgaaggcatcaactccaatggaataaatcaaacctgtgtaccatctgaaaggatttaatgcaaaaagacaacatcactactgtggcatcccaaattgagaaacattatataaaataaccggtttacaatcttcaaaaatgtcaaggacatgaaagccaggaaaacactgagaactgttccaaattaaaagaaattacaaaaacaagaaaacagaatatgcgcttctgccacagattcattacacataatggacaacactgggcaactggcagtacctgataagcccgaggtctgaatagtagtgaagtatcagtgttaaatttctgatcttgatggttgtattttgatatataggagaatgtacttgattgtaggtaaaatgtactaaagtattcagggatgataaaacaccatattagtaattttagctcaaccagtcctggcagagggtgaggggatttatctctttatccaagaacaaaaaatgagaaggccacaggtcttattccagacattccaaatcaattccttggactccctgaatatgtatatgtcagtaatcttatacaaactgttgtggaatataccacaaaattcaaagtagggcatctgtcacatgtaatgctaactaaaggtacaagttacttaccaaatttggggggggctggcacgggtataaggagggaaccttactatctctaatgaccttactgatgctgactttaatactctgtgaaggttagagttcagtgaatgttacctagaaacagccccggctgtggaatactttattcttagccctatatttggggtttggatgtccactgtgctggttcccagagatagtaaggggatgagagtattggttacatctcctgacccacatacttaagatccagatgaacaagacagttttcactcctgcttggtagaacctatttgctgaaggaaacagctcctaaagaatggttctagccagaccctgtcgctaccagaagaaaaaaaaaaaaaacttttcattaaccaggggtggtgacacatgcctgcagttccaactgctcaggaggctgaggtgggaggactgctcaagcccaagactcaggaggctgagatgggaggattgctcaagcccaggactcaggaggctgagatgggaggattgctcaggcccaggaggttgaggctgcagtgagctgtgatcacgccattgcactccagcctgggcaacagaacaagactgtctcagaaaaagaaaaaacaagaaaagaaaaaagaatggcacctacagatgaacctaatgctgggcctcagcagaaaaatcgaagacagtataagaaatgaagagtaagagggaggatggaaaacaccttcttgtcacctttcaaactggctctatcttttcttttactagactgcatagatctttggggttgtaaccactattcagacaaatgctaagtaagatctacactcttttctaaggaacacactgattctatgtggaagtacgtgcacctatgaaagaatcaggttagagtagattagttcctacacttttgtagtacagtaactttctcttcctcttagcaggtaattaaatgtacactgtttctgaaccaacatacaaatgatctatatctactagataaatgatgaattattaagacatatggaacccaaaattcattaatgctttatgttctgaacatgtctgcattttctgccatttattctaatgctatatagaatctgatttacaatttttaaaatctgtagcaaataaattcatctcaccaactttggctcaggagctccaaattccagaaaattaatgtccaaatcagtaagttaagtgacaaagaagcagctgaatagtcatttctctttctcctagattctcagttgggtccacacaaagcatggtgtctagatcatattgttcttaatattcatcacacaacacgcttgccctttaggagtttaactcttggtctttacaaagcatcaatacaagaacactccacttgaatagtttctgtgtcttccgtgaaatcatagctgaaaacataacccactatgtcacacaatggcagaaccccacagaatgtctttttcgttaagtacaatgccaggaaagaatctttctctgtaaacaaatgtgcatgcttgcttcccacagacaataaacgctatgtaattcaatgctacacaaagaaaggaatggttttcttttagccttagcagtcagaaaacagaaagtcaaatacagtgcacaagagttataattagctcccctcaggagcctggtacactttctcctctctatgttcttttattattttaatgtttttattgtactttattttttggaggcaggatctggttctgccgcccaggctggactgcagtagcacgatctcagctcactgaaacctctgcctcctgggctcaagtgttcctcccaccttagcgccccaagtgcctggaactacaggcacttaccaccatgcccagctaattttttgcactttttgtagagacagtgtctcaccacattgcccaggctggtcttgaattcctgaactcaagcgatctgcccacctcgacctcctaaagtgctgggattacaggcttcagccaccgcactggcccagtgctccttttagatggtttattatgtcctctaactgtcctgctgtatactacctttaattctaacagatttaagtccttctgaaagtacctagaatatgtatgtacaaatacatgtattttgtcttacaattctctctcatatcacttaatattttctgatatcagtctctatacaatgacctaagaatttaaaatgataatgacacaaggaggctaatttaatgaagaccaagcaatttgcatcactacctcctccccttgtccattcccccaacaaattactacacagcccaatggggaaggcaagccccacaccaccatgcttggcacatcacctttgcagtagtccgcagggtcctcttgctcctcatcatctgatcccaggatctcctcctctggctccgggggtgtggggtctggcaaaggtggcggtggtggtggtggtggcggtggaggaggaggaactaaaggagctttctgttgaggctccggcctgaaagagcagagagaaaattgctatttacttagaagtacatcttgcattatggatgcatttgagcacttcttaatatgggggaaaaaataaaacttgtcacatactaagaagaaatgtcatttaatgtcacttcacccattttagttgaattcaagtagtgtttcaacatataagtcaggccaaaaaaaaaaaaaatctgcccttattagctaaggaatttttttctgtaggtatcttttcacttagcgcttcaagaactaccaatgttaggaaatttcagtgcgctccactcaactcctaccaattctgggaaatttaagtgaaatgaaagcgtattccatggtatatagccttattggttagaaaacatcacaacgattataaaaagacaggcgcaagcagcactcaacttttgaaagcacttatttcctgttatctgaaaatgagaattcttttcccatagaaataggtggcaatgaggttaggtttcaataactcataaaagctgattaacatacactgtagctaaaatatacaagattgccagaaagattcttgtacttctataaggcctgttcgaagttttgaatgtattctggaagcggtgtgtgtgtgtgtgtttgattgattgagattattccctttcagggctctatgaggagaatggttcataatgggattcacttactattcctaaccatgccccagtgcggggaaataggaccctacagtctcaatctggatgccggaagcacatctctcccttaagctatcccactaataaaactaccactgaatgcgtgcgctgaagatgacggctgctgtggaaaggttgctctgagggtcagttgcccgacatgtgagtgccattccttggggcatttctgcaacggcagccctcaggcctgctgcgtctagaagaacaagcttgacaaacatattgtggtctggttctggtcaagcaaaattctttagcaccagttcctcacaccatgcacctgctgtcacccagcatgcgccctattttaagggtatagccgttgtcaatgaagagttcaaagacctaagccctagttgttgagagcaggtggaatcttggtgttattgctagatttccttttggaacactgttgctctctgcccagtggaaggccgattctggatcctttctctcctcactgcagcacagcctgcggcatacagtcaaagctcactcttcagccctggaatcttgagaaggtcagggtcttagcaatgcaagctcatctgtagctgccactaagagacaggccaaaggagctgcctcaaccactgcctcttctaaactgggcctctaaatccttgcccaatctgagagcctccaacaccaccactaatgcatgtggcttgccaacaaaaaaacccatacggccacaactgaaggaaggagtaggaatagaaggcagcagaaacacctgacatcatgaggaaggggtggggatcacacacaataggtcaacttaaaggcaaataatcaaaggtatgaatatctttagcaggacaactaaagaatatttataagctgaaaatgtactgattgctgctttctggaatttatgaagactcaacagttacagctccctgggtaacagacatcaggattgtagtgatgataacactccaagttaaccattctcttcacagagccctgaaagagaataatattcattctctctctctctctctctctcacacacacacacacacacacacacacacacacacacacacacacacacacaccacttccagaatacattcaaaacttccaacaggccttacagaagtacaagaatctttctggaagccatgtaaatgctcgcttctttttaacacatgtgcccttactgaaagtggaatggtcccaggcaaaagagagttctgaaggaggagaggcaagtaaggaacttcagtagtttgccacttccccagcgggaggaaaaggtttgagatgacgtccaaaagaagcacaacccactcttcaggggtgtgggcagaatcaatttgtctgacacatttcctcaatgagaaatactttgaaagctagctgtttcttcctaactcagaaactttatataaaaaatgagtacattctctgaaaacacacacacacacacacattgagtttgctgtagaaactacttgaagaaaagacaagaaatgatggctcttgtgctgccagtgcacggcactactgtacttagcacaatggattcttggactggataattcattgctgtggggctgtcgtgtgcactgtgggatgcttttcaccatcgctgccctccagccactatatgtcagtagcacacagccccccacccccaccccaccacccagctgtggccatcaaaaatgcgtgtagacactgacaaatgtgtgtgtgctgggggaggaggggagtcatgcccattgagaaccagtgcactagtagcattttctatatatggctttacctcaatggagtagactgcagtatggagaagagattctaattttcaccaccattttctctcacttgagagattcccgcaccttcattataatgtctctctcacttactctttacctacctgctgagctgcctacatggatgaccctcaaaattctcagaccctgcagtctaagtgtgtaggcacttctcattcctccagtgagggccacactgaacaggcagacagaaagcttcttaaaagccagctctaccaaatgaaaagtggtaagtcaggataccccaaagtatagaggaggtttagtaatgctgattaatagttcaactggctgtcatatcaaaacatctagaactgtgctgcccaatacagtagccaccagccacgtggggttatcgggcacatgaagtagctagttcaaactgagatgtgccagaagtataaaatacatgttagattgccaagactcagtacccaaaaaagtaaaaatattatattaataattttctacttgctcaatattaaaatgttttatacacgagtatttctagtggatggtagaactctggacctttcagatccaacctgtactgaggggcatttcagcctcacgttgagagattcctggccataagtgatgattatctttcctaggacttctaatgacctacttcatactaattatcaccaatactcaaatcactcagttcatcacagaaagtctcagttcaatgtaaccgccaattctttttcatccctccatccttgttactgtctaccacataggaaaatcaaggtaaatttctcctagggcagaaatagagaagagaaagccaagccatactgtcttagggctggattattttattttcattttgagacagggtctcgctctgttgcccagggtggagtgcagtggtgcatccacagctcactgcaatcttgaactcctgggctcaaagaatcctcctgcctcagcctggtgggtagctaggactacaggtgtgtgccactgggcctggccaaggctggcttctttaaagtggtttctgatggcttctagagtactgcaaagcctggttaaattacaacactgtagaagaccaagacatgacaggttatctcaccaaatacatactcattaagtctatcaacagattaaaaaaaacaactttcatcaatcctaatgaaagccgtaaggaagctatttcatataaaaattatcagaagtatataagcagcaatggcagtggaaatgacccataaatattttcaacaacaataccaaaataattaaatggtaaaagaatagtcttttcaacagtggtactacaacaaatacatactcatatgcaaaataaataaagttggacctctctctcacacacaggctttacatgaaagagctaaaactataaaactctcaggaaaaaaacataggagtaaatcttcacgaccttaggttaggcaatgtttcttaaatgtgacattaaaagcataagcaatacaagaaaaactaaattggacttcaaaatttttaacttttgtacttcaaagggcaccatcaagaaaatttaaaggccacagaatggggggaagtacttgtaaatcataagtgataagtgataagtgacttgtatctagaatatataaagaactcttccaactcaacaataaaaagacacactaatttaacaatggataaaaaggattggaaagacatttctacaaagaggatatacacatgaccaataaatatatgaaaagatgctcaacatcattagtaatcagagaaatggaaatcaaaactacagtctgacaccacttcatacccactagaatggctattaaaagaagtcagataataagtttaaggaaggatgaagaaataaggatcttcaaacattgttggtgggaagggtaatatagcatagccatcttggaaaacggtctggcagttcctcaaaagtttaaacataaaattaccaaataacccaacaattccactcccaagtatatacccaagagaaatgaaagcatatatccagcaaaatctcatccacagtgttcagagaagtactactatttttaacgaaaagcagaaacaacccaaacgtcccctaactgataaataaaatggggtatatcattacaagggaatgttattcactaacaaagagaaatgaagtactgatatatgctacaacatggatggatcctccaaaaccttatgctgggtgacagatgccagtcagaaaagaccgcaggttgtatgatcttccattttccatcaaatgtctagaacagataaatttatagagatggggtaaatcagtggatgctcatatcgggggttggggaaatggagaaaaaaggaggaaaatggggactgactgctagtagatatgggatatctgttaggagggatgaaaatgtcctaatgtggtgatggttgtacaattctgtgaacataataaaaaacactaaaatatatatgttacatgagcaaactgtatgctatgtgaattatacttcaaaaagctattgttaaaaaataaaagaagccaggtgtggtggtgcacacctgtagtcccagccatttgggacactgaggcaggaggatcgcttgagcccaggagtttgaggccagcctgggcaacacagcaagacctcatctctacaaaaacaacaataaatttttaaaaaaataaaagaaaaccccaatacagctatagatattttaaatatccaacactacaccgttataaaatgtatgacttcaagaaacaaatatctatgtagagatttaagcaatcaatatgcatagtctcttttacaataagctcagctacattcagagtgaaaattaatctgtaattctttaaaaaggagactgaaattttatctaagggtccaaagtttaaacaaggtgctaatttaagaacatgttttcatgtactataagaaatataaagaaatataccacttcaggccgggtgcagtggcccccacaggtgatcccagcactttggggaggccacagtgggtatatcagttgagcccaggagtctgagaccagcctgggcaacctggcaatacccacaaaaactacaaaaattagctgggcgtggtggcacacatctacagtcccagctactaaggaggctgatgtgagaggactgcttgagcatgcgagtctgcaatgagctaagatcatagcactgcactccagcctgcatgacagagtgagaccctgtctcaggaaaaaaagaaagaagaaaatagaaaaggaaaaaggaaaggggaaagggaagggaaggggaaaggaaaaaggaaaggggaaagaaaaggggaaggggaaaggacaatggagaaaggggaaagcaaaggaaaaggaaaggagaaagaaaaaagaaaaaggaaagagaaaggaaaacaaaagagcaaagcaaagcaaaagagaaaaagaggggaggagagaaaaaagaaaaacacagcacttcagtgatgggaatgaaattaatttagaaagcaaaattccactagctacttatatttttcacaaagaactatatttatttttacactacaaagaaaattctaatcattactctaaatttaaaatgtggtttaaaaaaacttaaaaatatttttctttcaatatcatactataatactaaaattatcatcatgctatgtacttcatactatattctgcatgtacacttgctctgtcagaaaagggaggaaaaactcaacaaccgaggaaactacaagtctcatctgctctaaattgccatggcaaccagatgagagttccgatttcctctcagctgctactgcgtatttcttttcagcagagaaaagaaaaaataaactctacatttagtaggaaaaatgtcctctcctttgctatcagcttagatggcaactgacacaatttaagaaatacagttcagttaatttttaatcaaacataaagaaaaggagctccagatgaatttcttcagttagtatttgagggacattcacataaagtcaaatttcattttctttcctccctatgtccaccctatatctataacttttctctctcccttcctccctccctccttcttcctctcttggtaattactgtcagcttgagaaatacccaatttctaattaatagtagaatcggtcaatataggttgagtatccctcattcaaaatacttgggaccagataatgtttcgaacttcagataatttcatgtattcctctttaatgaaaggttaagttcaaaaactttgtgtaaatcaaacctaaatgtgcaatgaccctcaatgaccctcatccatgttaaatctcctgcttctcttgagtatgggtagatctgtgagtgtgagatattacacctgttatccaattatctacactacatgccaaagggagatcacactgggtggcctgacctaatcacaccagtccctaaaagcagagggttttctttggctggtcaaagaagtggaagcggagcggcgggctccagctgcctggaaaaaaagcagacatcatttgtgaactagggccacagagagcaaagaactgccagtggcctctaggagtgacggtgctccctgccaacagctagaagaatagtaagataacaaagacctcagttctacgaactcaaggaaatgagttctgccaacaaccagtgagctggaaaagaactctgaagctcagatgagagctgcagatctggccaacaccttggtttcagtctagtaagaatccagccacactgtgctgccctgatttctgtcctacaaaactgtgagttaataaacaggtgttgttttaagctgctaagggtgcagtaatttgttacacagcaagtgaaagtgaatacactgccaagttcctcaaactgtactagagtagatcatggagaattatcagactttggcctcaaaaagatctgatttttttttttttaaataattgaaatggccaggggacttaagctgggtaatccagaatgggaaacagttctcttttgggaataggagtatcttattccctgaatgagtccattcgtgcattgctataaggaaatacctgagactgggtaatttataaagaaaagagatttaattggctcacagtcctgcaggctatacaggaagaatgatgctggcatctgctaagcttccgggaaggcctcaggaaacttacaatcatggtggaaggcaaagggggtgcaggcgcaacacagtgtgggagcagtaacaggagtgagagtgaggggggaggtgctacacacttttagaacaaccagatctcaggagaactcactgactaccatgagaacagcatcaaagtggaaatctacccccatgatccaatcacctcccaccaggtaccacctccaacattcgggattacaattcaacattagatttgggcagggacatagatccaaactatatcactccccaagtcctaatagcaaacaattgtaattccaagccaaatactacttacttatttcctaagaccatactgttttctagaacgtagtacacagccaactcaaagttagtaaggatgtaagtaaatcagacctgcttcccaactaatctacattttagaaaagaaaggagttggtgttctaaaggtattgctgcctgatcacctcactgagttctgagttcaggtttttatcatctatttcctggactaacttttcctcattaatttccttgtttcttgcttttatccttcccattttacacattaattccatatattctttgcaaaaagcaaacctctggttctaaaattgcatttcagcactacatatgtcttatgccactagtactattaatattttataaaacacttgtgggatctgacagaaaatattactactgaaatggagaaagactgacagaaaagttaaaccagtgagtccaaatgcatgtaaaatgacatccactgattctacaactacccagaagcacacagatgcccagcactgaggggtgtacagtctagtgaggaggggaaagtgcatgtaaacacacaaatgtaagcaactgctcctggtatcgttatggaaacagagatggtagtgggccaagtcagagacatctagaggtgatcttacagactggccagaatgaggctgactgcaggaggtccatgtctcagggaaccacatcatcaaaagcacagaggcccaaactaatctggtatgactggagagaggaaagaggttaggcataggaataatccacaattcaaaagaataaaccacaatgctaagaagcttgggctctatccctgaggcaagtagtagccactgaaatgcaaccatagaaacaaggattagctttctgcaaaaaacatatgaaattagagtgtagaacaggtagaaaggataaaagcaagaagaaagaaaattcatgggaaaacgctgcaattgttagtccaggacagagatgattaaaaactggaactcagaactcagtacagttgttgctctgtatccatgcattccgcatccatggattcaaacaactatggatcctaaacatggggtgatggctacatgtgtactgaacatgtacagactctttttttggtcattattccataaacaattaggtattacaactatttacatagtatatacaccatactaggtgatggaatctagacataactgaaagtatataggagcatgtgcacaggtgacatgcaaatactaaaccattttatatcaaggacttgagcatccatggattttggtatccgaatgggatcctggaaccaatctcccacaaatacctaaggacaactctaattcatttgctagaagtggatgtttgactcttcatttctggtctgaaatactgtaccattcatttcgacagagaatagagcaggtggatgaagaagggaaggggttttagagaaaagtaaccggctctagctcctctgagtttcacaggcaagtgggataccaagcagcatagaatacggtagggattgcttgatatataaaatctatagctgaaaagtaaaggtttgagctgcaaattgaagcaaaggtgattgaaactgaagcatactgaagcatgaccatgcagctggaagccaaagcctttccaagcatgtaagagtgctggggagaaactggggaataaaagagccaagggaagagcccagttcaaagccgaagaacaaagttaaacaagccaccaacattataatctatagtcaaggacccctactataattgccaatataagttttaagtgtcaaatacagattttagagcacatacatatacaaaagtaagcctaccttttacattaggataagatatacatataagaagaacaagcaaactaaagacccatacgctcttctatctaaaagctatgtttgtagacaatctgaagccagctaggtgcagagtgaataaaatgtcacaaaaaaggaactgtttactaagacttatattggtgaaagttgctataacaactaacgattgcctcatgctattcaggaaataatgtaagatgtaccactttacacaagccttctgcaaacttccacaagctttagatctaaaggcatacacaactactaatatataatggatcaacaaaattcaaatgcagtcaactttctaccttctaaagtaatttagaacacaggaaataagggaaatcctaaacctgtgttacacaatatggtagcaacaagacaaattaattaaaatggaataaaattaaaaattcagtcatcctccttcaagcactcagtagtcacatatggctggtggctatggcacagtatgggcagtgcagatatagaacatttctatcaccacagaaagttatattggacagtaatgctgcaggctctagatgctgtagcactgctctaggcatttttttaaggagcatgagcctcttccagcatatcactatttttaataagtagtaaggttagctgaaaaagagtttagaacattttttatacagcttattttaaataccttactgtaagttttaaaataagcagtaaaatgataaacagtcagtatatagccattttaaatttcacagatgattccaatatctgataccctgcagctcagtagttctctttagtagaattcaccttagtgatacacacactctgtggcaatgtctgcaaacagcaatatattgggatctaaatgtctatcaataggaaacttgttaataacattatgataaaattatggcacaaccatacaaaactctcaaaaaggatgaggcagaagaaacaattctagtcacaataataaagtacatagaaataaattaaacaaaagaagtttaaaacgtactatgaaaactgcaatatcttgttgaaattaaagacctaaataaacagaagacatcccatattcatggattggagacttaatactgtttgccaatatgggaaaatgccccctacagattcaacaaaatccctatcaaaatcccagccagcttctttgctgaatttgacaagccattcctaaaactcatatggaaatgcaaggtcccagaatagtcaaacaatcatgaaaaagaaaaacacaaaactgggggattcgcactttccaatttcaaaacttactacaaagctatagtaatcaagacaatgtcgtactggcataaggatgaagaccaatggaacagaattgagggtccagagataaagccttgcatttatagtcaactgatttccaactgattgccaagacaattcaattgggaaagaatagtctgttcaacaaatggggacggaacaaccgaatattcacatgtgaaagaataaagctaaattcttacctcccaccatacacagaaactaactcataatggatcaaagtcctaaatataagagctaaaattataaaactcctaggaaagagacacaacaatactagccatcagaaacatgaaaaaatcaaaaccacaatgagataccacttcacacctactaggatggcaataatcaaaaagacagataacgagacgtcagtgacgtacaaaacaagagaacccacaagtattgatgatgaaaatggaaaatggtgcagccagtttggacaacagtctagcagtatctcagaaagtaaaaaagagttatgatgcagcaattccactcctggcatatactctgcagaaatgaaaacatgtccacacaaaaacgtgtacatgaacactcacagccacactttcttatagcctaaagtagaaaccacccaaacatccactaactgatgaatggataaattaaaatgtggtatatccaatacaacagactattactcaacaataaaaagaaatgaagtactcatagatgctaccacatggatgacccctgacagcattaaagtattataaatcaaagccagccaccaaagaccacatgtatgattcaatttgtataaaatgattacaatagacaaatctatagaaacagaaggtagatcagtaacagcgtaaggctggaggggtacagaaaataggggtgactactcaagtgtatgaagttttttgggggggtgataaaatagttataaaattaagagggctgggtgcagctgcacaagctgattgtcccagctactgtgcaggctgagatgggataatcacttgagctcaggagttcaaggctataatatgccacgatcacacctgtaaatagccactgcactccagcctgggcaatagagcatgaccccatctctacaaaaaaaaaaaaaaaaagttaaattatgtggttgatggttgcacaactctgagtatactgaaaaaccactgaatggtatactttaaatgggtaattacatggtgtgcaattaatcttttaataaagttgttatgcaaaaataatgaaacacttctacatgtattaatatgaaagatatacacactgatgaataaaaagatgcagagcactgtgtatgctatgtatcatttgttttacacagacatcctaagcactggatggagcaacaagccaataatggttgtctccaggaaaaggaactcagtgactggtgagatgaaggaaaggaggtaattttttcaagattcttatcaccccccaaaaactcctttcaggagttcaagaccagtctggccaatatggtgaaaactcatctctatcaaaaaaatacaagtattagcagggcatggtggcacgcgcctgtggtcccaactactcaggaggctgaagcaggagaatcactttaactcgggaggcagaggttggcagtgagccgagatcgcaccactgtactccagcctgggcaacagaatgagaccctgtctccaaaaaaaaaaaaaaagagagagagagagagacaccaccacaacaacaaaataactgttacagtcatggtaaagttgcaactaattatcctagggctggagagtcaagatacaagccacagtccaaatgtacagctttctggtaacaaggctctaggttaggctgaatacctgttccatcacttaccaatccatgagaactcaagccagtgaccatttctctaggcttctgatgcacattagagtgttgtaaatattaaaagagatgacacataaatcccctgccatggtaactgtgtacatggtaggcattcaataaaggttaatcctcacctccccactcttctggtatgtggtgacaataaaactgtttattcagggttccagctgtgaccaataaatacaccttgatacattacgcacgatactgctacaggccttttggcatatctggagttcctcccattcctctctgttcatctctgactatcctaactgcaaaggtcaacatcgatcccaccacctaacaaccctctgcttctaaatctatgtattttataatcatgattagttaagagatttcttgagaaggttacaaacagttaattatcacatacttctacaaggcaatatgacaaaggcagtatttggtgagaaaaaaaaagatttaaagttgaacataaaaagtgacttacctaattaagcggaatagaaattcaaaacatacagtggtgctgagactagcacccatgaaaccaaatactataaattattctctcttgcattcacagaagacacagaagacactgtgccatacagcacaactgtatctgacaaatgaagactgtcctgaaatgtatcaaatccatatacctgacagagcaggactaaagccccaccagtggaagcatcccaccaatgcagactgatactctcagaactgattttctccttcccttgtgtcatgaatcttgtgattctaacccacagttccaaattctgcaggattatcccaagtatagagaatattccttatttacttgttcaagaaatacttacaaagctcaaactattttactgctaaaatgagaaaaaaatgagtcttttctcatggtaccaggaatctaacagatagatcagatagaaataaaaattagagcataaaacaaggcagaacgtagcttgataacattacttctttaattaactcaaggcatattcaatgtatccaatttccagtctcctgtataattcccaggggatacaatagcaaaaacaaaacatgtggaaaggtatacatgttctctccagctggctgagtgcctaaaaattctcaaagaaaggagagaaaattgaagaggcctatgacgaagaaaaaggtgtcaatagatctagctaggaaagggcgttctaggcaggaggacatgatggcctgagcaggagaaggtatggcagcaagaaagggctcatccacttctgccggcacacaaggtacccaaaggagaatattggcagaagtgctagagaaaggttgagaccagattttgacaccctggggtgaagaatttgaagttaatttgctaggaaataaaatgctacacaaagttaaatctatttctttcggaagctataacacaatagttctcaaatagaactatacagcacaaacaagtggaagtttttcaaaatgcaaaagtgagaatcaagagattcttctgactcagtaggtcaggaatgtagcctgggagcatgtcaccaggtgactgatacacacccatggttaagaatcaatgctccaaggaatcattaccatctctaacgggtgtcaactggcaatgcactaacgtgagtttatggtccaaacacaagtaaggaaagtagatacaaatagacgtaggtaaagaaaggcagatagaaataagaatttgtaatggtccaaaaggtttaatgaaaaggacctccacttataataaatgatgtttcctaagaagttactgcatgaatcagttttcaatcacctactacaagtgaagtaaaactaatttttagtgaattctattaaaatataaataatcataccacaatgtatttagagttccaactcagaaaagcatgcctaagggagttataatttaagcatgactggggactgagtgacaccttaaatatgactgataaatcctattcatttttcttttctccttcgtagttgaaaagaaaaagaagaaaaccccaaagaacaaataaaagaaaaaaaatcaaggaacaagaaattcaacaattttttttaaaaaaataatgagaatagagaagagatgacaactagaaagaacataagcagctataagcaaaagtggccgcagaaatagatactgaccagaaaacagtccaccctgggaccacaagagcttcagcactacaaccaggggcgggggagacattctgggggatgatgctggagacacatagcttcgttggatggagtggtcggcgcatacttcccacactcccacacctccagtgtaaccagatcacaatcttttccaaggcagaagacggaacattttggagacactaggcacaaggatatatagtactgggctaagaaacagtctttatgatgaacagttagaatcagaccaggatcttagtctccttactccactctgctcccagaacatatccccggctcatgtctacgccctggacaggaatacggagacttcttcactggagaaactaaatagccccactcaggccaggcctatgtatcattataacagaattacttttttcacccttccctttaaaactaatgatcttcaagaagacttatgttttactcactaggttctgctcctatatgcaagatcctttcaggcttttaagtgctagaagccactccctgtttactaagtatgacgttagctatgtgcctaagaacagactgagccttagtccctacgtacttagtagagctccttacttagacattaaataacagatgttgaatgaaaaatcacaagtgaaaaagtatatgcctaatgcttggtaaactatttaagcctacaatctaatactctgatttcataatctgacagtgatcataaacttttaaaatgttactcaaatttgcagtatttaagagtaatatttcctactcatttattttcccaaaatatgtaggtaccgtgtgaaagcacacaaaattctgtttatttagtggagataatgtttctatgtattaggagttcatgagtaaagaatcttgctaatgactcagccacaaactggtggcaagaacaggcaaaaattcctaaccagtgtacacctgacttagagccatgtaagccaaatagcctattcatcactacttagtagggagaagtttaagaactcaaatagtatctgacttaatcataaaaaatgaaatacggtttaatcaagtgattaatgtttttaaaataagcaggcaaaaaactaaacatagggaaaaataatgcagtttaaatgtggctataaaataaatactttatatacagaataagtagttttgtttttcctaattcttagatccacttacgattttaacagtctagcttgtgccgggtgtggtggctcacacctgtaaccgggaggcggaggcgggcagatcacagggtcaagagatcgataccagcctggccaacatggtaaaatcccatctctactaaaaatacaaaaattagctgggcgtggtggcgcacacctgtatcccagttactcaggaagctgaggcaggagaatcgcttgaacctgggaggcagaggttgcagtgagctgagatcgcaccactgcactccagcctggcgacagagcgagactccatctcaaaaaagaaaaaaagagttaatacaagtgttcaaaaactcaaatttaaattgtaaaagaactaacattaagaaaaaaagtctagcttgtcatacttagctaaaacaaagtctttcaatcatttattagtatatgaaacaaaccaccaaaagaatctaaaactagcataccatttaccactccagttgaatgtcactatattgttttcactaagactcactttaaccattttttttttccatcaagacatccagacccccagccctgatttgatgtcatcccaggatgtgtctcatttgtttcagaagccatcttgaattgtttaaaatgttttaaaggtttccctttacaatagtctaatcctttcaaaaagtggggtcaggggcaggaagagctatacaataattttttggtactggaggtaaataagagtagaaaatgaaaaaataaattataaatcattacttcaaaaaatattagcagtatttatttggcagaatcagaaaataaagttcatgtgagctaactggtctaataaaaaggtttactaaacccacacaccagttttcgacaaaaatctctaaaacatattacggatattcctcaactcacgatgaggaatatccaaaacacccttcataaagttgaaaaatcctaagtcaagtcattatgagggacttgtatctgctgttgccattatacgcttgtctttactaactaaataatatttcactcctgtcactagaatttgaaaagtacagagtagtagttaaaggcatagtcttaaaagttgagagcttggtttaagttccagctccatcagttataaaccctgtggctttgagcgagtgatacccacttttctcaccaatcttattctttctccagctacaacagtcctcatgcccttcttgaatccagacaagaatctacactgcctgatgatctggtttacgaaagcctgtacattttttctgggatttcaaaccaatatcacaccaacgccaaatgctactttggccccaaccatacctatttgccaaggtcagcatcacggagcattctgtcactactgcctcaatttccatccctgaaacaagatgctgcttttttctgtggtgtctcccttatataaccccctgtccacaacagtcctaaccatatcctttgccatctatctgtggcgccacatccctctccccactcaacccatcttcctttttaacagagccaactttccaaaattaacatacaactggtgatttttctgcttgaaaagtagtatttatttttcttcggattaccaaaataatatttgttcattatctgtaaatcacagggctataaacaaactaattctttacagccctagtatccacagataaaccaaaataactccatttatttcctctcaatttttacccagatataatttgagatccctcttttcataaacatcttctcctatcattaaaaacactgtaaaatatcactttagcaggcacttcatcatacacgtctaccaaaactactgaaccattcctttgtttccagtcttgggaagattgtatatactgtgaaaaacatctttaatcatgcatctttgtctataccttaccaattaaattgttagggcacagtaccagaagtaaaactgccagatcaaagattatacacattttaaaaccaaacataatgccaaactgctttgcaaaattctgtgtagcactctaaacaccaggaagaatctttattggcagttaaactgcttctgatgcccttgcacagactttaatagagagacatcgtaccaacaaaagaattgttcctcacaataacttgtaacttaatattaacaagtaacattcctttttaggaaaatattaaaagcactaaaatcaaaggcttaaaacttaaaatctgaagtaaaatttaaccaaacaataactgaagacaatagtctaacaatttaagcattttaagcagaaaatagttttttaaccataaaatcattagtaagtttgaaacttctatttttgcctactttagtatctactctgagcagtgctaactctttaaatactataatgccaaagcattccttaaaagttttccatcattagttacatttttgagaaagatcaatctggtataaatatagaaattcaatccataataacattagttttaaaacataattcagaaagatttacacttatggcaaatataaccacaccagccatttactataaagttctgtgtttgtttcatcatgaagaagaatgatatggcctctgacctcatggagtcgtctgtggaacgacagtggaattagcagagaaatttataattttactgatgaaaaaaaaacagctaaactctagtatgtggtaagaatcaggcattatctatttgctttcacatttattcaaatacattcttttaagttttaattttcttaaaggcacaaatgacacagaaaaaactttcctactgagacaattactctttgtgaaaaataagaggtaggctgaagtggcccagctgaccactgagcgcatacagtccagggcctcagcccagggccccagtcgaggaacggcatgttgggaccacaagatctcacaacctccatttgtccagaccgggctcaagcgcaataaatccaaaaaacatctgtcatctcttcagctgaaaaaagctcaactgcaactattctttgtcactgccttccagatccttttcctaatgtgagcaaacctgaaaaggcctccaaagaggctcctaataggctgaccagaaagtcacagaatctgtttccacattttaataacccagacagaacacggagttgaaggctgtttctttgcactttgtccctgacatacatacctccctgcccaagtgtcaaaaaattaaatgtctcccatctcagctcaaccttgtgtcttctaccctataaaaagccattcttccttattttagccagattctacttttctttcaacaatcatctcaaaccttattgactccctgtgaattgtctatgtcccccacagatctcaactatagcacctcccggggttcctcttgtattttaattaaccacatacatgttttcctctgccactagagatgaagcacttgcagggtttagctaaaatttccacatacatctctctccttgcacacacatacaagagtttcttgaagctaatttttgtcaagctatactcagaaagcaatgaaatcaatacacagcttttttaaaaaatgaaataaaagtataaaatacctaagtgtgcttcatgcggtaaaagtattgtttcttgagacatatttcagttgtgtgtgaacagatctgtatatgcctcgagttacacaaaataacatataaaaaatattgctcaagggtcttaaggagcaggctatgcatatcttcaaatatgcaaatttagatatatattccccacctggaatttttgattaaattctgaaacagagctctagttttagtttatttcatatggataaccaattgttccagcaattatttattttagattgagttacacacatatgctgaatttacagatttttaaacgacatctgtaccatattaagcagccccattctatatttttaaatatttatattttatgagtctatatattcattcaaaagtgattttatgccctttaataatattttgtaatttttttcataaaggtcatacaataagacttttgttagagttactgttaggaattcagaatctgtaacctttactcaaaaataattttaaggtgggtgcagtggctcacacctgtcatcctaggactttgggactctgaggcgggcagatcacctgaggtcaggagttcaagactagcctggctaacatggtgaaactccgtctctactaaaaatacaaaattatccaggaatggtggtgcacgccagtaatcccagctacttgggaggctgaggcaggagaatcacttgaactcaggaggtggaggtggcaatgagctgagatcccacgactgcactccagcctgggcaacaagagcaaaactctgtctaaaaataataataataataactttaagatattttaattatccagtaaatacatctcttatttatcatttggttaatgttggctcaagtttcagtttcccctcatcttccattttaaaacacttagaattctaaattaaactccaaactgtcagttaaaatacatcatgaaattcattcctattttctttcatgaatttagtacattcagttagtattcaaagtgaacaaaacattccccttgaccccaaaatgaatttgtttgctgaagttaaacttctcatgataaaaagccccaatcttaaaacacacgagctaaaacataaaaaagacgttaaaatattaaatcgaaaacttccctttccttactgagctttcattaatcaggttaataatagttaaatttacctagaagactgccaccatcaaaaaactgtaagccaggcgcagtggcacatgactgcagtcacagctacttggaaggctgaggtgggaggatcacttgagcccaggaggtttagatcacttgagtctagcctaggctttttttagagacccccatctctctctttaaaacaaacaaacaaacaaacaaacaaaaacaaaaaacaaaacaccactgtcaataaaatctgacttgcttttctgcctataaaggctgtagcttcttaagatctattttatttaaggctagcaactatcctctttcaatatgtattgggagaatcattatggttcttaacgctagagcaagctgcagtgagctgccaaccagcagatcgtctgccttagtaacttcctatttatgactcatacatgaaaccagtagtttctccctccatgtcctgaatgaagtatggcagagctcccaaatcattagccagcctctccaacagaggatggccaccatactcccaacaaaaccacttttaagtatgacacatatcctatatttttagtcagatcatccaaaaccttctaaatttggtgaaaatctacctagtcatttttcacattgcaattacagacacagagatacaattttaattgtatttataaagtttaataggctgtttctaaaaaacaagcattcttaagactgtagagaaaatagtaaataaattcagtaatttttttcccaaaatatcttgtgcttttccttataaatgtcttacaactaaacttacacttaaaaaaaaaagtaaaagtgggttattggggttctagacttctgctgtcctataaggtagccagacacatgtggctatttaaagtaaaaataagcaaacaaagattcagcacatcagtcttactagccacatttcaactgctcaacagccacatgcgggggttagcagactggacagaaaaatcacagaaagttctactgaacaatgctgcttagagtttaaaagctgtaaactgtgctaataaaattatctttaaaatgtagcttgttactaccaagtaagaagttctgttaagtctaggaacctaaagacttccaaaatatattaataatcatgtcaaaatattagatctattttttcaataaaagaaacataaaataatatttgtctatgaaacatttagtgatcatattcttcccaataaacaaaatggaagatatattttgcttgatttttttttttaaaaaacgcactatatatgtgctcaagaaagaaataattttttttttaacagagtctcactcactctatcacctaggttggagtgcagtggcacaaattcagctcaccaaaacctccacctccagggttcaagtgaattctcctgcctcagcctctcgagtagctgggattacaggtgcgcgccaccatacctggctaactttagtatttttagtagagttggggtttcaccacgttggccaggctggtcttagaactcctgacctcaggtgatctgcccacctcagcttcccaaagtgctggaaaggtatgagccaccatgccgggccaaaattcatgttttaagaagatatccaagccacgcataccaaagacctcccctttaaaagaaggccttttttcaagtgcaggattaaaacaaaagaatatactttcagacttaaggataagacagtgtagatctctggccaggcacgatggctcatacctgtaatcctgggaggccaaggtgggtggatcacttgaggccagggttaaagaccagccatggccaatatggagaaaccccatctctactaaaaatagaaaaattagccaggcttgaacctcggaggcagaggttgctgtaagccgagatcacacaactgcactccagcctgggtgacagagcaagactctgtctccaaaaattccaaataaagagagagcgagcagtgatttctgtcatctgctcagcagcaaatcgtttctcattgctggcaccctctagcgcttgtgtgtcaccagattactggaaacattttagcagagagaatggggaccataaaacactgcttggtccttctctccctaaaagttaattctcaaaccaagtaacaaagcaaagaactcttaactcagtaataaaaaaagacaaaagacacaatttttaaaaaactttttccataagttattggggtacaggtagtatatggttacatgagtaagttcgttagtggtgatctgtgagatcctaatgcatccatcacccaagcagtatatgttgcaccatatatgttatcttttatcccttgccccctttccactcttcccctaagtccccaaagtccgttgcatcattcttatgtctttgtgaaaagacacaatttaaaaaagcaaaggatctgaatagatgttcctccaaaaaagacatacaagtagccaaaaagcacatgacaagatggctcaacatcattagccatcagagaaatgcaaatccaaactacaatgaaataccacttcatgtccagtaggataactacaagtaaaaggatgctaacaagtgttggtgaggatcctgggaaattaaaaatctcttacactgcaggtaggaatgtaaaacgactctgctgttttgtaaaacattctggcagttctacaaaatttcaaacatataagttatcatacgacccagcaatctcacttctaggtatttatccagtagatataaaaacatatattcactcaaaaacatgtacatgaatgttcagtcacaatattcagaacatccaaaaagtaaaaacaatccaaatgtttatcaactgatgaacagataaaccaaatgtagtgtatccacaaaacagagtatcattcagcaaaaaaaaaaaaaaaaaaaaaagtaactaacaacgataagactccaaataatggatcagtaatccaatttttattactttactatttctagcctactatttagaaaaggaagattttaataacaaatataaatggtgaaaaccaatatcctaatttctttttttctgagacgaggtctcactctgttgcccagactggattgcagtgatgcaatcttggctcactgcaacctccatctcttgggctcagcctcccaaagtgctgggattagagatgtgggccatggcacccagcccaatctcctaatttcatatgaaaaaaagttatacaaagactggaaaaatctcagtatacctgggaaattaatgggctgtcactagaatagtacagtggctgaatttagatccttcaaatactgtttagaaaatttccattggaagctttataaagaaagcacatcaactcaactttctgaaattacatttcataaaagatgttgttttaaagagaaattgctgaaattccaatttctggatactaacacaaacttgaaagatgaaataaaaagttctttagatgtatcctaatgggcctaatgtaagaatgtagaaagattatgtcaacacctttaaaaaaagtttttggagacgggcgcagtggctcacgcctgcaaggggccatctgagctgctaacacaccaccgtccgcagacagcggaactaagagagcagtgtaacaccctctctcaggcctcggggtcacgggcaccctcacctaggcagcgccacaagcggcaagatgagctgctaacacactgctgtctgcagacagcagaactaagagaataccgtaacactcactctggggcttcagagtcccaggcaccctcacctgggcgctgcgagagcttgttcccgtgttggcgcctggagcagccagccggatcccgcactcgctcgctcacatgctccctcctgcaagcgctggagaatggcaggctgagtaaacagggcgcccctgttacaagtccagtgaagaggccgagaaaagccctgcatcataactactgctcacaatagtagtggtctctctgctactttttcactgtgaaattgaagctggaatgaaaatggtacaaacaccaacagctagctgttttaaaaaggctggcccaagagagccagcaccgagttcagggaactgcagtgagttcaactcaacagacaaagcacataaaaccacccaaaattttgaaggtacacttgttgctttaaaacgaccatcctttggccgagcaaggtggctcacgcccgtaataccagcactttgggaggccgtcgcgggcagatcacgaggtcaggagatcgagaccatccttgctaacacggtgaaaccccatctctaataaaaatacaaaaaaattagccgggcatagcggcgggcgcctgtagtcccagctactcaggaggctgaggcagaagaatggcgtgaacccgggaggcggagcttgcagtgagccgagattgcgccactgcactccagcctgggcgacagagcaagactccgtctcaaaaaaaaaaaggccatcctttttgtgctaacataaaaaatccagacatctaaatatgtcatttttattatatcaaatacgtagctttgatcttagctatggaggaggtatctctccctctccttccgcagtgcccacaacagatgaagggggagcgcaggaataaaattctagagtcaggttacaggactatcatagagtaggaataagtcttggttagactattcctcagagaactgaggttaagagctgagaaatatcaaacaatcatatacagagcaaaaagatctcaatattctttcaagtaagaacttgcactgctgtgttcagccagaggcagtgggtgggggggaatgggggtgggataaaatcaacagcgaagctgagtcgctgtcccagggatctagtccaggaatcaaggcaaaaactgcacgacagtttttattttaagtactaagtggttttgatggaaatgaggaggacttaatcacaccggaaggtttcaagaagacgtgggactgaactggatctgacatataggtagattttagccagcagtggggaagacattttgtaaaaggagaatcagtgcctcttctatccttaaaatgctaaggcaggaattaccaaggtctgtcagctgaacactgtaatgctcatcctgagcaaagcaagaatgcctgaggataagagggcccaaaaccacagagtcctttaataaaacagaaaggtacaaatgagaatgatacctaagatggatatggaaggtgtggaagactttgacagagatggaggctggaacatttcaggtagagggagcagtaacaagaacaaagggcggacaaacagctgcattccaccagctgggcagcagcagggcatacgtccaatataatgaatgtagctgcaaaggtggtggacaccgacactggagaccataaccaccaggctctcacactggcaaaaaagcaagtaagcagtagatagagaatagggagatggcaaaaccatccatgtgctttagaaagattactccagcacacttaagcatgatgaagaaagaaagacaggaaggtaaaaagatttacccagagaccagatttcttttcctataaaggacatgtataccaacgaggtgcccttgcttcaccactcacatttgtcccggtttttaaagacaatcatatacacagataaaggaatgctgaaatggacactcacatgttgacaaacgtcaactgttaaaatagctgggcaatatgcatgaaaaatcttgttgattcttgtcttaggaatgaatatgatctctgtcatatgttgtgattctatcttaggaatttatttctggaaaataaaccaaccatttttcagttaaaaaaaagtatacaactattatcaaaaatcattgtttatgacagccaacatattgttaatactataaatgcaatattcttgaatttattacaagcaaaatgtgttttttattttaacttttaggttcaggggtacatgtgcatgtttgtcatataggtaagcttgtgtcactaaggtttgttgtacagattattgtagtaagcctagtaccaatagttaattcgtctgcccctctccctattttcaccctccctcgccaagtagaccccagtgtctgtttccttctttgtgctgatttgatgagttcttatcactcagcgcccccttataaataagaacatgtggtatttggttttctgctcctgcattcttttcctaagggtaatagcctccaggtctatccatgttcccacaaaatacattatctcttcttttttatggctgcatagtgttacattttctttatccagtcggtcactgatcggcatttacattgattccatgtctttgctattgtgaacagtgctgcactgaacatccacatgaatgcgtcttcatggtagaatgacttatattcctctaggtacacacccagtaataagattgcggagtcgaatggtagttctgtttttagctctttgagggatcaccatactgctttccacagtggttgaacaaatttatgctcccaccaacagtgtataaatgttcccttttctccgcaatctcgccagcatctgttattttttggctttttaaccatagtcattataattgatgtgagataatacttcactgtggttttgatttacatttctctaatgatctgagatactgaactttttttcatatgcttattggccccatgtatgtcttcttttgaaaagtgtctatgtcctttgcccactttttaatggtattgtttttctcttacaaatttgtttaagttctttatagatgctggatactaaactttggtcagatacatcatttgcaaatattttctcccattctgtagattgtccatttactcttttggtaacagggtctcactctgtcacctagtctggagtctagtggtgtgatcataactcactgtaaccttgaactcctgggctctagcaatcctcccacctcagcctcttgagtagctggaaccataggcacttgccaacacacccaggaaattttaccttttgtagagatgggtcttgctatgttgcctagactggtctcgaactcctgggcttaagcaatcctcttgcctatataatctgcctgctttaagaattcaaggcatgagccaccacacccagactaaaatttatttttaagatcaagtttgcaggccgggcgcggtggctcacgtctgtaagcccggcactttgggaggcggacagatcacctgaagtcaggagttcgagaccagcctcaccaacatggagaaatccgtctctactaaaaatacaaaattagccaggcatggtggcacatgcctgtaatctcagctactcgggaggctgagacaggagaatcgcttgaacacgggaggcaaaggttgcggtgagccgagatcgcgccattgcactccagcctgggcaacaagagcgaaaccttatctaaaaaaaaaaaaaaaaaaaaaaaagatcaagtttgcaaagagtttttaagtacaaaagtaaaacaaaaacggcaataaaaatttgtacttaggatattatcattattcaaacacttgtaatctaagtctctaaagtgaaaaggctgcaaaacaaaacaaaaaaaaacagtaacagaaatattcacatgtgaaataaccattaataaaatcagacccttttcaaatatctctccccattaaaaaaaacaacaataataataaaaaaaaaaaagataaccaggctcagcggctcacgcctgtaatcccagcactttgggaggctgaggcaggtggattacgaggtcaagagatcgagaccatcctggccaacatggtgaaacctcgtctctactaaaaatacaaaaattaggtgggtgtggtggcgggtgcctgtaatcccagctattcaggagcctgaggcaggagaatcacttgatcactgaacttgggaggcggaggttgtggtgagctgagataacgccactgcactccagcctaggcaaaggaaaggagggagggaaagaaaggaaaagagaagagagaagagagggagagagggagggagcaaggaaggaaggaaggaaaggaaggaaagaaggaaggaaggaaggaaggaaggaaggaaggaaggaaggaaggaaggaaggaaggaaggggaaagggaaggaaggagtttaatgaaggcacaggtcaattaatagtctttgatagaaactgagtggctgtctatagtcacgccaccctgaaaacacctaatcgcatctgaaactaagcagttgacaagagaatgcagatacaattcaataaacctgaaaaccttacaaaatatgcaagacttcatggtagcaataaaagccttgttgaccttagtaacagccaagggtactggcaaacaagaacccagcagaccaactaacaactgtagaagacaatatcaacaaagataatggactgacaggctctttaatggagaacttgcatatgagagaattagagatcagtggaaaagaggtgaagctctcaactacttttacaaaatagttcctttataattcctgtaaaaataaaatacgggctgggcgcagtggctcacacctgttatccccagcactttggtaggccaaagccggtggatcacttaaggtcaggagttcaaaaccagcctggccaaatgatgaaatcccgtctctactaaaaatgcaaagaaaaaaaattagccaggcatggtggtgtgcacctgtaatcctagctactcaggagactgaagcaggagaatcgcttgaacctgggactcagagattgcagtgagccaatgcactccagcagcctcggcgacacagcaagactccgtctcaaaaaaaatgaaaaatgaaaataaaaataaaataagtaaaaaatcatatttttttggaaactattacaagagaaacaatatttgggtcaattctttgttcattctataaactaacagatccaagagtgataaattttgttaaatattaaaataaaactaatttcattttaataattagtatctattattattaaaataaggcccaattaaatttttttatgacttacataaaatttagatccctgttttaaacagattcacattaagaacacctttgctgcaccagttataataaggtaaatgagactgattattttagtaatttcagttatgtaaaaagaaaaagactacaaagatttatactagtagttgccactggaaaatgcggttgtgggtgttttttgtttgttttaaacaaagggacagaattaaatactgtttaaaacaatgcaaatatattaaccagtaaataagatttttgaaatgtaaactaatatttcatcaatggattgctattgcttttcaatctaccaaaagatcattagagaaacttctactatctcatttaagaaatatttcctggatctctacgatgtgctaaataccatgaagacaaaatttaataataggctatactgatgcttactatgtgccacttcaacccgtaaaataatgcagccaacaaactaattattatcaacgtccagagactgagaaacattaagtaacttacccaatggtatataactaaatagtaactaaaccatccttcaaaacaaagactgtctacaaagcccaggatcttaagcacttagctatgtattgcgttggagaggcagccttaaaataacttacacattagaagaagaaaagcagcaagcagaaaagcaccaaagcaatgaagataggtgtgctgatataagattcaccacatgctatatgaagcaggaaaaaaaaaggttcagtgtgggtaagaaaagagggcatcacagacatggagaagatggtaacagaatttcaaagaacacatgaattccacaagaagaaagaggtgttagaccaagcctgtccaataggccacatgcagcccaggacggctttgaatgaggcccaacacaaattcacaaactttcctaaaacatgagttatttctgcaattttttaagctcatcagctatcgttagtgttagcgtatcttatgtgtggcccaagccaattcttcttcttccaatgtggcccagagaagccaaaagattagatacctctgtgggagaccatctgaggcagacagggtaatgtaattttttggaaactacaagtattatttggcaacggctcccaccaaaattttgtaaacttgtaggaatagagataaaatagtcaaatgtttgcttataatatttaatgtttaattcaagtacatatgtatttaaattcatgttatagattatttggaaagactgtatttcccattgtcacaaagcaagtttatttcaaatgctttatcacatgcacctttaccatcattgtactcatcagtaaagccatctctttagtctaaagtcagttttctgaaatgcagcattttcacttctacgttgtctgggattgtgtgtgtgtgtgtgtgtgtgcatgtgcatgcattttaaatatgtatggtattgccaaaggaagtgttccccaagtcaaaaataactactcattctcgttcatgtcagttagcttttccatttggttttatacacaaacaaatatatcctctctatatcacaatcacttattgttttgctttttcatatgatctataaaaggcatgagaaacattcaacatttgaaactatgagaaataattaacaaaacaggtgttaaaatatctttaaaaaaaaaactatttctactagtgaactctaaattacctaaaactaacaaaagattgaaaccatttccatttatgtcatcacaaagaattattagctattcaaaataaagtcattgagatagttccctctaatatgagagatgttgcacagcactattctccgggggataatttcttggggaaaggggaattcatttatattctagcagtacttctatactaacatctataggtacattagaggaaaagcaaaaggaaagaaacttgaaataggcctgaataagatctgtggttctcaaacttaggtatatgtcagagtctcctcaagaccttgttacagtacagttgctgggttccatccctgtgtttctgattccataggaatggggtagggtctgagaaggtgccttcctaacaagtactcaggtgctgcagatgccacactctgatctagattatgctagacgctgttcatcatacgaaggttgattttatctttcaggagtttaggacagggaaatgacattataggatttgtggtttttaaaatatcactgacagcattatggacagtagtgttttcacataacatatttcatttattctaatatgtattttttcacaatttctgataacagagtgcatcttcccatcaacagtatatcatagtttaattagcagtgatttttctttcttggtggtgcataaaataatggtgtaaattatcacttacaggcagcagattcactaacatacagtattatcacctctgatataatggcactgtgaagggggaaaataggttttattcccgttttacagatgaggaaataggtttcaggacaatacaggaaataacatgcctagtaaatgacaggtccaagatgagaaattcagaaatttttgacacacaaaacaaacaccattcccctcaatgataccacttataacaacctgtagttcacttgccagagagaagacaagacaagagcataccagtgtaccctaaccaacaacaggagcaaagagaagagtccatgggtaccaggtgtgaaatgccaaatttaagtaatcaagaaaaagtgtctcaagattttcattaaaaaactaaataaatgaaaagacacaatgaaccacctccacaaatatagagatagaatcaaaagactagtttgggaacactgtttcatgcagtgctgagagatgcagaatgtgacataacatctccaaagcaacagacatcagcttaaggatttaaattatagttggtgatactaggaagtcaagtttgtgtaaagacaggcactgggcctggagagtggccagaggccagaatgccatacatgaccagctttctgaaagatgactagaaacccaagatactgcagcagcatcaaatgcaacacctctcaaaagcccacaaacttagcttctgaccaaaccctgtctggaaaggtgtgatgttctaaataccattctgtaggctgccagatgattttttattttgaaaaattaaaggaaaaatcagaatagaaaatctaaccattattatttgtcataacatcctgcatattcctactccccactgcaagtctactaataaaagatacactaaattatgcaatcttctcagtacattctgaaaagcacattacacctttacttggctcaatgacatgttctaattcctaggagaagaatgtgcagatattctagttcatcaaacaaattttcctcattaaaacaactcaaagctcagaggagcgaacagtctaaactgatcattattctggagcccagatagttttcatctctaaaaggaactctaaatactacttaaatctcaaattcaacttctaactagaaaaatgaaaaaacaaacttagaagagggcacaaagcttttgctgtgaccatgatacatactttaaaacttgaataccttgacagataagcagagttatcacaaagaccgaatggggatagggtctacaaccagacatgagacatctgagtgctgtggtaaagctacaagccaaacatgaagaacgtaaggaagcaccatccagggcaattaactcaagatatttctatttttcctgcttggttataggtgcattataaacatttaagtcttaagactgatttaggggaaaacatttaaatgtttataaacaggcaataaaagcagcagtagagtctgacagagcactaaaaaagccacattattattaagtttgacacaactcatgagcaaaataacctagagttaaaggcaaggcatatatctaaatcagctcctctgtcaaaataactattccatactcccccaaccagacaaatgacaaaagcttctaagtaaaggctgaatcgtgcagggtaaacaacagcaaagcagcatcacttgaataaacaactagcaacaaaattaacaatcattttcacttcaaggcagatggcccctgaaaggtgatacttgcctcaaagtcctaactgatcaatagtcaaggtaacaaaatcatcatcgtcgtcatcatcctcatcatcatcatcccttgggtgagaaaagatgctgagaaaagtctggacaggagtcagcataaagcactgcttcccactccaggagcctcaggaggtacagtctgtccttactcccaggcagccaaggcagaggcccacggcctaggctcagtttgtaacatgcccactggtggtgactctccaaagaagtctcgaggtcacaagcggcaaaactacaggggaaaatcactggaaggactcagcttcagtggcaagacacatctagcaccatggcctcaaggctgatccagtggtttgcccacagctgctgcctctcccattgcccactcttttattacacaacctacttcaatcactgtaactagaaataaaatagccagtcagtttgtattatttggaacccagaagcctgaatgacaagcttcaccattacacagtcattatttcatttttattaaaattaaataatttctgaaaatttgttctgtgttttgattttaataagaaaatcattttcagtaggaaattagaaatgaacacaatgaagaaagtaacatcatttataaccccaccacctagaccgaaatacccacgaccactttggagcacactcttctaagctttcttccaaaatggacaacttgacaagagaacaaagcacgaaggcagtaagcaaacttgtggtctacggagtcattaggccggggcagccaggtaaagttatcatccaatacacttctaagaacgaaggggcttcattccacttctcctaataagcaagccaaaaaacatataaatcacagccatccctggcaaaccagagtgtacaattgcactacatatctgaatagtccagcctcctgattaggaaaccctactctagaaatagtcccattcatcagaagaggcaatgaattataaattcttcctatatagcacaatttaatcagttgttaaaaagggcaacaataaaataaaccttcctatgttataagcgacctaaaatttttatgaaaaacttctcaaacaaaagctacaatttaacatcagaaagcacaaagtatagatagcattccttccttcctattaagtcagaaaaaaatgtcattacaatttatctttgcataggtcactcaaataaaaatatagagagaacaaaggacatttttcctaaattatcaaggtatcactgaggcagttacatctagtccttctcaaccaaaataatacatctttgttttctcctcctgtaagtgggtcagagcccttacaaatgctggaagcagggaaacagcctgaacatcaaaatatattgtttcaaacatactcctaggagctgacaagatgttctgggatgagagcaaaaaaatggagccataattaacaaaatctggttagacggagtctgacttaaaaataatactccacaatataaagcaacaacagaaaccccactaaagtatggaaaatccaagtctagattcaaatacagtgatacatggttgataagaataagaaagccaattctctgagcttaacattgatcctgttaaactaggatcttcgcagcagtgtcagatttggcttcctgcctttctcagaaactacttacctacaggctattttcttacctcttttctcaaaatactctattttaaagatgaatcctgatgaaattccctatctccactgatcaaattctacttacagaagaataacctctggatcaaatacactgggcacaacataaaaggtcttactctgtttaggttgctataacaaaataccaccgagtgacttataaaaaagagaaatttatttctcacagttctggtggctggaagtccaagatcaatgtgccgacagactgattctggtgagggctggtttcctagctcacaggtggggccttccagctgtgtcctcatggtggaagatgcaaggggcctttctcagtcctctttataaggatactcatcccactcatgagagctatgtgttggtgatctaattgtctctcccaaaagcctcacctcctaataccatcacattgggggttaggaattcaatatatgaattttaggggaacatattcagaccatagcatggtcaaaagtaaaacttatttttatcctttcatggagcaatggtgaaataatcattctatctggaggaagtatggaatgaacatacattaaaacaattctttaaactgagtcctaagaatatagaagaggtatagaaatcatgtgatttattatgttttctacatataaacccttcctggacagaaattagggggcagtggaggaggagaagaaaaggaaaaaaaaaatgtttttttaattttaaagcctaaccatagattgtagtttcagaaagtacaaggagaagtgacaccaaactttgaacctcacttgactctaaaaatgggaagatctacaggtgatgagaaagaattgcactttgaaatggcaacttttaccatcaatttttttctgttatgttgcatattaaatatgctcaatttattatgggccttcaatttccacaaataaaatactcgtccagtatgtactgaaatacctatctgctaaatatttataaagtaacctttgtcagtactatgccagttcacagcctgcaatgttttattgttattattctgacttcatttgcctgttttttaaagaatgttccagtatcatttttacaaaattggagggaagggattgaaagcaaaaagatgtaagaactcttaagtgaaagcacagaaatggtgtcagaaaataaaataaattagctttaaaagaggctgcatggtaagaaaaggatgtaaactttttaaatgttgtttctaaggaactctaattttgatgccaaaattagatggtgacatattgaggtatataacaggactgtaaagctaaatttagatgttccttctttaaagcatccgccagctcctagaccacttattgaataggtaacttgtgctaaacagttatgtacattatttcagttaaagctcaaaatgtgtatgcattatagagaaactggactccggagaaggactccggagaaggttacctatttgccctaggtaaacatcagtgaccaagttcatatgaaaatcctgcctgactccaaagcatgtgatcattcctctaaatcaagttgtccctcataccatccacccctcttcagcatctactttatattgactgtccccttaaatcctcacaaccctatgtgaggtgagcattatcatctttattataaggataaggaaaactagcacaatgaggttaggcaactttccagaatttagcttctggtccctggctccaaagcccatatattctatccaatatattttgctgctttcagctctaacaatctacaaatctatcatcacgcaacaatctattcctttacaggaaaccatgattctgtgcaggaagatcgagtcagacgtgatatttcattaccagcccaactctcatctttctcccttcacacgttccatatcacctctcctcccagcaaaatgaccagacatcttctcatagattggcattactatcagctactccccctaccacacctatagatgaccataaacgatgaagaaaagtaggaggaaatgttcccaccaagaaaaggtcattggggccacttttacagtctgccatattctacctgataatcttactccaacaagcccaaggatcaggtcaaattcaatacatatttaaaataaaaatttaaatattcccattgtcattttgatcttatgtcattatcagctggttgacggcaggcaacatttctaagtctgtgacttcatctataaaatgaatatgatatcaaatgacccttcaaccttagagctctaagttaatctaacatacatcccctcttcctttgcctgcttgtgagaaagcagctgaaaatttggcagggtgcagtggctcatgccagtaatcccagaactttgggaggctgaggcggctggaatgcttgaggtcaagagctcaaggccagcctcgccaacatggtgaaaccccatctctactaaaaattcaaaagttatccgggggtggtggtgcacacctgtattcccagctactcgggaggctgaggcaggagaattgcttgaacctgggaggcagaggttgcagtgagccaagatcaccccactgcactccagtctggcaaaagggcgaggttccatctcaataaataaataaataaataaaaagcagctggaaatgtataagcaaaggcagataaaactcgacagtaagtaaagcaagtgatcattattaggttctgcaatatacacaaggacctactcagaggcaggtgtgcatgcacacatgtctaatctgaaacaagtgacaaaaacaatctagagtttattcttgccaacctgaaatgaatcacctatttttacctcatctgcattcaagagggggcccagactgatccaaaagagccaatgaaccatgttcaccattgagtctcgaggcaagccggatctccaatccttaaagtgacctctggcttgactgcagctatcaactgaacatgaggaatggaaagctacaaaagcctaaagcttaccacagaagtagcatttcaaatataaatctacttctgtattttattaattctggtagaaggtgaggccagggctcaaaaagcctggatatcttaacattctaatcgttttttattcttcttcttcctttttagagacacggtctcactctgtcactcaggctggggtacactaactcaccgtagactccaactcctggcctcaagtgatcctctcacctcagcctccagagtagctgggactccaggcccgctaccatcccagctcctttttcttttattatctgggtagataaggggaatccctatgttccccaggcttgtcttaaactcctggcttcaagcaatccttccccatcagcctcccaaagtgcagggattacttccatgtgagccaatgcaccccgcctacattctaatcttaattctctaaatctagatgatgacacttcacagttgaggagcctgagataggatcaaaggtggcaagattacaattaaaatcctaaagtcatttgtaatcccaacactttgggaggacaatgcagacagatcacctgaggtcaggagttcaagactagtctggccgacatggtgaaaccctctctctactaaaaatacacaaattagccgggcgtggtagtgcatgccttgaacccaggaggtggaggctgcagtgagccaagaccgcaccattgcactccagtctgggtaacagagagagactccatctcaaaaaaaaaaaaaaaaaaaaccacatgccaagcaatctcaaataacgaacggtaaatttagggctgtgaagaaacttgagaattacaatagactgaatttgcagcaagacaaaaaaaaattttaatttcagttacaaagatgttattatctctaaaccataacacaataagaatctgcagctcagcagattacctaaattcacacgtgagaagtggaatgaacaaaatttaccagtccaatccagagacctttgtcgggaattctggctgctgccatcaataaaatggaagagaaacagccaaggtaactgagttggagtcccaactctgccattaataagatgagtgtgcctccaaggttcagaacttgtgggtatttcaaacattgagtgggaacttctagaaggaaagagctgccataaagaagccccacgagggctgaagagctggcaggggtagagggcccaagtcccgtccgctggtcaggaggcttttccaggccaaccaaaaccactgtagtaggtggagaccccactgagtccatgagaacacagagaagttggggtaaaaccgctataaaaagaaacatttgcaaggctgttcagaaggcagtaaaacaaaaagatactgtccaatatttcctattaaaaaatacagggccgggcgcggtggctcacgcctgtaatcccagcactttgggaggccgaggctggtggatcatctgaggtcaggaattcaataccagcctggccaacatggtgaaaccctgtgtctactaaaaatacaaaaattagctgcacatggtaccaggcgcgcgcctgtaatcccagctactcgggaagctgaggcgggagaatcgcttgaacccgggaggcggagcttgcagtgagctaagatcgtgccactgcactcccgcctgggcgacagaacgagactccgtctcaacaacaataaaaaaatcccagagttccacgcggcgccagccccagcgcgccagggccgcctttggagagcagcagccctggctctgcgctaccctatggccgtgggcctcaacaagggccaaaaggtgaccaagaacgtgagcgagcccaggcacagccgccgccgcgggcgtctgaccaaacacaccaagtttgtgcgggacatgatcccggaggcatgtggcttcgccccgtacaagcagcacgccaaggagttactgaaaggtctccaaagacaaacgggtcctcaagttcatcaagaaaagggtgtgggcgcacatccgcgccaagaggaagcgggaggagcaaagcaacgtcctggccgccatgaggaaagccgctgccaagaaagactgagcccccttccctgccctctccctgaaataaagaacagcttgagaggaaaaacaaaacaaaacaaacacacacacacacacacacacacacacacacacacacacctctttttcttagtatttcctaaccaagtgggaaagaaataaaaatctttattcaaataaaatttgtgtctataggccaaagaacgtgctaggcaccagaaacgtgaacatgagacagttaaagctccttgcgtctcgagctagtggagtgagaagcactgagtctcagtacaaaggtctagatggtgctctaggaggcagcaggaccctctgcagtgggatggtaagggcagcgtgcaggggacatggcatcttctcagtgaggtccaggcagagggaagtacacattatgaagataagaagggtaaaagagccagaaatggcaggatcagtgaggactttagataaagaggaccaccagactgtgaacgacctgttttaagctatattaatgagtctcttttaggaatataattctggggatgatgcaaagggcggaggaacaggaagagaggctagtgaacaatatttgagggcaaatgaggaatgacagatgaaagcagtacagcgagttttgacggaagcatttggagaggactcctgcaaagaaaccggtaggatctagtgaccaactagatacagactacgggggaaaatgaggagataaagtaactcgggcttctgcatttagaaaacactttttttcccctcaagagacaagttctctctgttgcccaggctagagtgcggtggttattcacaggcacaatcttcatgcactatggccttgaactcctgggctcaagtgatcctcccacctcagctgccagagtagccacaactacaggcacacatcatcgcacccagctggagacacttttaaaaattaaatagcagagtgacaaaatgttaggtcaccgcgaggcaggataaagcctgtgggccccactgttgtagaccctggcaattaacaactagcatgagtaggaagcctggcagagagaggataatggctctagcagctgctgcaaaaagaaaagctggaaggttacatcggcaaaaatccttactatttgctagagtaagattagggaacttaattctattcttacatagaccttacaaaatttcttgttgccttctactttctttcaaagatatttatgatgttcatttaaacacagacagaaagttacacacagagtaatttctgtcaccgaccccagagcccctaaggacagccataaaccaaaaggaatatttattccctccccctcaccctgcaacattttacaagaaagaaaactgaatgaagcacaggccatatgatctatctttcattacggtcaggaaagattagacaagataatgagtttggtttagggccagttatatttgagatgtcgacagacatttaggtagtgatgtaaagtagacagctggacatatagatctgtggctcagaatacagagctacagatataaatgtggtagtcaccagcccacaaatggtattaacaccatggaaacagatgcgatcattttcaaagagaatgcagatgagaagagcaacagacctacgacagtgacactgaggaagggccaacatttagataaaaccaacaaagaaactgagaggtactgctttgggttcaacttctatctacttcttcactaatcaaagacagaaaccttttctattaaagcatatatattttttttcagtgccaaatactgaagtattggagtactgaagacaatcaactataaattttaacaatttcagtaagttgccagcagttagtgacagcaatctttcactttccctgaactgtcagagagaaatggattccacttaagtgacatttcccaataaaggaagcttttccctttttgtgaacagctcatagctcaaattcttccaagagccaggcaggtgagtgagaagcactaagattcagacagtaaatgctgggtcctagttctactggagtgggcctgtgcctcctaagggcattcacattcagtcttctgtagagaaaacttgagggccctggtacttgcggtaccatgtgacctagaaatccaaaccatgcttccatgggctttttaacgactgcacaaggccacatagtaacaaactttcttacatttatcatctccaaggtcttttctccagctattaaccatttttctctatatactaactaagtcctcataaactctgtgttgtaaaagagacaattcaaaaaatgatcggttctgtggcttgggtaagttatctcacagcctcactttttcgtctgtaaaatacagatgattaataatattgttatgaggactaactgaaagcgtgcttgaagtgaggtcgttaatggtgaggaagaggggaagagaaggtgagtaaatgacgatgtcctttaagtacatcactgatgatcaaagtgccaataatgcctacacaactacaaataacaccggagtgccatacataccaaaaaacacacacacacataaacacacacacacacacacacacacacacacagaagttataccttttcttggtttttaattgttcaaagtttttaactattaactgaacaaaatatgacaattaaatggtacctaacaaaatgcatcactaaaaagaagaagtttaattcttggtattttaattgactgtattaaccacctattttttttaaaaaaaagttttttatttttatagagatggtacctcactatgttgcccaggctggttttgaactcctgggcttaagtgatcctcttgccttgtgactcccaaagtactgggattatagggcatgagctgtcatgcttggccttaacaatcttttttttttttttttgagacagagtttcactcttggtgcccaggctggagtgcaatggtgcaacctccacctcccgggttcaagcgaatctcctgcctcagcctctcgagtagctgggattacaggcatgcaccaccacacccgattaattctgtatttttagtagagaggggtttctccatgctggtcaggctggtctcgaactaccaacctcaggtgatctgcccgcctcggcctcccaaactgctgggattacaggcgtgagccactgcgcccagtcggccttaacaatcttttaaatcatctccggaaaaggttggtactacttaaaggaagcaaattttatagtcctaaaaagtcagaatcacatttatatttaaacaccagtatcctagcctaagaaatcacacagttctcttcagatagaaaagaactggattaggggtggtggcacaagtacttaattccaatactttcagaggatgaggaaacaagattgtttaagtccaggaatctgagagtagactgagcaacacagcgagatgccatctttacaaaaaatttaaaaaaaaaaaaaaaaaaaaagtcaggcatggtggtgtgcacctatagtctcagctacttgggaggctgttgtgggagaatcatttgagctccagggttgaggctgcagtgagctatgatcataccactacactccagcctggtaacagagcaagaccctacctcttaacaaaaaacaaataaacaaacaaaaaagatttgaaactaaaaattcaaaggttagtccgggcgcgatggctcacgcctgtaatcccagcactttaggaggcccgaggcaggcagatcacgaggtcaggagattgagaccatcctagctaacacggtgaaaccccgtctctactaaaaaatacaaaaaaaaattagccgggtgtggtgttgggcgcctgggctgaggcaggagaacggcgtgaacccgggaggcagagcttgcaatgagccgagatcgtgccactgcactccagcctgggtgacagaccgaagctccatctcaaaaaaaaaaaaaaaattcaaaggttaaaccaggctggtctaggagagggtggaaaataacaaaactgtcaattctgtccacgtgtgctagttgtgtctgttctatttgatgaccaaggacatcacacctcgtctctcagccttcttgaggcatataaatggaagtgactggagaaaagacatgaagagcacatcctgtttcacacatctgcagcctgatgcgggccaccttgtacatataaacaatggacatctttgttgttcagatattatactctgaggcataggggtttggagctccaaaacatagcttttagagcatctctaatattaactggtatgtgacattcttaagtcatacacttactggtttttttaatctacaaagtgagaataaagccatctacattacttatcaacaaggatttttttaaagaactaaatagtgaacaggaaaatgctctgtaaaatgaaaggcatttaagttatttcttccctggctaggacacagctagaagaacagtactagtataatttaaaataatcattcttggttttcttaaagaacagaaaaaaaaaaactggtcaaattcctttgtactaagttcccagactctaaatgcctgaatttcaaatactggaagttatcagtttataagaatcccatctagaacctgagttgtatcaattcaccattttgggcatcagtttttctatctaatgtataaaacaagggtgtaagatgacccagacttccatgttcttttcttgctatcatgctttttcattccattcatcatcctatatatgtctggtcaaaatcaagcaataatagttaaatgcttttgaatagcaaataaaaaatattaaaatgctacatcattcataaatgaacttttaacttccaaaacctcaactatactaaagttaaaaaaaatagtaattctcaaatgtggagattcctcctaataatctattcttacgcatatgacctagaatgaggatgacatatgatatgtaaatatttttctcatatgagctcttgttgcccatgtgcctctcaaagcatgaccatttcactgagctaagcgttattctactgttaaaaagtcgtggctactttggccaggcacagtggctcacgcctataatctcagccctatgggagtccgagggaggtggatcacctaaggtcaggagtcaagaccagcctggccaacatggtgaaaccctgactctactaaaaatacaaaaaattagccagacatggtggcaggcacctgtaatccctcccagctactcaggaggctgaggcaggagaatcacttgaacccaggaggcggaggggaggttgcagtgagccgagatggtgccattacactccagcctgggcaacgggagcaaaactctgtctaaacaaacaaacaaacaaacaaacaaacatactttgtaccacatgcccttacatgcaaacaatgcaagaaaaaaaaaacaaaaacctgatgtgttgcatcactggacaaaagttggctgtgttggatttacagaagtatgtcatcagtcactgtaatttcacatttggagatatacaggttttcccttacatgcatgcaaaacactaggccactgactcctaatagggatttttaagttcgaaattacaaaatgtaccaaatcacaccaaggaactaaatggagccttgttcttagaaaaagttaacttcagtagatctactttaaaaacatttaaattggaagaatattttttggaaaatgcttgacttgtactgatctaaaagctcttctccaaattcatcatgaatatctggtccaaagaatcggaaaacctttagtggtccccataaaacctgtaattccattaaacaagtagatgaaccgcttaactactatgataatcagctccatttttttcaccagctgttaaatcttttctagcaactctggggaggcaagggataataactttgtttttcttcaggagctagaggtactgccaagcagagcctaagctgccactaggaacatggctgatattagggcagcaacagcaacagaagctactcaggggtacgtggcagtggaggaatgaaatgaggatgaaatggacactgcacaactcattacacccaaacacaatttcttcatttgtgtactttgaaataaatacttacatctatgttgaaatgaagtaactataacaggacaacgccatagcaataaatacatcaatacaccttttccttcaacaaaaggcaccccaaaaaactgacagccctaaactgaggcaaaggtcacatgtaaaagatctggtgtttcttatatcacaggcacccaagggttcctctagagaagtctttcatttattcaaacacagactgtcaaattataactgatgaatactcagtaagaaaggaggcaagcttttttcttttctttttttagagacagggtctcactatgttacccaggctggtcttgaactcctggggtcaagctatgctcctgccttggcctcccaaagtgctgggattactggtgtgagccactgtaccctgccacaagcattttttatgaaaaagactgggctgaacagcaacaacaaaaattctttcctctaagcttaatcccacaaggcttccttttcaataaatgaatataataacacctaccatcatttaattgtaaaccttccacagctctgcattaaacagaggcttctcctacaggctaaagattgtgctggtctcaggaaaaagatgtcctttttgcatactgggcccaaagagtattttaataatcattagtaatcaccatgtgggggtgtgtctggtgatgggtacaagaattgaaatttgaatccaaatttgggggttttgtattttttgtaagctctagctagactgaatggcaacaacaaactgaggctaaattcagtgtcgtggcttgagggggaagaaggagctgactaccatcataaaccataatttctctactgacctttatctcttttatcagacaacacagagttcgtctatattaatttatctttccctttaaaactgaacatttaagaaactacactccttttactttaaaactgttttatgttagtagaacattaaaaagaggatataacaccaggcaagtaatatgatggcagataactgaatatttttctccttaaatgatgacagaaaattaagcagctccttaaaataaaaaatgctcaaaataactttatacaaggacaaataactgagtgcagtttcctttaaattactaatttgagttacaatgaaggaaataaactcttgcctgtaaaatataatactgtcaggatagaaagggcaaaagaattttaaaaaaacaaaaacagagtagggtggagcttaggaaacaaagggcaaaaggaagcaatattcatttaggaactaaagaacaataaaggaaacaatcttcatttctaaatttaaaaagaaaggttaaaataacagttcactggcgttctcatctgaaaagaaaaagttgagtggtttttgaattttaaaattaggtaaaattaaaaatttaatccttcaatcatattagccacatttaaaatgctcataggttttactgatattatactatcttccatcagtggaagacagactgcccagaaattccacttaggcagcactggcctaagtattttaaacaatttatagaaatgatactttatatatccattgagtaagaatttctgcaacaaaatgattagtgaaacattccaattatcatctttcttttcttttttttttctttttttttttttgagacagagtctccctctgttgcccaggctggagcccagtagtgtgatctcagctcactgcaacctcctgtctcccaggttcaagaaattctcatgcctcagcctcccgagaaagtgggactataggcacgcaccccacgtctggctaattcttgcatttttagtagagacaaggtttcatcatgttggccaggctggtctcaaactcctgacctcaggggatctgcccgcctcagcctcccaaagtcctgggattacaggcgtgagccaccgcgcccgacccaagttagtatctttaagttaggatttctttaatcataattaactgcgtaaaacctaggaaaaaaatacgtaagacttaacaggtcaatcacctgtctttagaaagaagcacctctaactatggtactccatttcgatgtttaatacccccagtgtcaaggaattcatccactctctgtcactcattgtaaatgctgccataatattcccaccaatttccagaacagatgaataatatcttgctgcaaagtctacagcatatcttatagccttccatgctagggggaaaaatatatttctttagactttctttaaaagaccttacttcatgcccacaggaaaatgtgcatgtattatctacaaacatccttgctaaaacctttcaatggctcttggtaaacatcagcataaaattcaaagacctttctttgccacctggtcactatatacccctctcatctattttcccatcctctcctccatctcttttcccgcttatgcaagtatttagagtttcaagatggtgccacaatgtttcatttcaccctgatttctcagatgctgtttcctggaatactatttagactagatccaagccgtcctgagactacacagagagcacgcccctgtcccccacaaaagtaattcaaattccagaaagaaaaatgaaaaggtcttgaccaaaaaggtgattacattttagaactgtcttagaaggggaacaaaattaagtagtaattttattgtagtgcaacaaaattaagtcattgaaaatatattgagcaaccaatcatgaggccatggttgaaaaggtaaggttagagaatcttaattcctgtacatctttattttaaaaaaaaacaaacaaacaaaaaaaaacaagccagccatctgtgttgaatgttttgtcacctgtttagagtgagaggcttgaatcacataacttcttgaaatccttacaaaatttagattcattagcataaatagaatacccaaattttctcagtgactatgtcacttaactgctaacatcaatggctcatttagctgtttcgtaaatgcttgactgaatataagaatctattgatgaatcttttacctcgttacagctgattgtactgatctttgacttacccacacccaattaacacagaaagtaccacaataatacttaacttttactagagtaaagacctaaagaacagagactagtaagtcaacactatctggaatattcttcaatgtcatctatacgacattcagaaagaggctgttttgagaatttcaagtgagggtgtaagttaaaaggttctcttatacactgccaatgacaacgtaaagatgtatctttctgaaaaacaaacactcctttataaagagccttacaaattggcttcacaagtgattccatttctaagactcaatcaataaaattatgtacatccatccatatcatgaactcagttctatgcaacctttataaatgatactacagatgattatttaataacataagaaaatttgcatatgttaagtataaaatgccagtttgaaaatcatttctcagtatgatactggattgtacggttggtgatgatgttatcgttgaagtacatctgcttgttttttttttgttgttgttgttgttattgttgttgttgttttgagacagagtctcgccccgtcacccaggctggagtgcagtggtgtggtcttggctcgctgtagcctttgcctactgtgttcaaacaattctcctgcctcagcctcctgaggagctgggattacaggtgtacaccaccacacccagctaatttttgtatttttagtagagatggggtttcaccatgttggccaggctggtcttgaactcctgacctcagatgatccacccgcctcggcctcccaaagtgctgggattacaggcatgagccactgcatctggcccatctgctttttatagatcttagactaaaacaaaaaattggccagaaaaaattaatcatggtgactgaactttaatgattaacagctcagtgccttatcatcattttatctgaaatttctaaaataaataagcatttaagatatgtagaaaaaaagttatgctaaaatgataattaagttagaggaaaaggtttggttctaccggggaaactaatattgtttctccttacagatgaaaagagcaatgttaattatttccttagtatggctgtcaagaagcttaaagccaattttgttagtcacctttactagttgcacagcaaatacccgtatctgcgtgtgcatctgactatcctccatcataaccttctactgtgatctgcattttctctgacccccttttttctactgcattataggtagttatcaaactagtctcaatatatttcctggggggagggtaggtgaagggaggaaaagacagatggaaaagaaggaaaagggaaaggcggggaataatgaggtggcagttttgaaaacagaacatttttctacctccaccattttcagattatttataaagcttaagttctaccatagtgggtacataaatatttacagaacaaatcaatgatatccaagttgagaaacgcacatctaggccaggcacagtgactcttgcctgtaatcccagcactttgggaggctgaggcgggcagatcacctgaggtcaggagttcaagaccagcctggccaacatggtgaaaccctttctctactaaaaatacaaaaattagctggacgtgctggtgggcacctgtaatcccagctactcaggaggttgaggcaggagacttgcttgaacctgggaggcagaggttgcaatgagtcaagattgcactccagcctgggcgatagtgtgagtccatctcaaattgaaaaaaaaaaaaagagagagagcgagaacaagaaaaatgcacatctgtcagggctcttcctattacatacagttaataccttattgaattttgtactgttattttagtatggctattagagcagtgatctgcagtgtttggcatgcctcaaatgtcagaaaaatccagagacacacctgtgagcatcaagataattttacttccattatttcaatctacagctaatgcttagtaatcacagtatttaaaaatcccctacaataagtctgcacaagtctgtggctcacaaattgagaatcaatgtgctatagcacagaagaaaaatatttaccataggctgaatctgaagaggagatactcttattgttaaggctgttttgagttactgttttgtttctaacttgcaccattatgtatgtatgtacgtacgtatgtatgtatttttagagacagagtctcactctgtcacccaggctggagtgcaatggtgcgatcacagctcactgtaacctcaaactcccaggctcaagagatcctctcaccgcagcctcctgaattgttgggactacaggtacacatcaccatgcccaacttatttttaaattattttgtagagacgggggtcttggtatgttgcatgggttggttttgaactcctggcctcaagcaatcctcccactctggtctcccaaagcacttggattacaggaatgagccactgtgctcagccacacaagcatttaaaatgaagagatttgacataaaaatccaaatgttcaactcgtaaaaaaaatcacaagagcaggcaaaacttgcccggtatttctacacggcagcaatcagcaagagagccgatcagcacccacatctagatggtgtcatcatctccagtttctgtgctccccacctggctgtagccactcattggacatactcttggtaagcaactgtgtttgtaacctctttaccataccactcatcttttaaagtaagtttcccagaagtgcaattattagttatgtgcaattctttctaaggagtgccaaaagctactcactgtagtgttgtccattagagtacttagcactgcatgtccaagaaacagaacaaattatgccaggggccagccacccacgaatgtgtcttccatgcaaggtttgtacactgatattctgtacaaaacctacatttctgtgctggctttgtggctccctgatttccaaatcactaagtggctagtgcatagcagctgctgaaaaaaatgctgggtggatggataacaaataaaatctactaaaattagtcttaatttcttccagccccagtacataaaagattgttacaaaaggaatctgcactatgactgttgaaagtagagtttttattgttgctattgttattataatagctgctcacatttgttcagaacctccctgataaattcatcataatctacattgctggagcagaagaggatcccaaagagaagaggaagtgccactgctgacatgcaaaattatcttaggtgatacttgaaacctggtattgaattacactgaatcaaatactgaggaagttattccttttccgaggttctttcaatctgtctgggtgtatgagaacaactctcactttggtgctaacacatatttatgtccctttatgacacctgcaaatttaacttcccttgtaaacacagagagcatatggctcaggcttggagcctttatcagacaacagaatctagacagggtttaacagtcatttttttttttaaggcaaacaatacaggttctctattgctggtggagacacaaagattcctttttaaagaaaattaagctttaaaaagcattaaaaggttttacatttattttaagaaatttaaaaataaaaaagaatggccgggtgcagtggctcacacctgtaaacccagcacattgggagtccgaggcaggcagagcaagaggtcaggagactgagaccaccctaacacagtgaaaccccgtctctactaaaaatacaaaaagttagccaggcgtggtggcacgcgcctgtagtcccacctactctggagggggaggcaggataattgcttgaacctaggagacagttgcagtgagccgagatcgtgccactgcactccatcctgggtgacagagcaagactccatctccaaaaacaaaaaaaaaaggaaagcatgatatgaggccaggtgcggtggatcacgcctgtaatcccagcacttcgggaggccgaggcaggcggatcacgaggtccagagtcctacaccagcctgaccaatatgatgaagccccatctctactaaaaatacaaaaatcagccaggcgtggtggcatgcacctgtaatctcagctactcgggaggctgagacaggagaattgcttgaacccgggaggcagaggtaatagtgagccgagatcatgccattgcactccaacctgggtaacaagagcgaaactcggtctcaaaaaaaaaaaaaaaaaagaaagaaaaaaagcacagtgtggagtgcaaatgtgacaaaaaaacaccaaggtgatacacaaaatactaatatttgggatgtaaatgactatgttttatcagtccagcatcatcctgataccaaagcctcgtagagacacaacaaaaaaagagtattttaggccaatatccacgatgaacactgatgcgaaaatcctcagtaaaatactggcaaactgaatccagcagcacatcaaaaagcttatccaccacaatcaacttggcttcacccctgggatgcaaggctggttcaacatacacaaatcaacaaacgtaatccatcacataaaaacagaaccaacaacaaaaaccacatgattatctcgatagatgcagaaaaggccttcaacaaaattcaacagcccttcatgctaaaaacgctcagtaaactaggtattgatggaacctatctcaaagtaataggagttatttatgacaaacccacagccaatatcatactgaatggacaaaaactggaagcattccctttgaaaactggcacaagacagggatgccctctctcaccactcctattcaacatagtgttggaagttctggccagggcagtcaggcaggaaaaggaaataaagggtattcaattaggaaaagaggaagtcaaattgtctctgtttgcagatgacatgattgtatatttacaaaaccctatcatctcagcccaaaatctccttaagctgataagcaacttcagcaaagtctcaggatacaaaatcaatgtgcaaaaatcacaagcattcctatacaccaataacaaacagagagccaaatcatgagtgaactcccattcacaattgcttcagagagaataaaatacctaggaatccaacttacaagggatgtgaaggacctcttcaaggagactacaaatcactgctgaatgaaataaaagaggacaccaacaaatggaaaaaacattccatattcatggataggaagaatcaatatcgtgaaaatggccacacggcctaaggtaatttacagattcaatgccatccccatcaagctaccaatgactttcttcacagtattgggaaaaaaactactttaaagttcatatggaaccaaaaaagagcctgcattgccaagaaaatcctaagcaaaaagaacaaagctggaggcatcacactacctgacttcaaactatactacaaggctacagtaaccaaaacagcatggtactggtaccaaaactgagatatagaccaatggaacagaacagaggcctcagaaataccaccacacatctacaaccatctaatctttgacaaacctgacaaaaacaagcaatggggaaagcattccctatttaataaatggtgctgggaaaactggctagccatatgtagaaagctgaaactggatcccttccctacaccatatacaaaaattaactcaagatggatgaaagacttaaatgtaggacctaacaccataaaaaccctagaagaaaacctaggcaataccattcaggacacaggcatgggcaaagacttcacgactaaaacaccaaaagcaatggcaacaaaagtcaaaatagacaaatgggatctaattaaactaaagagcttctgcacagcaaaagaaactatcatcagagtgaaaaggcaacctacagaatgggagaaaatttttacaatctacccatctgacaaagggctaatatccagaatctaccaagaacttaaaccaatttacaagaaaaaaacaaccccatcaaaaagtgggcaaaggatatgaacagacacttctcaaaagaagacatttatgcagccagaagacacatgaaaaaatgctcatcatcactggtcatcagagaaatgcaaatcaaaaccacaatgagataccatctcacaccagttagaatggtgatcattaaaaagtcaggtaacaacaggtgctggagaggatgtggagaaataggaaggcttttacactgttagtgggagtgtaaattagttcaaccattgtggaagacagtgtggcaattcctcaaggatctagaactagaaataccatttgacccagcaatcccattactgggtacatacccaaaggactataaatcatgctgctataaagacacatgcacacctatgtttattgtggcactattcacaatagcaaagacttggaaccaacccaaatgtccatcaatgatagactggattaagaaaatgtggcacatgtacatcatggaatactatgcagccataaaaaaggatgagttcatgtcctttgcagagacatggatgaaactggaaaccatcattctaagcaaactatcacaaggacagaaaaccaaacaccacatgttctcactcgtaggtgggagtttaataatgagaacacatggacacagggcggggaacatcacacactggagcctattggggggtgggggactgggggagggacagcattagcagaaatacctaatgtaaataacgagttgatgggtgcaggaaaccaatatggcacatgtatacctatgtaacaaacctgcacattgtgcatatgtaccctagaaattaaaaaaaaaaaaaaaaaaaacagtatggagtgcaaatgtgaccaaaaaacaccaaggtgatacacaaaatactaatatttgggatgtaaatgactatgctttaatgttgccattttggcacagagatggaaagtgtccaaatttaatttccattgtatattaaatgaaaaataaatgtaacaataagctgtgcgcttttatggtgacagaaaaatctggccgggtgtggtggctcaagcctgtaatcccggcactttgggaggccgaggcgggtggatcacaaggtcaggagatcgagaccatcctggctgacactgtgaaaccccgtctctactaaaaatacaaaaaattagccaggcattgtggcgggcgcctgtagtcccagctactcaggaggctgaggcaggagaatggcgtgaacctgggaggcggagcttgcagtgagccgagatcgcgccactgcactccagcctgggcgacagagcaagactcgagactccatctcaaaaaaaaaaagaaagaaaaaagaaaaatctaagacctgtaaccttgacagtttgtaacaaaattatcttatgattatttattaatctatgccaataccacagaaagagataactccccataccaagaaagtcttcctataaagctcataatttgtaaaatgcaaatgaacattatttgttttgttgacattttgtgatgaaagcacttctatatataagatcataaggtggggttaacagtgagtaagccagtaagtagaccaaatgtcactgatacgccccactgtcaaacagcagctgtgacaaatgctacaaaggagaagtacatggtactgtaatttgatacaggcagagcttccttgagacaggaaggatgggaacagcaaaacagccaggacatgaccaaaggaagagatacatgagacaaggctggagagggagatgaggacagagaaaagaggtactcactgacccaggtatggagtttacctaactcccaagcacaaggggaagacagctgaaaggttttaaacgtggaatgacctacctgatcagatttgtgttctgaaaggtttgctctggctgtaatgtaagcaaccctccagagaagcatcagtaaacagacagaatcaaaattgattacaaaataatgtagaaactactacatctagaccaaataaataatggccaacagaaaacctgatcagaacattgtccagtctttcattggaaactaacactacacttttatttaggtatatgatacataaattttagagactaggaacagcttaaaacttaacacttcagaagctatcaaaatgtcatgatttcttggacagacctaaggtggcctacctacctcaagggctttaagtaaagaggactggagctcgaggaagtggctccaaggcggacggctaagcatcaaaaactgcggctctgatttacattccccagctcccaaaccaagcatcttctttatatattttacatgataacttcctattaaggtttgacgaaagaaggttttgctactgaaaccaagtctgaaaactaatgttaatacccacggcctctagtacccagttacaagactataatcagtgggaaagcagtgcctccaacaacaacaccctagggtcacttactggtctatgcttctaattctgttccccctcaggaacgctcatgttcagaaatagtccagtttctacttctaatcctcctcaaaatggtgcaaactctgggtaacactggtagagccaccagaatgctaacaaggaaaaaggaagggagaaatggagggaaaggtaagagaaggaaaaaaatatatacaataccaaattgaaaagaacctggagcatacacagttggtggaagtatagagtggtacattcactttggaaaactgacaatacccactaaaactcagcaactgcactcctaggaatatattaaacaaatgcatgcaagcttcattaaccaaaagacatgtatggaaatgctcacggcagactgggcaaggtggctcacacctgtaatcctagcactttgggaggctgaggtgggtggactgaggtcaggagtttgagaccagcctggccaacaaggcaaaaccccgtgtctactaaaaatacaaaaattagccgggcgtggtggcgcgggcctgtaatcccagctactctggaggctgaggcaggaaaattgcttgaacctgggaggcagaggttgcagtgagctgagatcgctccactttactccagcctgggcaaaagagcaaaactccatttcaaaaaaaaaaaagaaaaagaaatgctcatagcagcactattcctaataaccacaaactgtaagcctcccaaatgctcattaatagaatgaataaactgaggtatattcatgaatactgtacagatatgagactgaattaattacaactacacacaacaatatggatgaacctcacataggtaacctcacataggtaacagaccaaaagcttatccagagggtttctatttatataatgttcaaaacagatacaactgaactgtcatatgcaaaaaattgaatctcaatctttaccttaatactaaaaccccaaatgaatcacagacttaaatgttaagatcctaaaactcctaaaagtcaatctagcagaaaatattagtgaccctaggcttggcaaagatttcttaggcacaacacacacacacacaaaacaaacaaacaaaaacactgaaaaaaaatttcaataaactgtatttcataaagatctatgatctgggtactattccatatacgtatcttcaatgaaaatactaacaaaaattaaataaagaattgagtgatgagaagacaacacaatcaaccactatgtcatctcattaaggaacaagtacacctctacaaggagagaaagaaagccaacagtggcagagcaggagttggaaaagggaaaaatagttatcaacaaatgtttttcctagtctttgcattgcaacggggggagaaagggaaaacaacgaagaaagaccctttggttctcctcctataactgctcttagtccaccacacatcataaaagaaaatatatcaacttaagagcaaatcaaagacatcttggtccaggatccttttccactgaatgccctttacttctttctctcttcatctggtaccttcctcacttttgaattttttcccttcctttctccttatttttccaggtatagctttttgctctccgcatccacacatcgctatgtatcactttcacctttgcatacgaggcaccaaaataagaagagaacaattaaaatacacacacaaaaacagcctgggttccttatggatttgaaatacccttatattggagaagggacaacacacaatctctatcaattctcaccaatcctttttattcggcattggtagaatataggccacagcataaatattactatgacactttttccctctccgcttctctcctctcctgaacaagacagctacagtttgtgaattcagtattggctagctaactgaaatgttaaggatctaggctaggagttcttatctattgagctacaagtataaagactcccttttaaacactaaaatacatcaaaaacccacaaacatgcaaaaagaaattatcctttccgtatctgttccctgagaaaatgcaaacctatatagcactgttgtgagttgttaatttttagttcattgtgaactttatcaattaaaacaacatccactcacactgaacagcagatgtgggcaatgctatgtgtgaatgcagtctcagcttctcagatctcctcatctcacaaactcctcagccctccttgggtttacctaggcagactgggaatcagctctgaccactctgggctcaactttctttactgattaagaattgtacaattttgttacctgagttccctgaagaaatagcaataaagtttgacaaaaatgatagtacggtaaagtaccttctgttcacacaggattcttctgggatgatttattaaacagttctcccaataaccattccttctacacacaacacacacaccccttccctctctttctcttcacctaaaaagcactcagaactggtatctagactgtttaataaatgattagagtcagccctccacatccacagatttgacccactacagatcaaaaatatttgggatataaaacaataaaaaataaaatacaacaataatacaaatttttaaactataatataacaactatttacagagtgttttcattgtattaggtattgtaagtaatctagagatgttttaaaacatatgggacgaagtacacaggttatgtgcaaatactataccattttacatgaaggacttgagcatctgtggattttgatatctatggggggtcatggaaccaatcaatcccccttggacaccaagggacaactgtactacacctttttagctattatggttattactactactactctcccccacgcacattaccccataaatcccagaagtgctctagctaagaaagggcaaaatgaagaaacgagaacttgaaaacctagtttttttaatcagatattcacatttattactgtaaacaggagtaaacaagggagtaaaaatgtgtctagcaccgactctactatattcaagatgaattcattcattcaacaggcactcaaaaaaaaggaaaatacctgcagtaggatttacccctaaaatctccagagggtactgtcttgcagcaaatatcttcctcgtaactattatatacatcatttttcattcatcattaggcattttttttaaaaaattcattcaatagcattctctgctcttaattttttaaatggttatgctgagtttttttctctctcttcaaaacacaaaaccaaaaaataaactaacgttttgtaaccctgatagttttgatcttaggagtcagccattcagaacagaagtactccataactcccctacaaaatggcactcttcagacttccactgttcctttaaaggtaaaaacataattttagatttcaaggtgttattgagatctattaggataacgtatttcccaatttagccccccaaacaaccttcaaattccattataattttacttcaaatcgtatgtatatttttcagtgaaggactcttaagattctacaaaaataaattaggttgttttgcttttcccattttataaaattgaacaaaaacaattcaaccaatactaagctcttgcaagactagcaattcttttaaaaggataaaaatgagatgaaaaattactagaaataatcacatcagggtttttgtatttatattttgtatttagaggtacttttctctacccagttttctgaattatcaaaagataattctatatactgcaggaacaaaatcagttgtggtgaatgataacttttggtttgcttacaatcaagcagtttctcccctgctaaagaaagaagtcagatttcttcaacctttctaccagtagacagatgggaacactgactatatgcaaattccaaatatctctaagatttagagcaccatgcctcaaaccattaacttattttttttttaagtgaaagcaaaaactcttaaaatgtagctggactggtgaacaaggaatttaagaatgtaatgataatgctacatgatattgtaaggtgttaaattcctggacaggatatagtgttacaagccataaattctttttaaacttcagattcttatttttcaagttcctccaaacaaattaaaaagacaaatgatttgactgttcattaccatatgacttttaataaaaagtaggggcaagggagagtaccttcttgttgtaatatatctacattaacgaaacaacttctatgtttgcaaagtgttgtctgatttataagctacatttatcaaccattaagtcaggacagcataatggccatgaaataataatacataaattaagtaatctctggtaaaactgtgcatgaagttatcagaagcaatagtggctgatttctaaactttaaaatcatgaccacatgcgtcctccctttccttcaaataaccaccagagtgtaggtaagtaaataaataaaatcactaaaatatcttagaatatctttccttacagaatgtattttaaccagaaaacctcatccactcctaatttgtttctcaataatattcatccactctgtccaaccctcaatttatcagtaaagaattcatgatattccaaaaagctaatgtaattattactgtcatctcattaagtgtgctcttcctagtaccaaactctaacattacagctgatacccagctcgttcactatgcacaccaccctcttctacccttcccatcaccaccattttactggcagaatattcacaaggctgaagactgtttctcatctcagcaaacagaatgcttaagatcagatggctagccacaaaccaaaagttagaagccacacaaaaataaacactagcagtcctaaaattttctactttcagtctctaacaaaagcagtaacatcatttttatttgtgatgccctaagttagagccataagctttttcccctgattatactaataaatcaatttaaaatgataattttacatcagattatgtccttcatatactagcatactttaaataaatccattttaccatggtaggttcttcaactcattttttttgtattttttctgtatcattccttaactaccacattatttctccattatttttctaaatattacatctatgaacaaaaaagataaccctgcaaaccctagaaaagataaatcaacatataccttaagtataaaatatcaatattaagtataacctattaggtaaccaagagaaaggtaagcatcaactgtatgcccaggaatctcaatttaagacatcatgtagtatacactattttggtaaacagaactgtatacaatatttgcatatcaaaataggcaactatagccttatttctgacttcagataaaaatatcttaattctttttataaggcaaaacagtcattttaatgaaatatctcttttcagatataatcatatgattgacagataaaataattgctttaaaaatacttctgagtcattttgtccttacctgcaggcatgaaccattactgcatgcagtgactgttccatttcctagcacagacttgaagaagcatcatatctctcttacagaatgtgactaatctgtgggtttgcaattcctaagctatttacaaatggcactcccttaccatataagaataaatatttattacaacccaaaatcaagtatttttaacctacattttacaaataaccttcgtaattctgtagagcagcaacctcaacatataggaagaaaacctcacagcatttccctttaaaaaagcaagatttttcttttctgctttttagctaaattatttttaaagccttcaacagctgtcacacatgaaccagcggtctgctgtgttatggtgtgcatgctgcagctgatcaggctccactatttttcttaaaaaaatcaatcaccctttgcaaaagcagaacagcttgccccaatacacatcttcaatacagcacaataccagcatgcaggacaatacgttatatagcaaacttgacaagaaaaaaaaatatgtcctggtttgtttcttagcaatgctacaccattaattgttcatgcaagagatgtagctgtacctttctgaagaggacgacttctcagagttaactgacatcagcagctcaatcttctgcttgatttctggaaaaatcagaaaatattcacaaccaagattgcctgcccttgctttcaagccttatatcaagagatttttcttctctaatcccttttgttcagaatgaggccacaagattcgcagtacttctgttaggactgggattcaatggtgctataaagggaaa

SEQ ID NO: 1384 - DNA, 272519 bp, Homo sapiens
tggaaaaaaaaaaaccaaaacactttaatttttaagacaactgcaagcacctcaaacaatggattattgttacaacacttgttagcttttcacaatctagttattgcaaaggcatatggataaatgttaatggacaaagtcaaaaacgaggcaccttaatgaatgtaaaatttaaaataaaaagacattcaatccactgacttctaaaagaggctaaatatacctctatatattacattctaaaattgtattgcctactatggtttgtatcctggagtctacaattaattttaaggaaatgcataaacaaaactgtgtgcaacctgcaaagggaaaatcattttctcaacttcgtttcatggaaagacaatgaaaaagctagtaaaatttgttgtagccacacgtaaagctacctatggaatgaatgtgatcactgttatctttgagctgtgagaagtattctgcccactgcactgcaaattgtatataccataccttgtgttctagacaagcatgatcatgcttttccaaaaatatatgtattttttcattccacacaattaacacgtttctccaatttaatctatgtagagcttaacttacagcgcccagaggaggcaacatgacatggtactgagccatcacatttttaaagggaaattgctcttctttaaaagtacttttaaaaatatgcaaaatcacaaatgggactgctaaattataatgcatattttagaatgagaaacatatcttttcttcctttaaagtgccatatagagaatgacatcttataacccagagccactttgtttaaaatccaatgtgaaaagactgttatggaatgaaaagtttgcacaactccttggagcagttaaagtccgctacatgcaacataggctacaaagcactcaagacttggtagcttttctgaaatttgagtccccctcccatatttaatggaaagtaacatttacagggtgcatttacatacactataatacaggaatgatgtccctttgccagaagataaaattgtacatttccttgctatttcttggttccaacttgataatttcttaagattgtaaattatatagtactcagctaaaatatttcttcataaatagttacaaaacctgccaaaacacaaaggggaaagtatttttcattcaaaaaaatgacatttgaatgtcacacaacacaagaaacaatgcttagagacatgttattgtttccagaagaaaatggtcagtaaactacttagctgaagacaaaagactacccttccccaggatcacagtgcacaaaaagcaaaatgtcaaacaacagtacctcaaagcaaaataaaggtctgaggatgaagccagctcacttgtaatcctgttaaagaatgagagtcaccgtttaggtccaatgtactgggaacatttgctagctcagaatgcaatattggtagaatttgctaagaattcaaccaaggatgccgaaggcattcgccagctgaggctcgtttttctggaaccatttctaacatcgggatcaggaaatctgtaaactgtgcagcatcttcatggggccagccatacttttccacaagtacatcaaagaggctccagggcttcagcttggtgatgtgtcgcagttctcctacaggggaaaaaacaggccaatgtcaagaaagctccaaatctgcattccccattgttggtccagtcaggttcttttcagtgaagcggacaaccacctgctcaacacttgtacagcaacaacaaagaacaccagcttttccccactaagcaataatcattacatgtacatatgaccaaggcatatttcaagtaagcctggtggatctaaatagaggttaattaatagttcattcacattagttctaagcttctttaagtaagtggagtgggctcagtttgcccagagtgttttcttttccaaaggttgaagcaagccactctcatttcaacctgggatcttccgtaaaatttgcaaacttgaggccaacccaaatcaaacaccattcatgtctacgcatttgttgtaagatctaagatcctaggacattaatttgtaaaccttgaagttatacttcacaaactgtgctagctgcagtatgaaaagtgtcggttacaggcagctttggttgacataacagaatgactaacaagctagtaaatggcctacgagctgtaatggtcatttcataagagaaaaaaaaggttatttttaagtcaaaactgcaataaagggctgagggcagtggctcactcctgcaatcctagccgtttgggaggctgaggcaggaggatcccttgagcccatgagtttcagaccagcctgggtaacatagaccagaccctgtctctacttaaaaagaaaaaaagtagctgggcacggtggtacatcccagctactcaggaggctgaggcaggagcattgcttgagtccaggaggtcaaggctgcagtgagtcaaggtcatgccactgcactccatcctgggacagagcaagcgaaaccctgtctccccataaccttttcaaaaaggcaataaactgtcaaaagctccagataatttcactgtgaataactcgttttctctgcctgtttgaagttttcataggacatcccacccctgcccacagacctccttaggtgcccctcagtgcatcctgagcagcttctgcagaggaaacacccccctgtgcccacacctcagagcagccaggtctcggtggggggagagaggcattcaagcacctgcagggcacacttcatgcaaggactgacttctctcccctttcaactgctttaatttaaacaaggtacatttttttcatgagatgcatcaatagataatcagtgctctgctcacaaaggtgttctcaggaggcttgttctgtttcacccatttattcgagtcaacttggaaaagccctcccgtttaaaaacacaatgaaaaggaaagagcattacagaaaagtataagaacaaaaggggaagtagcctacaatcctacccacaactgctcttcttttgtgtctattgtgaagagtgttcttacacactagtatgtctacaaagttgcaatcatgctgtgcacagggttccgtataaagaatcttttaagagggctgcttgctaaaggggctgagatgtaaaataagcttctgtttccaatatgaggactggagctagagtaaagcatcgcatccagactagacatcaggtctgtgttgatgaagaaatgaacctgtaatattagaggcgggaaaggatctcctgttgaaggaaacacagtctccataaaaacaaagtctgaacagagactgcaggtttatccctctaagcctgaaattccggctctaggaatccagcccaaggagataaaccctggttgcaccaccccaaattcatgcctaatatatgctggcacaaaattatatgtactcgcaaaattacgaagagccagtaatagtaaaatggtggttaaaagaaaaccaaggtagattcacttaatagtatttaatattacttaacaacatgggagaagatcatggtacaacattaggcagtaaaagaacagtcaaactatgtcctacagataatcacaagattattaaaatgctcattaagatggaaatcaactgaatcaaaacatcagcttttgttagtaggttatttcaatttccacattttctgtaatatgactatattgatttagactgttgatctcaccacagcaacagttaaagcaaactaagaaagctcacatgtgactaaaccaagttctctgggaaagggagcgaacttttatgacatgaatctattctatctcagaaaaaatactctccaggtttgcaaatataggtaactacagagaagcactgtgtgctgagaatagtaaaggaacctatttctgaggcgccaggtgttaaactaagatccatcaacaaggcatcttttaagtacaatcttccatgaaaagagaagttttaccactataaatgcttaacagctgcatagtaacagtgagcaaaacaatataatagtgaaaggccatgagaaactattcatccataactaggcatactataaactggtaaaaatattcgcaaggagcagtaaaatatctaactacttttaacaaggtaaagactgtgcaaagaagcagtctataaacaacagtatatgcaggagagtcctaaacacctatggtcctgagcacagagcagcactgcaatataacaaaacactgaaccgcctctaaaaaaaaaaaaaatgtgtggactttttttgtggaaaaagtttataatataatgcaaaggaaaatcaactcacccagatgctataatgattatgtgtgcaaacccttaagctcagtataagaagtaaccttgccctggaaatagttgataaggttacttaaacacaaagcccaagcccccaactctgtatctattgctaggagacacaacaagagtgggctcactgaatgagtgagggtctcgagtccatgagccagctccagccctgcagatgatgcccaagaaatgtagccacctccatcacttagaatgataattaagaataagaggggaaagcatattttaaaaacacattttcaccatttgctcttactataaaagtagcaccctaacaagttaaagaaatgtcatcggccgggcacggtggctcatgactgtaattccagcactctgggaggccaaggcaggaagatcacctgaggtcaggagttcgagaccaacctggccaacatggtgaaacccgatctctaataaatacaaaattggccaggcgtggtggtgcacacctgtaatcccagctacttgggaggctgaggcacaaaaatcgtttgaacccaggaggcagaggttgcaatgagccaagatagcatcactacactccagcctaggcaacagagtgagactctgtctcaaaaaaaggaaaaaagaaaatatatgaagacgtaaaaaaaaaaagagagaaaagaaaatatatgaagatgtgtttcactgaaacaagttttgcaaataactagacaactgtgacaattttagtttcttaaagttccatttctagcctgtcctccttaaagaatgtggaatatcacttcacccttcctgtgactatcagctgtcaatctcagtatcaactcacacacacacaagcaaacatgagcctggcagccaattgtgtggtccccaagagccccttaggcttctgaatttgctctgagaaacagcttgaaagagccaaggaaaaccaacaggaagcaggctctgaggaagggttcctcctgcagagtaaaggctttgtgacagcaactgtactggccagtcctggacttgcagagtccttctaaggaaacagggaagttctattatacttctcttgaatcttaaagtggtttgtgaaggaaaatacattattttatccatgaaattgtcatattccagaattaaataaagaagcccatgaggttccacactacatgtgggaggactctaaaggcaaatcctggactatatttacatgaacactggtaattacaaagcaaaccatgatataaaactgatgagcatcaattgtgtacacgtagaaagtaaacctaccaagaaataccaatacaaagcaagagacaatgaagagatctgaatgaattcttacacaagtagacaaccaaatgtaggtaaatattggagtttaaaatgtgtataaaccctacctcacatcccatacaaaaatcaactcaaaataggtcatatgcctcagagctaaaactaaacaattcctagaaaagtaaatcttcatgaccttgaagtaggcaatgatttattagatgtgacatcaaaagcacaaattgtaaaatgtatataaattggacttcatcaaaatttaaaaatttatacttaaactttcacatgtgtattcaagagaaacggaaacatctgcccacacaaacttgtacattaatgatcatagtagcatcattcataatagccaaaaagtgggggaaaaccaaacgcccatcatctgatggagggataaacaagaggagtggcagtgacaacgcccagcctgtgtagctgtcaaatgcccacgaaagagctttctttgctctttacagcatcaaaagaatctgttgctttttaggtattcaggagataattttaaaacactgtgacaagttcagctcagacactaaatattaaaaatacagaatacagtatctctttttaaaactcagctcctgggttttagccctcagttctcacatttctcttgatgttgtccctgactcagggaaacgtggattttatgctgctgcacagaagcttcttgcttttgaaattttcaattgtatttaaggtctgtagtctgacacacacacatacacacacgcgcgcgcacacatgcacacaatcactctcttttatcccaacacactcgatgctgtcatctagagaccagttttttttttttaagtaaactgtctcatttgataatcccattatccacgcagcaatttttactaaaatatgcctgctgaatggtcagaaaaattcctggtgaccagcccagtgaggtctgctcctggctgcaccgtttttcctaccatgatctgagggctggaaagcttctggggaccacccacttcttgaagacaggacagggaaaaaattcatggacgtgctgatttctattggaccacctatcaacacagtagtttcttaatgctttttggtggctcatgtccagcaaattaaccttaagagggtgagagctgtaattacattccctgaccaaaaatacagctcaatttttaactttctggccaaggaatgattcaaactagtaatgatcatgacttcttaaattatacgcaaggagaggagacaaatgagctgcatttgatgttcaaccttaacacacagaccccactcttctctggctgcgtggcaaggatgaaaatctgcctctgacccagaggagaaagagcgggaaaacctcctgggaaggcactctccatcagtaactgctttcaaaagtgatacggcatatcaacagctgttttaaattttgttatcagttctagcacaaagtattttagctattttaggaaaaaaaatttaaatggatatttttaagattccattatttccaaaattatggaaattatggaatttcccctatattacttatgggaacatgccaaaacacatgtttcacgcagcaagccattcccctcatcctaagagacaacggtgaaatctatttccatgaccggccctcattcctcataatgttatcctgtgacttctgtaaaaaccctaaatcccttctgatctctactgccattagaaataataatcaggaaagaactgaagtcccaattcccagtcatttcaggggatttctcacctagtcacaaacggtctcttatatccaaaaacaggaaaaaagaactcgaggtaccacaggaacaccaagtgaaaatatttttggtctctcattaggaaggatgccaaatgcattttaactctgcaggttaccttcaaataagctgctcaaaaagaactcgatcacgtaagtcctaagtatacgtggtgatgatggcagtaacctggagatacacatccacaagctgtctcagggagcaaggttgctgacaggcccacgtggaagctgccttccagccatttatggccacacgcaggccgctctcactgaaaggaaccatcacaggagtgacagcccaagagcagatgcctgcaaccagctccatgcctgcaggccgctgacaggccctgccttccaacaactcagtgacttcacttgatcattcaaggcctctctttctgtccctctttccttccttcccgctgtgcacagtatggagtcctcgatcccctcaacagacagacgattaacaaagacaaataaatgcacagccaggcgcagtggctcacacctgtaatcccagcaattgggaggccgaggtgggtggatcaccttaggtcaggagttcgagaccagcctggccaacatggtgaaaacctctctctactaaaaatacaaaaattagccgggcgtggtggcaggtgcctgtaatcccggcttcttgtgaagttgaggcaggagaatcacttgaagcctggaggcggaagttgcagtgagccaagattgcgccactgcactccagcctggacaacaagagcaaaactccatctaaaaaaaaaaaaaaaaaaatcaatgtggttctccaaatttagctaagtaaggtagacagagcatctgggactttcagaaatttctaaaagtccatgtcctactcacatcaactttaaaagttctttattaagggctgtcacatccaaaaaaaaaatctaacctgaaaaatatgaaggaccaactacactcatcacaaaaaagtacagcaggctgggcgcagtggctcatgcctgtaatcccagcactttggaaggctaaggcgggtggatcacttgaggtcaggagtttgagaccagcctggccaacacagtgaaaccctgtctctactaaaaatacaaaaattagctgggcgtggtggtgtgcctgtaatcccagctacatgggaggctgcggcaggagaattgcttgaacctgggaggcacaggttgcagtgagctaagattgcgccactccactccagcctgggcaacagagcaagactccatctcaaaaaaaaaaaaaaaaaaaagaatatagcacttagaaggagttcttttaaaaatactcctagggctcttgggtgtttttataaattactaactggggactatactgggcaaataaacagttggaagatcagtaagaactacaacatgaaaataatcaccttaatacagtgtggcataacacaatgggaatgtaggatgtcatttttaagaatgtgaggtacgcagcatttcacaggcctacacccactacagaaataacccaggcagaccaaaagcaatgtccctggacgttccctaagtccagtctctaggccacctctgttctactacagagagtccatgaaatggaaagataagtctagctggcttttaacaatcacctaaactcctttttataaataatatacagattggtaacttggagtaaaagagagaagcggaggaggaaaaaatgctgttaggaaggctgttctcttacaaaattcttactccaggtatcagatgggtcaggtttatttcttgagagctttcttcggaagaattccccagttgtgaaactccagatctttctccactgcccaatcacgaatgcacaatttctccttttgggagaagactatgctgaaaattagtgttgcataaataccgttaccttttctggtgaaaaactccttggagtatttccccaacatagcgtattttcgagggactttccccagcagttcaatgatcaatgctatgtgatctgcattgggaaacattgccagcaaaacagaaacacacgacagtttaatcagtacactgcatgcagacactaccaccgcccgcgcagacagaaacagagcgcaacttgaatgaccaaaagtacaggccttcctcgcgttgctggattcaggatccagagctggagggcacaggagaggggctggtgaacagggtgaccgcagcacagggctaaatgtggtcttccctgacaatttttctatcagcataggaattctgctgggttgcgtttcgaatttaggagaaatgcctttgtcaccattaatgctaaaatcagcagctgctcttcagtttctgtctgcatcgtggcgcttttcaaaaagaagaggtactacctctgcgattgaagaattcccgagaatattttccagatagagcaaagtgccttggaatactgcctagcagctctatgatgtgggctatgtggtctatggaggagagaaaaaaaggatatgggaatgggaggggcaaagggaaggatgggataaaagaagagggaaaaattgaaattagtaaaaaatcagaaatagattcaaatcaacagtgtctgcagcacatccatgcagaggcttgtgggaatggcaggcctcaggcaccacctggagcagtaacagtgactgaggccagctcaccccaggccaccccagcatcgcaagcaaataagcatggagatggtcaggtttacagatggcattcaagccagaattcctgggttttcaactcagctcccaaacaggacagagaaatgggcagcacatcaatggtcaaaaggaccacatagaggcttcaggtctgtatcatctgtcttctctcagccagctgggttcctgccctgtgcaaggccaggaagagccgctggtgtagggcccctgagggctcgctggagtgctgcctgtgctaggcaggctctgcccattcactgagactgagggggcatcaaactcaaaggaaaagcatctgaatttggtgtttgaaaaccaaacacatggctctatttcagtacaaaaatacagtactctacagaagttcagggctggcagaagacctagaccgaggtattcagcaggcaccaatactcaccttcgtctctggaatagtcttccccagaatgtggttcaaacaaataatctcccgttgccagctcaaatgcctaggatacaacagacgacatgctaagcacttcagagactggcccccaagtcaacagctttttctccttatagaagagaccgccactttatgaagatctgaatcaaacaaaatagcctcctgaaagtgctcaatactaatttttttctttcttccacattcaaagaagtttcagaagtatttttacatttctaaggaaagatataagagctatgtattctcttcattttgcaggaagcaaaaccaaaacgtcagtgagtcagccgcacctgcatgcaggcctggccagagcgcggtatgcactctataaatggtagaacgagagttcaacccaggactcaacaaggcccgtctgactccagcacctgcctcaaccactataatagccttggcctctgtatagcagacactgctgcgtcttttaggcgaagaccttcatgttttagtaaccaaggactattttcagtatctcatcaaccattttcatcatcatttcattcatttctgattcaaccaaaggaaaacctggaaacaaaaaagaccctctttgtccccagggccagaggaagcagatggtcttgcagacccttttgtggatgtcacggagcactggcttcctgggtggccactggctgtccctcagcatgccagcatgtagggaacacatttcccttgctcacaaaaaaaccctcaaaaacatgagtttaagctagtaacaatatacaaaaatggcaactgctactgctctgctgatcaaagagaatgttttaaaagagaaaaaaagaataagctaaatcccatttctggtttttctcatagctgcttctattctgaacggatcttgctgtcccaaaaggtgctcagaggcccaatcactgatgcctgtggatctgtgactgccctccccattcccgccccaaggagccaatactggggaaacttcactgcatcaacctaccttctttttctttcaatgaccacacagtgctggaaaggcacctttaagggaaggctcacctgcctgggtgaggggccacctctcctggcactgtctttaacaaaccaagagtgagtgcagtcagcccaggaccacatcttttcaccttttttaaaaaaaaagactgcctgtcaatcacttgaaggaaggaaggatggtgacaagatggcttccagctgaccgagcgataagcattaatttatgaactcaggatccctgccctgaacctggcataggtctgagcaagacacggacatgtcacatctcagcatggtgagctggtggtcccagcactgtggatgcacgaaggcaccagcagaaaacccaggaaagcccttatgtagggcctctcctttccacccaataaacaaagaagacagttgggccaatcccagatgagggcaggaaaacctcataactggccccaaatccaagtggaacaactagattacacactcaatggccaggagagtccttctagcctgggaaacaatcaattcagtatcttacaagctaagagaaaaatctgaaaactctaatgggacaacgaggacttgaaaagcctggatcaagttccaagctgcttttcaacccctgccttgagccctatgctaactaactcttttaattaattttcaaaatgacttcaatctggttgcatatatttctttttctttcatattttttagagaagggacctcgctatgttgtccaggctggactcaacctcttgggctccagtgatcctctctcagcctccagagaagctgggactacaggcgcactacactgcacccagctttgtacatatttcttactgccaaaatatgtcaggtatgtattctttgaaaaaaatcatcattttgattagcacccacatattcccaagaaaacatgtatagaagccaatcaatgaaataatttttttttgagacggagtctcgctctgtcacccaggctggagtgcagtggcacaatcaatctcagctcactgcaagctcacaccattctccttgcctcagcctcctgagtagctgggactacaggcgcccgccaccacgcccggctaattttttgtagagacgggatttcaccatgttagcctgacctcgtgacccgcctgcctcggcctcccaaagtgctgggattacaggcgtgagccaccaagcccggccaaataattttctttttttttaaaggaacaaggaagatgaaggctgtaatgctacccatttttgattctttggagagtggcaagattctcttaacaatacaacatgtacaacagggcaaatgcacattacaatgaaaaaaactctgccttcaactcagttactcccagtataaccttctattgcccaggctgagtgcagcggcacaattttggctcactacaacctctgcctcctgggttcaagcgattctcctgcctcagccacctgagtagctaggactataggcacgtgccaccatgcccagctaatttttgtattttcagtagagatggggttttgccatgttggccaggctggtctcaaactcctggcctcaagtgatctgcctgccttggcctcccaaagtgctgggattacaggtgtgcatcacctcgctgggcctaagtataatctttattattatttttaatacctgggaactccggattcttctctacttggctcaatcccctcaaagggctcttccctggacctacttgtttccagattcttgggagaccaactacctctctcctaaaacattctcctatgctgaagtatcccgattctgaacaaataagatcacgtatttgttctgtaatgtgaccagtgccgaagaagtctggtgaagtttgttggaatggcttttcttgtttctatggcactgaccaggactcaccatggagttcataaaaagtcctatcagagactctaatacataaatgcagagaaaccaatgcttcagccacaaagaagtttcagattatatgtacttacactggaaggtgtaaagctcaaaaaaaaagtaaaactcaagaaaagtaaaacagatccaaacccaacatacccttgctgtggtccctcattctgttgtgcttctccagctgcagagcctaaagctgtcctccctgacaatagccaatggctaccacccgtcagctctcattcccaacagagtctctgtgagatttgatgctatttataaatctcaaagacagccgggcacagtgtcacatccctgtaatcccagcactatgggagaccagggcgggtggatcacttgagctcaggagatcaagaccagcctagacaacgtgacaaactccatctctacaaaaaatacaaaaattagccaggcgtggtggcatgtgcctgtagtcccagctacaccagaggctgaggtgggaggatcacttgagcttgggaagtggagtctgcagtgaactatagtcctgccactgcacttcagcttggggaacagagcaagaccttgtctccaaacaaacaaacaaaaccctcaaagactatatataggctttaccaccaagaaccatctgtggccttatgacagcttggtattatgaggtcaaatttaatatattaaatgtcctatttttacactacaacagaacgatgaggtaagaaaaactgcctcattgctcctaggttctctaggaggaacaaaagaaacctctaaagccatgacttttggggggtggggcaagcagtgaatgagggcctgcccctttccaaaaaaaaaaaaacctcccttatgacaaccaactgaaaaagcaaacctcataagccgtcctgacagcactgagggagcttatgcttaattcttgggaagggggcaggtgagaagacagaaaggcttttccttgggaatctgttattgatatttatgccactgttcacagcaatagcatttcaagaagtaagcaggacagggaaattgtatggagggacaaacgttcatctaatggaaggcaggtcagataacctggtataaaattgtgctgaaagctccattaacccactacatccgtgactgcgtcctatttttctggttatatcaccaaacttaataccccaaattagaagcacagcatttcagagttcaaagagtacttagcgcctaattcggggcagccctgctgctagtggccattgtggtctaacctccccacatcctgaaatggcccctgctccccgactcccactcagtgtctccgcagctcccgttacactaactcccacgtctcagtctgcctgctggggtcacacagagagggtcaaatgcctctccacacagcactctctaaattcaaagtgaccatcattggccaccggttcttttaaccgttcttttctatacctagctaaggcagggacttggtttttgatatggaagaactttaatacctttaataatttaaacgttattgtctggtattatccttaagagcaacgagggaatagaaaggcctggtgtttcaggacctatctggccatgtgctgactcagatcatgctgagtcaaagctgaaagacagaaagcaccctctttttctcctatcagctggcactatctgctcaacaatgcttttacttgagcattagaggaggtaaaacacagtaaattcaagaaaattgttaaattaacctctgaataacagaaaattaatatatttattctgcattccttttttcagtgagaagaaaaatgctaagccttgcacacaatcttttcttttaaatattggaagaatatggataaaaagcagtatggaataggaaaagcatgaaacccaacagcaagcaacccacctttcccaacacggaacgcctaagtaaataccactgagaaaaagctgctgaatgggccaggaaacagggcagaggaagagaaccaggaactggctcgcaaatgcagggccctttgtgttcaccaactcacaggttcagggtcaatgaccaaacgatgccaggcagggccaggggagtttacagacaatgcaactgtgcagcacaaaaccagcagcaaaacaggcctgacagatagaagaagaggcttctgccgccctgtggaagccgtcatctcaaccactctgggaacagactctgtcagagggagtgggcgttgctgccactgtttcagaagaggctagacatcctagaataagccagaatatctgctagctcttgctttataagggaagagagattatgcattggcatctggggaaatcccttccagtctggaaaggtgaggaaccctgcatgtctggttgaccaggcagaggcttacctggaggggctcccacctgcccgccttaggcagtcttcccctggagatgctacctcatcttcctccacagtgtgagtgaagggaaaagctccctataccctgcacattttcagggaccacaagtgaagtcactgtgtcacaacaactgagtctgattcatggggctgtgggctgtgcagggccttaagaagagaccatgtctctctcacaagcccacaaccacaccaaacacccagggcccgcctgaggaggatccttccacttcttaagatgcctgcggcagcaaccttcccctcacccagcccacggtggatgacccttacagtcagaaaaactgaggtcgcatgcctcagagagactcagccccatccagagtgtgaaaggaacgagccaattcccatggcagcaaagggcacagccgtccttaccatacacgccgtgctccagatgtccgcaggggtgctgtaccccgctcctattaaaacctctatggagcggtactgacgcgtctggatgtcttccgtgaagtgtttatgctggaagggaacaggctgcattaccacggagcaacacagacattcaaaaagtgtcttcgcacacagaatcaagaccaaaggttttagaaagaaaactctacttaccacccaacaagcatttcccaggtcagcaatttttactctaattttatctgcattccgcggatccaggggattcaccaacaagtcagctgcccgggtttttgctggcatgagcaaacagcaggacagttagtgatcgggataggtggtttgcatgtgtgagcacagtgtttgccagggtcagtctcctttcctcaagagtagtggaatgatcacttaggcctggaatactgtaaattaaacttgacagaactaaaattgcttgttctccacctctggaaaatactccagaaaagagcaaactgggctgcccacaggacgccaagggcactgccttgacctttctctttttatccccagtttcttcgggtccaggtcagccctagaacaagccagccttgctgtccccctgtctgcagctttgtggcggctcttcatggtgtcaatccatcccttcacggcccagatcgagcttgctgatgcattattacaaggaacatgaaggtagaaagaacactgctgtgggggccgatcactctcagtgacacacagttccttggacgccacaagacatcagggtccctggcaccgacacctcacacccacatcatcccctacagttcccactgcttgggctgagcacacacagatctcaaggggtagatgactgttgattaacaaacacagattaaaggcagggactaaactattctggttttgttttagacaaggaaggtcccagacagaggtctcctgagatggcctgggccataaaggcaacctctgaggtcagtcatgaacttgtcatgtacatgagcagtcattctaaattccaggatgactccagggaatctcaaaggcaggtatagggccagcttcccagagattctggggccagatcttctcaaacaagttcagatcatgcctgtatcaagcagagttaaccaaggggcaagtgacaaacaaaaataatctggtgaggcccagaaaaatagtccttaaagtcagcatcttcatcaccaaacctcagactgacctacaagatcagatttctggtaaagatgaaataaaaccaggacttttatttactgtataagtaattttgaaatggtatttaaaaaccaagcagaaaagcctgttcaatgtagaacattaaacactgatatgattcgggtttgtgtccctgcccataactcatgtcgaattgtaatccctagtgttagaagaggggcctggtgagaggtgactggatcatgggggcagatttccacgttgctgttctcgtgatactgagtgagttctcacgagatctggttgtttaaaagtgtgtagcacgtcccccttctctcctcctcctgctccagccatgtaagatgcctgcttccccttctaccatatttgaaagtttcctaaggcctccccagccatgcttcctgtacagcctgtggaactgtgagccaattaaacctgttttctttataaactaccgggtttccggtattttttacagcaatgtgagaacagactaatataaacacctacctaggagagcccctttgtttccttgaagctgggcactgctgaaatgaactaaacctctgttggggtacatacgagctgtgaaaccagggtgcttggggaggctctgattcttcagcaagccccataagaggaaggagggccagccttgcaacttgccgtaaggcagtgaacaggcaagggcctcaggacctagggtgcccacacagctccctaggggggctccagaggacgccaagagaattctgaccagtatcttaaccctcaagacctgttcctctagcatgttaatcaaatgagccagccaggtacagatattccctgcttgctaccttccatatgcctgtttccttctttataaggattctgcacagcctcaccaaaggccaggtatgagctcaggaaaagaaacaccagaactcagcaaaaattcagaaagaaagcagcacaaagaccaaaaaagaaggcaaaatgaatatacactgattcacctggggctgagaacagaggtccaggataaatataaaaatgctgacccaatgggtagatgaacaacactagacatgactagatgaatgccccgtatgtcatttaatcaagaagaatcagcaagaaggaaaatggaatttgaggtttgaaaaattggattcaaatctaagtttcaatatctacaagttgtaagactggcaaatgacttaaactctatgaggcttggtgttcaggaaaagaagaatcggaagggaccaccccttccccaccgaagacactaaaaacccaaacacaggagagtcaggacagcatctgggcgcctggccagacgcaggggcttccctctgctgtgaccagctgaaccatcgtctggggcagaggctcccaactggtcagtgagggaccagagagcagcagcagagggaaggggaggcccaagagcaagttccgcccccacaaacaactcaaatcataggtctaatgagaagagggcgaagcccggttagacatattgtggtcctcctgagccacagaacgatgtgatttctttttctccatgagaacagtagccgagttggctgttatctgagggcactcaagtggaaggagatgatctgtaatctgccaccactctgagatgttgtttttaaaaacatttctcaggagctgcttaattcaatcacgctagaagaaatatactttcaaagacccatcacctcacatttaaatgcagggaatttttttttttttttttgagacagagtctcactctgtcgcctaggctggagtgcagtggcgcgatctcggctcactgcagcctccacctcctagattcaagcaattctcctgcctcagcctcccgagtagctgggattacaggcgcctgaaaccatgcccgattaatttttgtatttttagtagagacggggtttcaccatgttggccaggctggtctcgaactcctgacatcaagtgatctgcccaccttggcctcccaaagtgccgggattacaggcataagccaccgcacctggcctaaattcaggggtgtttcttgtacttaatatccctcattaaggttcactgaacagaatctctttggtgacatgctgttatcctcctggttcgggtttgtaaacagttacttagcttctgatgcgttccaaatgatgctaggtaatgtatctcaataacttaattgtataaaaacacaacaggaggtaaaagagattttgcttttctttcttttctcagtatgatagttcctgaactaaggtaccagactgctacattcccaagaagtccactgaaacccaactggaatgcttttgtcacacctcctctgactgagtcaccacagtagtgacctgtcacacggtttccttcttacagataatggtgacacaaaggacaaactggagctgtcttccttccaaaatgaaaagcttgcaattgcactctgcttccactaagaggggaatgagtggaaagctttcacttcgggaagaactgggccccttaagtcaccttctgatacgctagtctttgggtgacactgtggtcactcattccacaagaagctatcctaggaactattagatggtagccaacagtgcctcagcataatgagacagctgctgtcacacgcacataacacatggagctaggcacacactgactctttacatcataaggggtccttacaaggacgacaagaatatcccctctatatggaggaggttcactatgaggcccaaggaagtagtggaactaagagatttaatgttgccacctcaaccattcgtgcaacaaatatttactgagtaccttctgtgtgctaagcatggtcttggtactgggaacactgtaagaaaaaaacacaagctaaattaggaaactcgtgtactggttgaaaatatgggcaataaggcaaataaacgaggaatccacacatcctgtcaggtagctaaacaggctatgaagaaaaacaaagcagagaaaggagatggataatgccaaggctgttcaggggagatcttttctgagaaggtgacattcaggagaggtctgaacaaaggcaggcatgaaagtaagagaagtttgaggcaaaggacacgggaagtacaaaaatcctaaggcagaaacaggcttgcaactttgagaaactttagaaagaagccagtgtgaacggtgtagaatgaattagggaaacagagaatgggtctggagcaggcaccaacagagacctgccagggaacacactggagagtttgtcagcttcagtgaaggacaactcagggcatcactactctacatgggaaacacaatggagatcatgttggtgaggcgagggtgggtaagggggaagaagttaagccttaaacagttctctctggactgccagacagagacagactggggagcaaaagctcaagtgataggagcacggaggctgtgttaacagtagcctagcaaggactgacagtggtgtgggtccccatcgagtgacacagaaaggattccagaaatagcccacaggtaagaccaacaaaaccaccctgttccagggcctttgtccttcagatgtgttgagccaagatacacactaaggctctggcagctgatcatctaagagggaccatcctcttctcaaccttcaatggctgccaaattactctaggaaaaaagtgtaccttctttagcctggcatttaggtttcttcaagttcctcaaactggccccagtctttcttctactatgccctaacatgtacattctgccctaaagtcaggatctacacaaactcttcattgtttctcttgcctcaaattcacgaagtaccgtgtggtcaagtgcaagactctaggcttataccccttcccatgcagaaaacaaaacacacctcccatgggggaggctgctcttgcttatcaaatggccaagctgcgggcgaaaactgagtgcttccaaacaaaggagatcctgtccctggtacatccctagaatttgccaatattaaaatgctcttcaagacctccagtttctacctgatgcaacaggtattggggatggtatgtgtgttggacacagtaaaattgtgactataaatggaaaaaagcgggagaaaggaaagagaagaagaatgtaaaaaggtatcactcatttgtttgttcgttattcaataaatatttatcttagcactgaatcagatgctgaggatgcaaagataaaaacacactgcactctccaagagttcacattctaatgagaagacagacagtgacaatgagcactgcccatacaactaagacaagcatggccagcaggagcagaggggaaagagaagtaagcctgctggggatacaggaagccctcacccaggaggcaggctactgtgttggatcatatcctagatcaggaaaatttaaaaagaaaattttagaattattgaggaaatttgaatatggaataaataatagatgatattaggccaggtgtgatggctcacgcctttaatcccagcattttgggaagccaaggtaggcagatcactcgagcccatgagttcaggactggcatgggcaacatggtaaaaccctactttctctaccaaaaatataaaagttgaccagacatggtagtgccaactgtagtcccagctacttgggggctgaggtgggaggatcacttgagccagaaagcagaggttgcagtgaaccgagatcacgccactgcactccagcctgggcgatagagcaagatcctgtctcaaaataataataatataaaattagtgctattcttacacgttgtaatagtattattgttacaatggaggacgttctaattcatctctcagaagatgaatgcttaagtatttaggagtgaagtatcctaatatgtgtagcatgcagtgtctgtgtacacaaagtatatgcaatgcggcaaaatgtgaattgctcaatctatgtggaggatatacagttgtttattgtactattctttcaaaataaaaaaatacacagatgctctaataattccttcctgcaccttcctggatggtgctggttatgcagggatgtacactctccactgtggagaccactgctgtagatgatggggagctgtggaaactgtgagcaggggaatacactgatcgggtgagcatactgcaaagacactctagcagcaccatggaagggcatgctgaaaggcaggtggggagaaaagctggagagaacacaaagccaagacaccagtaaggaacctccataataggagaggcaagcaatgacactgcccactttagggacaaggcaagggggacccctacttaggaggtatgactggcaaaatgagatgatttactggacatgagagaaaaaaagaagacatcctgatgatcaagtttctcactggagcaacaagaaatggtggcaacaagtgtaggaaatacagtatgtgtagcaggttggcagggaaagttgtattctggttttggacatgtaaggtttgaagtttcctgtgacacagagatggagctgtcatgtaaacaataggataagtcttatgacttgcctgggcctccaatgatgaccatgtggtaacaagcagcaattctgctcctttacatggattgtgatgaccaaggcaacttacattcaatgggaaatttttcaatatattattattatatgttatttatgtacctttgccattgacctgttttatttaattcagtgctactaacaaccttagaggtagccatttctttcttttgatagaggaatgaaccaaggctcagacagggtaagaaaccaaagttccacagttattaagttttgagctggggtttaatctgatatgcaggtgcctctcggtgtctgcaggggaactggttccaggacatcctgaggataccaaaatccacagatgctcaagtctctgatataaaacggtgtagtgtttgcatataacctacatatatcttcctatacactttagttgatctctagttatttataatacctgctacaatgtaaatggtatgtaaatagttgttatactgtattgtttagggagtaatgacaaggggggaaaaatctgtacatgttcaataaagacacagttttttttcccctccaactatttcccacctgaagttagctgaacacatggatgggaaatccaaagatgtaaaacccatggatatggagggctgactgtacttgaagccactgcagcccaagctaatacttgcaaaataagtatgaataaaaaaggtactttgagctggtcatggtggctcaggctcgtaatcccagcactttgggaggctggggagggcagatcacctgaggtcaggcactggagaccagcctggccaacatggtgaagctctgtctatactaaaaatataaaaattagccgggcatggtgacgggcgcctgtaatcccagctgctcgggagactgaggcaggagaattgcttgagttcaggaggcggaggttgcagtgagctgagattgcaccactgcactccagcctgggcaactagagtgagactgtctcaaaaaataaataaataaatgaatgaataaaatagaaataattaaaaaggtactttgtaaattactttctatatgaaacttcagccgggcgcggtggctcacgcctgtaatcccagcactttgggaagctgaggcgggtggatcacgaggtcaggaatttgagaccagcctgaccaacatggtgaaaccctgtctctactaaaaatacaaaaattagccgggcatggtggcacgcgcctataatcccagctactcaggaggctggggcgggagaatcgcttgaacccgggaggcagaggttgcagtgagccgagatcgcgccactgcactacagcctgggtgacagagcaagactcaatctcataaaaaaaaaaagaaacttcaagtaagagaaaaattgaactgcaacagcaacaataagtctggataaggtacctctcactactgccctttcccagaaattaacctacattctatgtaagcaccttcaaacactccctggaaaggggaacaggagctgaccacgtccagccaagtaaagaaagcaaatccttaggaggattcatcatagccagtgcgtaacaaagccagcttactcggcgtgcaattccagactgctggaaccaaaggggctgcagaatgtcgggctgtttgcagggctggctcatcaattttactcgctgtgtgttaaacagtcttgtcagtagagggagcagagggaggtttcagagcttttcccccataagccagtatggaaaccagctgtgttacccagttttcacttactagagtcacttggcattcactcccaaaataaggctttgaataagtcaagccttcttaggtaggcaagaacacaagagccaatctataatctgtcatcacatttaaatccatgccaattccttgaaaattacaatcctgggccagttaccaatagtagggtcctataatcaggaacaactatcaaaagacaatatgacacttctttctcaatagagtcaaagaggaggcataattttcttgaatagaaacaaaacaaaactaaactaaactaaatataatgacattagatggaagaagatacgaattttaaactaaactacacattctagaaaggtgtaagttgctaaaactggaaggtttttgcaaatgatgctgctgactaaatatattaaaaatgaaaactggtcagaaataagatttggtatgcagagagcaagaaatagcctaatggcatagaaaatttatttaaatcacattacttcttcaggagtataaaagtaataaaactgatcagtacacacacacagggcttggccacttccagccaattccttcacagcatttgttaaaggcacgtccctggagtcagcgatggcagacagttgatgggaagaaacacttaccttttggcaaatccccagtactggaggctgaaaccgttctgcttctgtcatgggatggactgctctcctcttgctcagtaagtggtgatccctcagaaagcacagagccgcaggccacaggttctaaggatccagagaacaacgaggtggaaaactctgggaactgtgactcgggaattttatgtcgtccatttggcaattcaccattgaattgttcataggagctgctatatgtgtaatcactttctgcatttggctcatcaagattatattcctcaggatttgggcagtcttcttcatcatcatcttcatcgtccagttgctgctccagtgagaatgggccattctcaatatggccattggttttaggtgattctatccacgtagggtctatgttcgcaagttcctgatctacatcatcttcatctttttcaatgttttctttctcagcatcttctttctcttcctggtcctcagcttcaccttaagaatttgatgggtcaagaattagaacttgttactctccttaatacagcctcattaagtacttatctccatcaataaaatacattttgaatatgcttatgtaccacctggtaaacacctcttggcttttggggtaaaaccttcaggttttctaaatctcatttttcattcatttagtaattggcctgctcttataagaaaaagttagctttaagggaaaataactctttctaaataaagttgcacttccatttctaccctctataatcttcagaaacagacttgtggtgcattacagttaggtaaaaagttaatgacaaaataaagcaccatcattagcatgatagaaacatggaatttctcaattattttacatttttaaaaactattttgaaatgttaacatatttctggcatacagttcacaaatgaagtacgaggctatttcccatatttcccaatagggagttggagagaatcatccttgtcatctgcagcagcagcacaaatcagcccccatgttgacctggcagaaccctactaatggagctctgagaaccccatgcagcccaggttccaggccccactgaccattgtcctttgcagtctctgcctcagccgcctcctctaatcctgttgtttttagtttcacctctgggcagtattcgccatcctggtcattggaaggtgcagctgaggtgatgttttcttctattattttcctttcagcttctcgctccaattcttctatctcctgcaggcgcttctccaataactcagcctgcctcttctgtttctttttcagttttttctttttgtttttagatatttttcctatctatgttaaggaaagaccacaggtcagtattcttctttttaaagcaccacgatagtataacgactagcagcatggcaaatagcaataaactctgctttctcatgccatattctattaaaatcccaaacccagacagatccactttgtggtaaggcttacgataaaatcaaagggaaagcagtgctgactgatatcacgtactaggtctactaccaggtcctgccctcagagggatatagcttaaatccagtaagtcttcaccattcaaactctaagagaactgaagttcgaaattctcttggccttaaaggagaagctcctcttgcaagttttatttgctgctgtctatatacaaagtaacaacatcccagctcctcaatgccaaaaatgaaacaggtgcccgagcaggtgtatgtcactgtgtgtttgggtctcacatatgaagctcttagcagccaagacaacatgaactgtaagagataagcctatgctgcaaagggaaaaaagaaaaagctacagcttttgtctgcctcccgtcatggttacctgacttgcaaagcactggcaatgacagcctccaacctttcaatcaatcagtaaattcaagcagctcaagccagggaagaactatgggaaacaacttgagcttctcagcaggccaggaagcttaattattaaagctccctcttgttccagaacttacattccaaatcaagagctgtctcagtaaaaatagtgttttgttgttgttgttgttgttttctttgagacagagtctctgttgcccaggctggagtgcagtggcgtgatctcagctgactgcaacctccacttcttgagttcaagtgattctcatgcctcagcctcccatgtagctaggactacaggtgcacaccatcacacccggctaatttttttttttttttttgagatggagtctcactctgtcgcccaggctggagtgcagtggcgtgatctcagctcactgcaaccgttacctcctgggctcaagtgattctactgccttagcctcctgagtagccgggattacagacgtccaccagcacactcagctagtttttgcatttttggtagagacaggatttcaccatgttggccaggctggtcttgaattcctgacttcaagtgatctagtggcctcagcctcccaaagtgcagggattacaggcgtgagtcaccacacccagtatctaataaggacatagtgttttgacaggaccacaaaatagatcagtctctttcttatttaacatccgcatggaaaaaattagaacaacagcttcagaaaaacaggtaacttagcagccaatcagaaataatgtaaagtggttttgaaataaaaatacttcaactccatcacctcacatttcactaaacttggccaccatagtccagaaaatgcataaagaagacaatttttgaaaggctctaactatcccaactctgcacagatcattaaaacttaacaagacaggctgggcgtggtggttcaaacctgtaatcccagaaatttgggaggccgaggcaggcagataacttgaggttaagagttcgagaccagtctggccaacatggtgaaacccctctctactaaaaatacaaaaattagttgggtgcggtggcaggtgcctgtaatcccagctactcgggaggctgaggcacaagaatcgtttgaaccagggagggggaggttgcagtgagccgagatcgcaccacttgcactccagcctgagcaacagagtgaaactcagttttcaaaaaaaaaaaaaaaaaaaattaacaagacattaagtcttacctatttgaggatacacagcttttataaatgtgtctaccctttaaatacacaacttttttataatttgaacaactcaataataaacggtctcttttaacatggtgcatataaagtaatatgcgtaagtacttacaggtttctgctgtggagccgtactcactaaaataaaatcaaacaaaatctgtatttagcagaaaacagacacatgccttcatgtaggtcattcgaattgcaaagtgaaataattattgtcttttaatggctatccaacttcaaaaactattaatcagagcttcttaatcacaaggatctagagtaagtttatgccactgaaacaaatgagtgactcctgaagtcacagcagaagttactcatactgagccatttctcttatttatctaaaatgaaatactaatacatctcaaacacagtcaagctcaagcaccaacagatcacttaagaaaatggaaaagaatacatatcacagtcattaaaccaaatttgtttaaaatataatgaaatgaacaatgtagatgtacatcgatatttggaatctattttgcaagctttctataatttaaatcaaatactgcagttggtatgcagcaaatagtctaggaatcacatgattaaacccctacaccagggtcaaaagcttaacaggctgggtccatgatctaaacaacaccctgatggcagtaaaggagatgtgaagagagccccaggcagtcccaggagcctcagccctttagtatccatgcttgcctgacaacacacaaaggcacagatcatggtgtcgaagagtgagaagcacagtccacacttcactgcaccacctccccgaccccgccccagaaataaagatatcccaatactcaggtcacttgatcttcttcccccaccatcaggccttttctaactaactccaaatctgttgatacaactcaggttgacatagctatgctaaatggacaacaagaatttatgtacacaaaattgaagccagaaaaatattctgatgactaaaggtcagctacaggaaagctgttactatgttctcctctgcagagaagctggcaacagaaaaaactgttcaaatatagatgaagcagcaactacaaatttaaatggccttttaaagggggacaaaagtaaatacttccaatattaaaatataatgtagctggggcattttccatttcaagggtgcagttatttccagcaattaaacttttccaaaatcttccttatgtgtaacgtttgattcagataccttcaacaactgcaactttgcaagctcccaatgcccccacactgaaatgaagctggctcagctccctcacctgcagaccctgaaggaggaggagcacctgctttctgccactcagtggcctcagctgccattcttctcacatatgcatcatccacacacatcaagatattttccggctttatgtcagtatgaatgatcttgcacttactgtgtaagtaatctaacccttgaaggacctggatatagtaaaatcaagagagaagataagctattaatatctcattatataacttttatttatttgaaaaacatgtaatacaatgccagggtacaaagtttgataaacacaaaaggatatttagtaaaaatctccctcccatgcctacccacattggaatccagctctcctttccataagcaaccagtgtgtataatttcagagattatttatgctcgtggaagcaaatgcatctacatacagttgaaccttgaacaacacaggtttgaactgcatgggttcccttatacacagattgtcttccacctctgccactcctgagacagcaagaccaacccctcagcctactcaacgcgaagataatgaggatgaagacctttatgatcatctacttcatatgatctatccacttaatgaatagtaagtatattttctcttctttatgattgtcttaacattcttttctctagcttactttgttgtaaaaatatgctatataacacacatacaaaatacatgttaattggtcatgtgatcattaaggattctgatcaacagtaggctagtaattcatgtatcatacaattgacccctttaggtatacaattcaatggattttagatgtgcgactatcattactatttattttttaaattttttatgtatttattttttgagacagagtctcgctctgtcacccaggctggagtgcagtggcacaatcttggctcactgcaacctccgcctcccaggttcaagcaattctcctgcctcagcctcccaagcagctgggattacaggcgtatgccaccacgcctggctaattttttttgtatttttagtagagacggggttttaccatattggccagtggtctcgaactcctgaccttgtgatccacctgtctcgacctcccaaagtactgggattacaggcgtgagccaccacacacggcaactaccaccactatttaaatgacaacattttcattgctccaaaaagaaacaacatattcatcagcattcacttcccatctctctcctaccccttctaacccttagcaaccactaatctacttgctgattctggacatttcctataaatggaatcatataaagtatttttttgtaactggcataatgttttcaagtttgactcttgtgcagcatgtattagtacttcgcttattcttattggcaaacagtattccactgtatggagatacaacattgtgtttatcccttcacctcatgaacatttgggttattttcactttaggggctataaaaataatactgctattcacactcgtgtatacatttttgtgtgaacatactttttttgaggggaggtatatacctaggagttaccgtacttaggtcatatggtgcctctatatttagctttttgatgaactgccaaagtgtcttccacagtggctgcaccattttacattcctatcaccaatgtatgagggttccaattcttcgccctgaacaacacttactatcgttttttactttatccacccaagtggatatgaagtatcttgttgtagttttgatctacatttccctgatggctaatgatgtccatacatttttaacactgcaagagaaggggggcttgatttaaatagaaaatagccttggtatctagacaaccctacagcattatactaaaagaaagtgatgaaccaagatattcatatttctcatattaaaacaatcaaaaacttacagtgtcagtgacctaaatacaaggtcagtgtttttctataattatttccactggagaataattttttcaattatttccataaacaaaatttatttttacaaaacagatcatgttctcatataagcattagaaattccaaatgttaagcaaatattacatcaatgaccattcaaacaatgaattgaataggcattttgttcacaagagacaggaagtgttatatgtttcacatcatccaatgtagggaaaagagagatccgactgttactgtgtctatgtagaaaggaaagacataagagactccattttgaaaaagacctgtactttaaacaactgctttgctgagatgttgttaatttgtagctttgccccagccactttgctccagccactttgacccaacctggagctcacaaaaacatgtgttatatgaaatcaaggtttaagggatccagggctctgcaggacatgccttgttaacaaaatgtttacaagcagtatacttggtaaaagtcatcgccattctctagtctcaataaaccaggggcacaatgcactgtggaaagctgcagggacctctgcccttgaaagctgggtattgtccaaggtttctccccatgtgatagtctgaaatatggcctcgtgggatgagaaagacctgaccgtcccccagcccaacacccataaagggtctgtgctgagatggattagtaaaagaggaaagcctcttgcagttgagatagaggaaggccactgtctcctgcctgcccctgggaactgaatgtctcggtataaaacccgattatacatttgttcaattctcagatgagagaaaaaccgccctatggtgggaggtgagacatgtttgcagtaatgctgccttgttattctttactccactaagatgtttgggtggagagaaacataaatctggtgtacgtgcacgtccagtcatagtaccttcccttgaacttaattatgacatagattctattgctcacgtgtttgttgctgaccttctccttattatcaccctgccctcctactacattcctttttgctgaaataatgaagataataatcaataaaaactgagggaactcagagaccggtgccggtgcaggtccttggtatgctgggcgccagtcccctgggcccactgttgtttctctatactttgtctctgtgtcttatttcttttctcagtctctcgtcccacccgactagaaatacccacaggtgtggaggggcaggccactccttcaatccaacactgaaatattcccagtttaatcgacagtggaaggcatctgatcaacagtaagctattagtagttagcctactgttagtagaagttaaagtagcattatgaagtgagagggaacaaagattttacaaggaaaatgaaaacaggaatacctcttaaaaacgatcaaaatccctacaaacatttaaaacaactttaccttacagagtatttttacataaattcactgaatgtgcatcgcctgagctcctatcacatgccattattccaggtgtttgatatataaaagctcccaggcttcatgttgcttacagtcctcatatcctcacagaggttaccaattcaggacaggaaatgagtatgacgggtggggtaattggccaaaaaaaaaaccaagatgaatcatgggcatggcaaatatgatttaataagatactgacaagttcctagtaagtaccagtgaagtagataaaactaggataagattttaagacattttttgccttagaatatttactgttttggataatactgcaattaggatatgtttaaattacatttaaaatgtcaaggccgggctcagccttgccttgtaatcccagcccttcgggaagccgaggcaggcagatcacttgaggccaggagtgcgagaccagcctggccaacatggcgaaaccctgtctctactaaaaacacaaaaaaactgcacaggcatagtggcacaggcaaggtagcacacgcctgtaatcccagctactcaagaggctgaggcacaaggcggaggtcacagtgagctgagatcatggcactgcactccaacctaggcgacagaataaaactctgtctaaaaggaaaaaagaaaaaaagcaaataaaatgtcaaaggaccaatagtaagaaagataacatgatgtaaaatatttccatggagaacatggttatacttttgaaggaaacacaatccaatgggctcatgttattcaacgacattcatgcatcttcctggtgcaaactgaataatatgtggagttctatatctgaacaacaaaagagattctgaaaagtacaagaaattaatggataggcacattgatgatgtccagcccatagaggtcaaaggaatacgatttttgaaaaatcgttttccaactaaaattgtatttcggtatcaaatactatctcaaggtaaaaatgtcagtatctttctttcctaaaatatatttgaccattttctcatgcacgagagttgtcctatctttccaccttggcttctttcacagttcaaaggttgattcactgtgcgggaggctgcacagttaagagttaatgtgcctcagtgtgcaaatgtgttcacatgaggtcccaatgacaatgatgcacctcatgacaagcaagaagtgatctcagtaaaaacttaaagttccagattttttttaaaaaaaattggctattgcactcaactaggctaactttcctaaaacagcaatgggcaataaacacaagaaaaatactttgccactgggacaaataaagttagttaagataattgaaaccattaaaggaaatggcaacagggcagcgttaaaaacatgaccttggattcagactgctcttaaattactgctcaaccatttactcattgtgttacccctgggcaagctgtttaagctgtttgagctttcattctcatctatgggagggggaaacacctgttacacacaaatgtagcaataagctttagaaataatctacggaaaactcacaaaaacaaagtctagcacacaagaaacttaaatggtaaaacgtatctaagtcagaagacttgtactgatattgacttattgaattatgatttttcatcactttttaaaaattaatttctttttagagatgggatcccgctatgttcccaggctggagtgcagtggctattcagaggtgtaagtaaagcacactgaagcctcaagcttctggcctcaagtgatcctcttgcttcagcctcccaagtggctgggattacaggtgtgagccaccacatccagcttcctaagtcacttattaaagttctctgggttggctggcacgatggctcacacctgtaatcccagcactttgggaggtcaaggcaggtggatcacctgaggtctggagttcaagaccagcctggccaacacggtgaaaccccctctctactaaaaatacaaaaataagccaggcatggtggtgcatgcctgtaatcgctgctactcaggaggttgaggcaggagaatcacttgaacccagaaagcggtggttgcagtgagctgagatcgtgtcaccacactccagtatgggcaacagagtgaggttctgtctcaaaaaaaaaaaaaaaaaaattatctgggtctcagttgtttccatttctaatataaaaggactatacttgataacccgtatggtacatcccagcaacaaaactttgattccataatttaattttgaactacttttttctttttttgagatggagtctcactctatcacccaggctggagtgcagtggcacgatcttggctcactgcaacctccacctactgggttcaagcaattctcctgcctcagcctccctagtagctgggattacaggcacatgtcaccatgcccagctactttttgtattttagtagagacggggttttcgccatgttggccaggctggtctcaaactcctgacctcaggtgatctacacatttcggcctcccaaagtgctaggattacaggcgtgagccaccatgcctggccagaactactatttttaaatggttttattttcaaaaataacatttgtctttccagtgaagttttaagtaataatgcaccccagaatcaaccaacattgacgagaactcctacaattatttatacaggataactgtgacaatgggaaaaacaaaaacacaaaccaaaaggaatcatgtttcatccccatggatagatctccccttgcaaaatctgacagagttaagtctttactaattctttcctctgttgcttttacttgtcaaatcacagtatgttcatctttcttgcctaaaaaccttaatacggctgggcgcggtgactcacgcctgtaatcccagcactttgggaggccgaaatgggcggatcacaaggtcaggagatccagaccatcctggccaacatggtgaaaccccatctctactaaaaatacaaaaattagctgggtgtggtggtgcatgcctgtaatcccagctattcaggagtctgaggcacaagaattgcttgaactcaggaggcggaggttgcagtgagccgagatcgcgccactgcactccagcctggtgacagagcaagattccgtctcaaaaacaaacaaaaaaccttaatacttggtgctagcagcaggaggcagcagagatcctttggctgccagggaagctgagatcaacctaagcccagacgagccagggacgtgactctcaatcatcccactcagggagccatttcacacacatgaggaacaagtgccaggtttctctgggtaaagtcagactttgagttcagcagcagtgcggaaaagaaggctaagtctagggctgggagctagaagccccgagtcccattccaaattaactagctacaggttcagagaaagttccttcttttccttgaacctcaaattcatcttcaaaataaggggcttggttaaaatggtctcaaagcttgctttctgtacatcaacatttgtgtcagataccatctattactggtcttcgcaacacaaatctgctcctctccaccacaacttgattgaaataggtcctgtaatcttgtagataagtcggggaacagtcaagcataatgtggagactcctctaaagactgtctccctggccttgctcacagcccagagtgcaaagcttcccccaaaattctgaactgtaaaaagaaatagaatgagagcaactttccaaattatgctctgctactggtgataagcggtggactttcttcctcccacacctgaacaaaggacacagagcagggagactctgtctcctcctactctgtgggtaacagaacctaatgaagcacccagagaaacccacgtgggcagccagatgggctggcagaggaaggaggcgaccccaagcaggagttcttcattgagaatattaattacttgtgggcgtgcgggacaccagaggggttctccgcaagcctagaagtttcctgctggaaacactgagggttccactagatttcccttccacagtgaaacacacaaggcaggtcccaccaactgcctgtgaaaaccaagatgttaaactcaatggaggagcttggaaatacctgttaacaataaaagaggacaagagccagagacacgctcaaaccaaaaatccaggggacggcgtccttacccacattgtcctgaaatagcctctgctcctttttctttcatctctaactggtgagaattaatgagaaaagccagcagctgtacttctgaatgtcatcaggaagaaagttaaagctgctgtgcccagcactgggactgcacaaagcaatggctcaggaaagcagcttagtcccttgaaacagagccacctcaccacatttcctgagtcaagggctcaacatcctgaggagaattccaagtcaatacagcatcgtgtgcactaccatgctgaacaaacccagtaatatcaaaatgtttaccaaattgacatgaaagcttctggtctgaacttgaacaatactggttcagtcataacaaaatttactgataaacagggccactgaaagaattacaatggtaaataaatactaagtgtagagagacaaaatcagccaatgatacaggtgagaggacctgcggggcaccaccgtggctctcggcatactagagggttgcaccccaaagggagaagtctggaaaaacattgggttttaaaggtctcatctggttacatattataatatctacttcataaaatctaatggctatactttttttgtttgtttggagacagagtctgtcacccaggctgaagagcagcagtgacacaatctcggctcactgcaacctccgtatcctgggttcaagcaattcctgcctcagcctcccgagtagctgggactacaagcacgtgccaccacacccagctaatttttgtatttttagtagagatggggtttcaccatattggtcaggctggtctagaactcctgacctcatgatctgcccgccttggcctcccaaagtgctgggattacaggtgtgagccaccgcacctggcccacccttattcttgtttgtctgtttgagtcagaatttcgctattgtcacccaggctggagtgcaatggcacgatctcggctcactgcagcctccgcctcccaagtccaagtgattctcttgccgcagcctcccaagtagctggaactatatgtatgtgccaccactcccagctaattttttatatttttagtagagacaaggtttcactatgttggccaggctggtcttgaactcctgacttcaggtgatacacccacctcaacctcccaaagtgcagggattacaggcgtgagccactgcacccagcccccttattcttaatctccacaatcaaactacaaattatgcattactatttcgagtttacaaatgaggaaacagactcacagaggctaagtaactgatcaggagtacaagatagaagtgccaaagctatgatgttaaatcaagtctgtcaccaaagcacaatacaccttacactttctcttatcccagtggttctcagtgagaggaaaactggcaaagttcagagatatttctaattgccacaatcagggatggtgacagctgatactggctctgaggggtagatgccagggacgctgctaaacatcctatctggtctgaagtgccagcagccctagggttgagatggggcctacacgtagttatgggaccaaatgtgagctgaaggcatttcaagaagggaaggcatcctcttaattgggtactgtgagaagcctttgtcacaatggtgggattttcgttgagtcttaaaaatgtgggtagacaaggatggcatttctggcagcctagaacaaaagagatgatcaaagatgtggagataaaaaacggaaaggtgcccttaggggtcaagatgattaccagtgagtactttctctaaactacctacaaaataaaaccagtaaacattcatgaatgaaaattctggtaaatctgcacattataaatgtttgggacatctttgaacattcataaaaaacgtaagctggtagattccagagggaaatagggtacctgagggacatcactttttgtctgcaaggggaaatacaggctgacaccagatgatagaaaatcttaaacaggttcccagaaagtgacttaacttctactggacataggcccagtacaattccaaacttattacaggctcataataagtttattatataaaacccattatataacggccaaaatggtaaacccatgagctctgaagccagactatctgggtttgaattcctgcttcaccacttagcactttttaagcgacttcctaactaggggcaagttacttaacctctctgggcttctgtttcctcttgatgaaatcaggaaagtaataatacccatttcacagggttattgtgaggaactcaactatgcaaagtactcaaattatacctggcacatagtaagcactgaattaactatttgctactattagcattactatctctcattacatctttacaataaactaatgaggaaggtatcatttttgtttgttttttgtttttaaagagacagtcttgttctgtcacacaggctagagtgcagtggcaccatcatggctcactgcagccttgaccccttgggctcaagtgatcctccgacctcagcctcccaggtagctgggaccacaggtgcatgccatcatacctggctaatttttaaattttgtttggtagagacacggtcttgcgatgttgcccaggttggtcttgaactcctggtctcaagaaatcctcccacctcaaccttccaaagtgctgggattacaggcatgagccaccacgcctggctggtatcattattttccccacttttattgatgatgaaattgtggtttgcagaagttaggtaacttggccaaagccctttggtgaatgtagggtatatttgatgccaaacccaagctcttaacaactccatatattgcttcatgaaggccaagaacataaagcttcagcaaacaggcaatgggaagccactaaagaattctaaatgggaatatgagtcattaaagcaaggttttacttgcaatagaaaggagaataaactggaaaagggaccgggaattggatgggctgtatgcacagagagccaagaaaagcctgtgaaaaggtactagctggaggtgataagggcctgaactaaagaggacagcaacagaaatacaaagaacatcaagagtaaaagacatggcaaaggagagttcaacaggcgggttcctggggaagcacagcaagtgatagagtaaggagaatgactggaacatggtcggttatccatgactcttaagaagaaggtctacagtgaaaggatactaagaaaatactaagaaaattggtctgctctggcttgttctgggaaatgatataactgtgtcagtctgcaataaaaaatcttcctagtactacccgggagaaagaaatactgaaaacataggctgaatcaaaggggttgaagggaaacctcaggtaagtagattattaactggagtatgtaatttcttgaacaacttactacactgaaagttctgcgtaagcttagggggaaaaaatccagattccatgataatatttttcttaaagaaagatgggttcacacacacaaaaccaaaaccaaaccaaaattccattaacactgcatataagaacaaagtgcagaccacatgacacaatcaaattttcagcttgaatttctctgaactaaagaaataatataagagctctttctaagtttccaccaaaaacagggtacatgaattacagtgaggataacacacgcattggccaggtgtggtataatcctagcaactttgggaggctgagatgggaagactgcttgagtccaggagacaaagagaccagcctgagcaacacagtgagaccccgtctctacaaaaaaataaaaattagctagcacggtggtgcatgcctgcagtcccagctactagggaggctgaggtgggaggatcactagagcccaggaggccaaggctgcagtgagctgtgactgaccagtgcactccagcctgggtaacagaggaagaccctgtctcaaaaaacaaaaacaaaatgaagaacacaggttaacttatttaatcttcggttcattcaacaaggatgcactgaggttccactgaacctcagattttcatctttcaacttacagactccttcaacttgctaaggctatattttcttctctagaagataaaataaatgtcaatggctcatctgtgaattcacctttttttttttttccctgagatggagtcttgttctgttgcccaggctggagtgcagtggcatgatctcagctcactgcaacctccacctcccgggttcaagtaattctcctgcctcagctggcagagtagctgggattacaggcgtgtgccaccacgcctggctaatttttgtgtttttagtagagatggggtttcaccatgctggccaggctggtctcaatctcctgacctcgtgatccacccgccttggccgcccaaagtgctgggattacaagcgtgagccactgcgcctggccaaattcaccttcttacacactaagcctaaagggtggtggtgtggtcagtcacttaaggcaacagcaagcccctctgaaagcatgaggttctgggaaatgatggagcctgcgggaaatacatgcaggcagctatttctgaaattattcagtatttgttagaatgtgtaattcctttaatattttcaagatttatcaaaaataattaggagattcttcccaagttttaacaatatggttttatttttttgtgtttttttgtgtttttttttttttttaaagactttagagttgctgctaaatgttacaaataatacactagtcttatttggggatcaaataattccacttaacatactaatttctgccctcaccacataacctcttctacattaaagttgttcatttgagatatcagcctgtcgaaataatgaataaaaatgctactatttgaaagctaagggcaaacagatacagtactgaacaaaagttagccataaatctaggcccacatgtatacctagcataatactacatagaaacacctcaattcaactgatatagaagacaatgtagtgaacttttccctctccagcccctcttctcaagtaacatctgtcatgttacagaataagctgccaattttccatacaaggctgggtgcagtggttcacacctgtaatcccagcactttggaaggcagaggcaggcagactgcctgagcttaggagtttgagaccaccctgggcaacacggtgaaaccctgtctctactaaaaatacaaaaattagctgggtgtggtaccaagcacctatagtcccagctgctcaggaggctgcaatgagctgagattgcaccacttcactccagcctgggtgacagagcgagactccgtctccaaaaaaaaaaaaaaaaaaaaaaaaaccgtacaaaaggaagaagagatgaacacacaggcaggctaaacaaagttatctgcacacaaattcaacagaaatatcaaagatgcttttactacacaaatttaaacttcaaactttttacaggcaatgagtagaatacatactgattccatgcagaacactggaatgggcaaacactgctaattaggaggagttcttccatctacgcatactttcattctacagatgtttactagagcatcatctctaagcctgaccctagctgagggttttcttctggcagggcaactgaacaaaacacacatctaatacagtaatttctatatgagttaaacatttccatttttttccccagctttactgaggtacaactgacaataaaaactgaatatattagtagtgtacatgtcttgaaatatgtgtacactgtgaaatgattagcacaaaacagctaattaacctaacccagtatgacatatagactctgtgtgtgtgtacatgatgagaacattcaagtctactctgttaacaaattccaagtacacaataatgttaactatagtcatcatactgtctattagatctgcagaatttaaccacgttataactgaaactttgtacacaactcttcaattatctattatttaatctccatccaaggatacttagtaaataaacccagtaagttatttcttctaaattacttcctaatgaactaagtggatgttttatagtagatactgaacaaaaacaatgtaattgtaccatgtcacataccttaaaaaaaaaaacgacaggcaaaaaacgtatgcctgacaattacatgttgttcccttcacaacacaaaatatcattaaatactgacttaataagagttcaaaatgttatgcactgatacatatgtaacatacataacatatatacattatgcactgatacatatgtaatacatatacatatttgtaaacagcattcatgttgaaagcctaaccaattaggtactagggcctaggggctgccgtcaaaagtctcacctgtcgaatgatactcttcacacaacgtactgggaggccttgatagttggatttgatgatccacttgaggagatggtggccaagtacttcgaagaccatgcagacatctgggacacagttaaggatcgtttgtggatgcactgcctggagtgaggcagttattgaaagcagcaccattgtgtcacttgcaaagcacttattactttataaaatacaacatcaaccctatcagtaataccaaaagtgagaaaatgttgtatctcacttaaataacaagaactgacattactaaatacaggtgtttcccagtatctcaggagattggttccaggaccgctctcagataccaaaatgtacatatgctcgcctcttcagtaaactggtgtagtatatacataacctattcacatccttccatatactttatttttatttttttttgagacggagtcttgctctgtcgcccaggagtgcagtggtgtgatcttggctcactgcaagctctgctttctgggttcacaccattctcctgcctcagcctcccgagcagctgaaactacaggtgcccgccaccacgctcggctaattttttgtaattttagtagagacagggtttcaccatgttagccaggatggtctcgatctcctgacctcatgatccacccgccttgggctcccaaagtgctgggattacaggcatgagccaccgtgcccagcccatatactttatttaaatcatgtctagattacttataatacctaatacaatgtatatgctatgtaaatagttgttatactctatttcttaatttctactactttttactggtgtttcccaaatatttttcatccaacgtttattaaatctatgaatggggaaccagcagataaaaaagggctaagtgtacttactctgtgccatatattatttcacgtgtactccaaacaaccttaggcaataatgtaattaaccccactgtaggcatgaggacatggcactttctaggtgtagagtgcacttagaaagtgccaggtggctgagccactactcaagcctacactgagctgcactctcacccatctcagcacactccctggaaatcagcctgatgaaacaggcaagactgaaacctcctaggaactgacatgaaacaaatacagagctccagtatctcaagtgtcctaactgcctgcctaaatttctacttgataagctacataaaacacattataaaataaaaatttagtaaacacagttaagacctatttaatcttttccttgaataatatcttacattatacaactagatcaattttaatactataggcaggtgttaagaatgtatgatcaccatttaagacatggtattaagacttaatctatagtaacaacatctcaggaatctggattttcttttcttaaaaaagacagggtctcactacgctgtgccaggtggactagaactcctgggctaaagatactctcttgccttagattcccaagtagtcagtactacaggtgaaaaccaccatgcccagcttaatttttttttgagacacagtcttgttctgtcacccaggctggagtgcagtggcacgatctcagctcactgcaacctccacctcctgggttcaagcgattctcctacctcggcctcccaaatagctgggattacaggcgtgtgccactatgcccagttgatttttccagttttagtagagacagggtttcaccatgttggccaggctggtctcaaactcctaatctcaagtgatccacacaccttggtctcccaaagtgctgggattacaggcatgagccaccacacctggccccaacttaatttttttttaaaataggtatttcagccttcacaactatgatacctccaatttcattatatattcatgtcattcatacaggaagattacaaatggctctgaaaccctttgagaacattttattcatccctggaggcttacatttgactttagaatcaaaaaaagtagttgatttaatcaactataataactgaatatgctatattaaaacaatattattttaaatatttttagtgaaaaaaagaaaaatctttctatactgtttaagaatgtaagcactacagatttatgcgcagataatctaaagccagaagtttcttactatttcccaggctcattacaaaaacggcagattatttaaggactacatttagcagcaggcatagggcgaggcccaggatatcccaaacataacctaagtcttctcaaagcactggcatatctggatatgatgattacttcgcattttgcttaacagtaaaaatacccactagaacgtatatttcaaaaacctctatttacccacggattaagtagtttctccaaagaaatgttctattagctgtcccaagaaggaccttgcaagtcggacacagaagaagtgagtgctctgccgctatctgcttactgatttatctatccaaagggaaaaatatactcagcagttagcagaaattaactggagaaaaaggacgaggtaacattagcagccactggtacttcctagtatactcaagatgaatttctaaaagaaatatgagggattttcaaaaagtctatggaaaatgtgtattttgaaaacactatgcatagatttcaaaaatttttttgcaccaaaataaactcatactagtttgttaaagtatctgaacaggatctagtttgaggcactcgcaagataagacatcagtttgaaaaaagcctctaacagagcaacatgaattctaaaatcaaagcaataacaaacatcaaatttatgatgaagcttgggtgaaaaaatggtgaaatcactgatgctttatggtaagtttaaggggacaataccgcaaataaatcggcagtttacaaatgaataaccggttttaagaagggatgagataatgttgaagatgaagcctgcagcggcagaccatttgcatcaatttgtgtggaaaaaaagtttgcggccgggcatggtggctcacacctgtaatcccagcactttgggaagctgaggcgggcagatcacctgaggtcgggaattcgagaccagcctgacccacatggagaaatcccgtctctaaaaaaataaaaaataaaaaataaatacaaaattagctgggcgtggtggcacatgcctgtaatcccagctactcaggaggctgaggcaggagaatctcttgaacccgggaggcggaggttgtgctgagccgtgactgcaccattgcactccagcctgcgcaacaagagcaaaattccatctcaaagaaaaaaaaagtttgcaccctaattgaagaggacagatgacagcacaaacaacagccaacaccacagacttcacgactggttcaacttatgcaattccaattgaaaactgaagttgagcaaactttccactcaatgggtgccaaaaccattgttcccagatcaagacaagagcagagctttcaacggaaattttaaacaggtacgatcgagatcctgaggcatttcttcaaaggactgtaacaggacataaaacatggttctacagtatgatcctgaagacaaagcacaatcaaagcaataactaccaagaggtggcagtggtccagtcaaagcactagtgaactagtgaagaggaaaggtcactgcaaccgttttttgggatgctgaggcattttgcttgttgactttatggagaaccaaagaatgataacacctgcttattatgagagctaattttgagaaagtcagtgaatgctttagcaggaaaatacctcagaaaacttcaccaaggagtccttctccaccatgtaaatgttcctgttcattcctctcatcaaacgagggcaattttgtgaagagtttcagtggaaactcattagacatccaccttattatccttatttggctactcctaatttttgtttcttaatcttaaaaagggcacccatttttcttcagttaataatgtaaaaaagatttcactgacatggttaaattcctaagacccctggttctttggggagcaactaaatggctgatatgattgtttacaaaagtgtcttgaacttgatgaaacttatgtgagaaataaagtttatattctttatttttgtcttttaatctagtttttctatgaacatggtgacattcccttgtataaaaaccttctcaaatatatagagtgaaggaaatgcttccctagttgatcatgacttagtagatgcataaactggatgtcattttggagtttaaatctgggaaaaagccttatccttaggcttctgacatttgtgaaagtaaaatatcaaaatggtggatctgttccaaacatgatataaagagcaaaaaatctgaaagaagccagaagaccacagctactgacacaacctagcacccatcagtcatgtgcctctgagtaaagtggtccgattttcttgaaccttggaaaatgaaagtactgcctactccaggcacacaaagggctatctcagaggatccaacacccacataaagaaaaagtactcatgacactgaaggcatcatctcttctcttcatttttgctttcttctctgagctacaggttttgggatactttgctctctgtcacttctccctggagctaccctttgccaactcctcaggtagaggaaggataaggataacatgccaaccctttctacaatcctaattcacttcctcctgagtccccatcaaaaccaacaagcatccacataacttagtagcatggtcaaaactgatattctcaaaaaagaaaggaaagtcaagggacacctttgcttgtcttcttcctagacacacttccaaagataactagtattagtgagaggtgaagccagctggacttcctgggtcgagtggggactttgaaaacttttctgtctagctagaggactgtaaatgcaccaatcagtgctctgtgtctatctaaagattgtaaatgcaccaatcagtgctctgtgtctagctaaaggattgtaaatgcaccaatcagcactctgtaaaaacgcactgaccagtggtctgtgtctaaaggattgtaaatgcaccaatcagcaatctgtaaaaacacactaatcagcactgtgtctacctaaaggattgtaaatgcaccaatcagcactctgtaaaatggaccaatcggcaggtccatttctccaacgtgggcacggacaaatgagggaataaaagctggccacccgaaccagcagcagcaacctgcttgggtccccttccatgctgtggaagctttgttctttcactcttcaaaataaatcttgttgctgctcactttttgggtccacaccaactttaagagctgtaacactcaccatgagggtctgtggcttcattcctgaagtcagcgagaccacgaacccaccgggaggaacaaacaactctggatgcgccacctttaagagctgtaacactcactgcaaggtccgcagcttcattcttgaagtcagtgagaccaagaacccaccagaaggaaacggacacattacgactaaggccatccatccttttaaaaaacatgagaaacacctacacttatagctgaccaagaaacactttcctctgttaagaatcactaacttctgtcaggataatttaaatactctgtggatcatagtctaacaagaaacagaaaaatgtaaattgagcaaattaatctgaaactgaacaactaaagtaagtgaatacagacttaggagtaaacaatattgttaaaaatgattcaaatatgtctttaaaagttcatttttgcaataccaaggaaatctgtattaagaagtctccaataccaacgatatctgacgagatatcaagaacccgttaatgtctttggtgagttttaaggttatgtttaaaagttcatatttttttcaaagattcacaatgacacagaagtaaaaggacatgacttctaggatttgctctataataattcagcaagaaaagatagatggatcaattatggccagaccatgacaattattaaacttgagtgacgaatttacaacaatttactgtagtatgatctctttcttatatgtttgaaatttctcccaataagtttgtaaagaaaaacaataaaggtattttcgatcaagcactggcttatgtcagatttatcaaggagtatagaaaatgcagagtatagaaaatgcatcattttacttttccttaacttttgcaatatagataaccaggaataaaatcaagaaaaccaaaatgtttccatactcacctgacagaaagatgagcctctgcaggacaattatttgaaaggctcagttgtatcattttggaaaaagaatttggcaattattagtactattcagaactaagagcagtcaagcgccaccttgggatgtggacatttacagagcatttttccttttatcttaaccaatgctccattttcacatggtgctttgcagccactggggcacacacagattgtccttatgcactggttttagaaagtttaaaacacaaagaagtggtgctgatgtatgcttttatctaccaccacaaaaaaaactttaccactattaatgggaagagatcaataattaattccacaccaaaattaagtcaagttgttgtgttaaaaataagtttctaagatgctactctaccaaacaccccaaaaagccatgaaaactattctaggtggaccacttcataatacttgacaatgttcctagagtgtttatgttgaaggtgatacagcagtaaacagagattataggagcttgaaatattttcattttttaaaaggtaaaaatacaaataaatcaggaagtaaaggatacgtatcccattcatgcctgaaatcttgaagtcgtcaatgagctggaccaccatgtctttgtttgggtcactgggatcactttctcgaacctatgccaagaaaaatgaatgcaagaacacaggagtttgagacaaagcatgttttcccattataacaccaatactgtttaaataaaagtatattttaaaataaaaaattcatcacaaagttataaaaaataaactttatttatttatttatttatttattttttgagacagagtcttgctctatcgcccagtctggagtgcagtggtacgatctcggctcactgcaacctctgcctcccaggttcaagtgatactcatgcctcagcctcccaaggagctgagattacaggtgcccaccaccatgcctggctattttttatatttttagcagagatggggtttcaccgtgtttgccaggctggtctcgaactcttgacctcaagtgatctgctcgctttggcctcccaaagtgctgagattataggcatgagccaccgtgcccagccaaacttgactttaatttagtattacccagaaaaatctttctgtaaaattttaagtcattaagttttcttatatcattcacatttttaaagtacttacacatttgagcaattttatttcatccaaggctgtctccgtataatgctgggcactttttacaactttcattgcaacaaatcttttccccctaaaagaaaaaacaaaaaaagagtctatttatctatattatcagtagaaagaatcactggtatccaggttgagcatccctaattggaaaatgtaaaatccaaaatgcgccaaaacctaaaacattatgagtgtgtcaacacgatgccacagtgtaaaattccacctctgactgcaatcaaaactcagtaaaagatttgcatgttgcacaagattatttaaaatatcgtataaaattgccttcagggtatgtgtatatggtgtatatgaaatataatgaattttgtgtttagatctgggtcacatctccaagataggtcattgtgtatatacacaaatattccaaaatccaaaacacttctggtctcaaagcatttcagataagggatattcaacttgtaatgagatctatccaatacacagaaacataagctttcctttaaaatagtacttttcaaatggtggggccacattaaatagtagtatgggtcaagacaatctcttttatgttttgttttgttttttccctaattaaaataagactagataaacatcagagttatcacgaatattacacaccaacctaatagtgaaaaccattctcttttaacacttttgtttcagtacacacacacacacacacgcaccaaatgtgtgtgtgtgtgtgtgtgtgtgtgtgtgtgtgtgtatggagtagcaatgaagtttcttactatgggtcatggctttgaaaagttaaaaatgactgatttgaaacgcctatactatacattatgtttgtctgatatggatgaattactagaaaaataatataatcccagtgtaaaacaatttcaatgaattaactttgaaataaagctggaagcaagtaatattttaagatttcaaatgaacttcaaactaaggcagggggcaggaaggaatctagccagctgaggcaggcctgtgctaagcacttcacatacctcaacaaagcagtggtgaccctcagccataccttcttagaacacagatgttgaactactccaggaaacaaatgcacaaatgacaaagaacacttactgcatatcccagcacagccagacagtagagaagtgcccccatccaagctttctaataacatgataccggccattgaagaggtctccaattttcactggatgatatccaccttaaaaaacaagaaagaaagaaaaaaattcaaaatattcgaaaagtagtaataaacatttcatctcttttgtcattcttgatgtcattaaagaaagctctacataatacatgcagactaaaacatgtttaataatacaacatttttttcaggaatatctttcaacaagaaaaagtgttggctggatgtggtggcttacacctgtaatctcagcactttgggaggccaaggcaggtggatcatttcagatcaggagtacgagaccagcctggccaacatggtgaaatccagtctctacgaaaaatacaaaaatcagcagggcatggtggcgagcacctgtaatcccagctacttaggaggctgaggggagagaatcacttgaaactgggaggtggaggctgcaatgagcctgagtgaaaagtgtgcgactgcaatccagacagcctgaccaaaaagtgttctatgaattcctattagacttcttgttttaatttaatttaaagaggcaatgaaccatctagcacaccgtaatgataacttgaggttctctatttacttatttatttttaagacagggtctcactctgttgtctagactggagtgcaatggcatgatctcagctcaatgcaacctctgattcccaggctgaagaggtcctcccacctcagcctcccaggtagctggaactacaggcacacaccaccatgcccagctaatttttgtattttttgtagggacagggtttcaccacattacccaggttggtcttgaactcctaggctcaaacaatccgcacatctcccctcccaaagtgctgggattataggcatgagccaccacacctggccaaggttctgtatttcaatctaggtgtgtacgttatgcacataccagctcttggtatttaaagactttttttctcctaaacaagttaaattcaaatctttttggatatgtgcaagaaaactgaccaaaataaacaatgtttactctgtataattctgcatacattaatggtttattaataactagaaactgtacaatgatgtcttaatttaccctctaacagggcttgttcctctcatcactcttctgccaactcctaactcctgcctggaaacattcctcacaaatgaagaaatgaggccgggcacggtggctcacacctgtaatcccagcactttgggaggccaaggcgggcagatcacctgaggtctggagttcaagaccagcctggccaacacggtgaaaccccatctctactaaaaatacaaaaaattagtcaggtgtgctggcgaactcctgtaatcccagctactcgggaggctgatgaagaagaattgcttgaacccaggaagcagaggttacagtgagccaagatcaagccactgcactccagcctgggttacagagtgagactccaccaagaaagacaagaaagacaagaaagaaagaaaaggaaagaaagggaagaaagggaggaaggaaggaaggaaggaaggaaggaaggaaggacgggagggagggagggagggagggagagagagagggagagaaagagaaagaaaggaagaaagaaagaaagaaagaaagaaagaaagaaagaaagaaagaaagaaagaaagaaagaaagaaagaaagaaagaaaggagaaagaaaaagaaaaaggaaagaaagaaagaaagaaagaaagaaagaaagagaaagaaagagaaagaaagaaagaaagagaaagaaagaaagaaagagaggaaggaaggaaggaaggaaggaaaggcaggcaaggaaaagaaaaaagaaaagaaagaaaggggaggggaggggaggggacgggaagggagaggaagaaatcagctatagagggcaccctattaaggtagattcttgagggcaagtagggtgcctcactgatatctggcatgagaagttcttcacttcgcatttttaagcagaataagcaagctacaaactagcatggataatatggtacactttttgtgaaatacggaggataagatgttaggaatggacattcctgggtataaaattactcttaagtctctttatctacattttattctttttatctatgctttttcaatttcttcaatttttctaaaacaatattttactacttttttactttggaaacagatttttcattcttttaacatttgcttttttattgtaaagatgttatttcttttttaatctgcagaattcttacaaattactcaataaagatgtggatggcttgtgcctagtcttaagagctctagagcagttataggaagtatctaaccagatccttcaatatattcccagagggctctcaataatacttcaagaatatatttctgaacatttaaattgtgttggattagtgaagcaggaatctgaccagatactgagttcgtgagattcttacccttctactgcctctgcacttgcttgtcctggatttgaatctcaaggtgtatgacaacattttgggctaaatatatgaactaaatgatagtgaattaggaataaaatgtagcaaattattaaatggcttactacttagaagattaaactaaaattaattaaaagaaatgagctctgagtttataatacagttatttatttatttatttatttatattttttgagaccgagtttcgctgttacccaggctagagtgcactggccatctcggctcactgcaacctccacctcctgggttcaagccattctcctgcctcagcctcccatgtagctgggattacaggcttgcaccaccacacctggctaatttttgcgtttttagtagagacagggttttgccatgttggtcaggctggtctctaactcttgacctcaggtgatccacccaccttggcctcccaaaatgctgggattacaggcatgagccactgcgcccagcctacaatacagttttcaaaccattaaaattaacattcaaagcaggaaatgaaacagtttatccagtataattaggaacactgtgcgaggcactttattttcaaaactatgttccatgaaacaaaaataaactataatatactgcaggtgttcaatagaggagcaggggagtaggaaggaagaagggagaagttctgtttgagaaacgcagtgttgaacaaagaaaagcagatttcttgaccataggcctaatgttttaatacagagtgagaacctttaagagaacagaaaatgctgcatattcctgacatacgtgttcatggaattatttcttcagagacctagttacattttataacacaagtatttaggaaagactgatctaccataattcttgaaaccaccatacaaagtagatggtattatttctacaatgctacagagaacaccaagtatcatagattatgaagtactaggttcacggctggaaactaggtatgactccaaaacccatgttttatcaactagtaagaaatacactccaattttaataactagaggactgcttcctggtcttagtacacagaaaacatgggatgtcttaattaaaatctatatactacttaaacgtacattattgctaatatttgtcactaaatttaaaaataatttatgcataaaaagaaacctgtatcactagtatatgtttcagattcaaattctcaattagccgaagtgtatacatgtgagcaaaaacagaagagcactatttccaatgtaatcacagtgtaagcatagcagctccttttctcaagggctttgaaagctaacaacaacaaaattactactggagtaaagtatccctgaagccctcagtctagctaaaaatattatctctataaaaaggcaaattacacaagaggggcattttttttttaaagagatgcgggctagctctgtcacccaggctggagtgcagtagagcagcacgaacagggcttactacatccttgaactcctgggttcaagcaatcttctcaactcagcctccaagaagtacatgccaccatgcctggctagtaatagtatttttaaaacaactgaaagtataacgcacttaacttacttctattttgaaaacgtgatatacacaatttcaagtctatgtatattctcatattgtaactcctggtttcctacacaatcaagtatcttctgaccattcatttttcattcccttctcacagaatggcagccttgctcacagggcatctcctctaacacccatgctgccagaagagtggtctctgtccccgtgcaccagaccacactaacctaatacccagggaatctgaaaaaatgaacactccagtaactccaccagaaatgaccccaattccctgggcttagttaactatgtgcaccataatggctattagcaatggaaccccatggtctaccacattgcccagcacacaagaaaacaagtacagtcactagacaaagactcaaactttattcagtttgctgcttcaccagagaacagaaaaggagtatgggacaataacactgctatggaccctgctaatagcattaggcagggtgccagaaagcctcaggcacttgaagatcaccatgacttaagagtttggttgataacacctgtacacttcactatttgtactatttaatataaaaaccatgcatttatcaaatagttgtgtgttggtgtttttttttttttttttggctgcttaaaaaaacaaatcttagccgggtgcagtggctcacacctgtaatcctagcactttggaaggctgaggcaggtggattgtttgagcccaagagttcgacaccagcctgggcagtacagtgagaccctgtctctaataaaaaaaaaaaaaaactcttatcggattacaaacacaaagagaacaagaacaaactgttaagtaaccattaaattcattgctctggtttcttctacttccatgcctctagcacagccaagatttctgtaactaaaactctacctatgctaataagaagactccaaagaagaaaattttaaaactctcctttttacctatttgggagacttactggccaaagataaaggttcccttttccttgcctagcaaaaatagattctatttatggagttaaccagaagttcagaactccatgacaatgttctggaagtattttcaacaaagtctctttattttcttaataaagataatattaagtattacctgagttccgctgagaatgctttctcagccctctgattgtggggtttctctacataaccactgaaaactttcaaaggactagggaaagctgagaatcacccccaacacacacaatgattaaaaaaaggaaggggtggaaaaaagaaatttgttcacagtaacataacataaagacacattctgtgtcactgaagattttaatatttccttcccccaaaactgataaaagcaagcagacataaaatcagtaaggatatggaagatttgaacacactatcaaccagcttgacctaattaccatttatagatcactacactcaacaacaaatactcttttcaagggcacacaaaacatttaccaagatatataatgtactagaccataaaacaagtctcaatagaaataagaggattcggctgggcatggtggctcatgcctgtaatcacaacaatttgggaggccgaggcaggtggatcacctgaagtcaggaattcaagaccagcctggctaatgtgacaaaaacgcctctcttactaaaaatacaaaaattagctgggcgtggtggtgcacgcctgtagtcccagctatttgggatgatgaggcagaatctcttgaacccaggaggcagaggttgcggagtcgagatcacaccactgcactgcagcctgggccacagagttaaactccgtttcaaaaaaaaaaaaagaaagaaagaagaggattcaaatcacacaaagtatgtcctcagaccataacagaattaaattacaaaccaagaagagaaaatactcagaaatttggaaactaagtaacacaattcaaaaataacccatgggataaagaagaaatcaaaaagaaaatagcaagtatttcttacattaagtgaaaatgaaaacttaatatatcagaatctatgaaatgctgttaaagcaaactcagagggaaatttatagcactaaatgcctataccagaaaagatctcaaaaaagtaatcttagtttccaccttagaaaactaaaaaaatagcaaacttaacccaaagcaaacggaagaatgaaaatataataataatatgaactataaataagtaaaacaaaaaagcataagaacagtcgagaaaatcagtgaaaacaaaagctggttctttaagaaaataaaagcaattaacaaatttcgggccaggcagattgggcagtgagagaaaacacaaattaccatcatgagcaatgagtgaggtaatgtcactatgtatttttgaggtattaaaaagatagaagggaatattatcatgttatacctatacatgtgaaaacttagataaaatggacaaatacctgaaaagtcacaaaccactcaaggtccaaacagaaaaaaaaatctgaaaaaccatgtatctattttaaaaaatgaatttattgttcaaaatcttcccataaaaaatgcattggtatattttatcttgatattatgaaaaaaatactacaaattcctcctaaaaagtaaaaaaagaggaaatacttccagttttgatcctatgaagccagcattttttattccaaagccaggcaaagacattataagaaaactgcagaccaattttcctcataatgtggatacaaacgttccagacaaacgttcaacaaatcaaatcaaataatatatcaaaaggataaaacatcatgatcaaatggggtttattccaggaacacaaacttgggtcagtattcaaaatccaactgatgtaattcatcataattaatatgctaaaaaagaaaatctatatgatgagcacatcagacacagaaaatcatctgacaatatgaaacattcattcttgatcacaattctcaatgaagcaggaatagaggaacatcaatgaaaagcccacagataacatcagatttaactattaaagaccaaatgctttccccctaatatcagaaacaagataaggatgtctgctctccccatttctagtctgctgttttggaagctctaactagtacagtcatgcaaaataaataaaaaggcatcactgctggaaaaaaaagaaataaaatttatctttattcacagacaagccacagagatgtatgtggttttgcatatatgtgtgtgtgtgtgtgtgtgtgtatgtatatatgtgtgtgtgtgtgtgtgtgtatacgtgtgtgtatatatatatatgcacagtggcatatggttttacatacatatatatagatgtatgcatgtgtgtgtgtacatatatatgtatgtgtatgtgtgtgtgtgtgtgtatgtatgtatgtatgtgtgtatatgtgtgtgtgtgtgtgtgtgtgtgtatatatatatataccacgcctggctaatttttgtatttttagtagagacagggtttcaccatgttggccaggctgttcttgaactcttgacctcaggtgatccgcctgccccggcctcccaaagtgctgggattacaggcgcaagccatcatgccctgcctagtcatatattttcttgagtgaagtaagaatctgttcaatgattttgatcacttttctaatggactgtcattttcttatcactgtagatattccgtatacatgttaataccttcttggttatacatgctgcaattccgctaatattaaccacttccaaaaagtacctggtaattgtcaggaaagtgattaaatcaggaaaaaaaaacacataaaaaagagctggtaaagtgaaaataaaaacatgatatgcagagatatcaatgaaaccttttgatgacttgctttttttaaaagcactgagaatagacggcatgacttgctattatgtatgcactaaccaccacttttcttcactgaaaaaaaaattatttagaacatatgcaaccaatctttttacttcaatgaaaggatatctttagattattaagatgtgtgatacaatgtaaggacacaaaggactgcaagaaaatcttaaaaccttagcatatttgttgtcaatgatgttcttatgaatattattgaaatatctcatttacaagataaaacaaataggtaaatgtcatttaaaaaccaagattttcaacataaaagagttaaaatgtaagtttttaaaaacagtacaaatgatgtgtcaatggaggtttaccaattctaacaaatgtactactctgaaggaggatgctcatcctgggggcggctatgcatgcgtcagggcagggagttcataggttatcactgtgctttcaattttgcagtgaacctaaaactgctcttaaaaaaacaaaaacaaaaacagaaaaaacaggctaggcacggtggctcacgcctgtaatcctagcactttgggaggccgagacgggcggatcacaagatcaggagatcgagaccaccctggctaacacggtgaaacctcatctctactaaaaatacaaaaaaaaattagccaggtgggcatagtggcgggcgcctgtagtcccagctactcgggaggctgaggcaggagaacggcgtgaacccggaaggtggagcttgcagtgagctgagatcgcaccactgcactccagcctgggcgactgagcgagactccgtctcaaaaaaaaaaaaaaaaaaaaattcacaacacattcttcctaagatttgacagtcacattccctgagctgtgaagaaaatgcctgtaggtgatatcaataaaaatgtttcaatctaagaaaacactactttcctcatcagtaatttaaagcacaatttaaattacattcaccacagcaaaaacactaataataataatactaaatataaaaaaagcatcaagactaaggacgtttttaaaagcacttagtagcaaccaaaaatataaacaataatgaagcctctggcacaaccattaaactcccttgaaactggaagaaattcaaaagcagtcaatcagagaagccattgttatttaagaactcttgaatacaagtcaatctctgttattacagtcaaatatttcctataacagtaatgaatgggagactgctctagaggaaaaaccagagcaaaggctaatattccaaaagacacgggaggattcctacttatctacaacctaaaaaagtaacaacaggctgggcatggtggctcacgccgctgataatcacacatgaggcaggaggatcacttgaagccaggagttcgagactagcctgggcaaaagagtgagagtcccccatcattccaaaatttaaaaaattttgctgggcatggtggcgcatgcgtatgatcccagctactccgaaggatcacttgggtccaggaggtcgaagctgcaatgagtagtgatgacaccactgcactccaacctgggagacaaagtaaggccctctctcaaaacaaaacaaaaaaaacaagtaacaacaaaaattacttaagggtaagataaatataaatgaaaacactattttcctcattagtaatttaaaccacaatttaaattacattcaccacagaagaaacactaataataataatactatcaaaaattatgctgtggtgaatgtaaattgtgctttaaattactaataaggaaaatagtgttttctttttataaaatataaaaatataaatggattcagaaaccatttttgcagtgaaatcacacagattaaaggtcagtccgttgattgagcaaccctgaatacctaaaatgttcatgtcaaggccaacacataattctaaacccctgcctactaccaattacttaacagatatttatgcttgaattcagggatgtcgatttgaatatcagcattggcatttactactataacattaagccagttacttaacctgtgtcagcacttgccccagctacctcactcaaaactatacctgggtatatattatgtgccacgttagtgtttactgttctgccagtactctaacccactgtgactaatgacagattaacaaatgagcaggtcagagttaagagtattgtctatggctatttaaaactgtaaaactaactggcccaaagcataatccgattcactacagtagcccaaatagcaattcaggtatgataatttacagctggtaaatgtcacttaaaaaattaaaagaccagggatggtggctaatgtctgtaatccgagcactttgggaggctgaggcaggcggatcccttgaggtcaggagtttgagaccagcctggccatcatggtgaaaccgcatctccactaaaaatacaaagattagccgggtgtggtggcgcatgcctttaatcctagctactggggaggctgaggcaggagaatcacttgaacccaggaggcagaggttgcagtgagctgagattgcgccattgcactccagcctgggcaacacagtaagagtccatctcaaaaaaaaaaaaaaaaaaaaaaaagaataaaatatcttggagtacagctaaccagggaagtgaaagatctctacaataagaattacaaaacactctcaaagaaatcagagatgatacaaatggaaaaacagtccatgcccatggacaggaaaaatcaatattgttaaaacagctatactgcctgaaacaatttacagattcaatgctattcctatcaaactataaatggcattcttcacagaattagaaagatcttaaagtccataaggaaccaaaaaagcccaaatagccaaggcaatcctaagcaaaaagaacaaagcaggaagaatcacgttacctgatgtcaaagtatactaaaaggtgacagtaaccaaaacagcatggcactgatgcaaaaacaaacacaaagaccaatggaacagagtagagagcccaaaaataatgccacacacctacaaccagctgatctttgacaaagctgacagaaacaagcaatggggaatggacttcctagtccataagtggtgctagaattacttgctagccatatgcagaagactgaaaccgcaccccttccttacaccatatacaaaaatcaagatggattaagagttaaatgtacaacctaaaactataaaaaccctggaaaggctgggtgcagtggctcacgtctctaatcctaacactttgggggaccaaggcaggcagatcacttgaggttgggagttcgagaccagtctggccaacatggtgaaaccctgtctctactaaaaaaatacaaaaattagccaggtgtggtggcgcatgcctttaatcccagctactggggaggctgaggcaggagaatcactttaacccgggagatgaaggttgcagtgagccgagatggtgccactgcactccagcctgggtgacacagcaagactttgtctcaacaacaacaagaaaaaataaaagcctggaagataatctaggaaataccattctggacataggacctggcaaagatttcatgatgaaaatgtcaaaagcaattgcaacaaaaccaaaaactgacaaagggaacctaagaacttcctgaacagcaaaataaactatcaacagagtaaacaacctacaggatggcagaaatatttacaaacaaagcatctgacaaaggtataatatccagaatctacacagaacttaaacacatatacaagcaaaaaaccaccccattaaagagtgtgcaaaggacatgaatagacattttcaaaagaagacgtacatgcggccaataagcatataaaaacctgctcaacatcactaatcattagagaaatgcaaattgaaaccacgatgaaacaccatctcacaccagtcagaatggctactaaaaagtcacaaaattaacagatgttgtcaaggttgtggagaaaagggaatgcttatactctgcaggtgggagtgtaaattagttcagccattgtggaaatcagtatggcaattcctcaaggaaatttaaacagagttatcattcgacccagcaattccttattgtgtatacaccgaaaggaatataaactgttctactgtaaagacacacgcacgcacgtgtatgttcactgcgacactattcccaatgacaaaggcatggaagcaatgctcatcaacagtagactggataaagaaaccgtggtacacatataccatggaatactatgtagctataaaaaaagaacaagatcatgtccgctgcaggaacatggatggagctggaggccattcattacccttggcaaactaacacaggagcagaaaccaaatacctcatgttcccatgtataagtgggaagtaaacaatgagaacacaaagacacaaagaggggaacaacagacactggggcatacttgaggatggagggtggaagaacagagagaattagaaaaaacatctatagggcactatgcttattacctgggtgatgaaataatctatacaccaaatccccgtgacacacagtttacctacataacacatgtgcacatacatgtacccctgaacctaagataaaagtaaaaaaaaaaaaaaacagaaaacacacacacaaaaaccaaatgtaggctaaaattcaactgagatggccaggcgcgggggctcacgcctgtaatcccagcactttcgggggccaaggcgggtggatcacttgaggtcaggagttcaagaccagcctggccagcatgatgaaaccccaactctactaaaaatacaaaaaaattagccaagcgtggtggcaggcacctgtaatcccagctattcaggaggctgaggcaggagaatcgcttgaacccaggaggtggaggttgcagtgagccaagatcacaccactgcactccagcctgggcaacaagtgcaagactctgtctcaaaaaaaaaaaaaaaaaaaaaattcaaccgtatactctaacagcaaaaaagaggaaagccctgacgtaaaaaaggatagcatgacgacaagcacagcagtttaaggtgaaataaattaactatgtttgaggctgagaaagaaaacaagaatggtacattgaatcagactttgaagagccttgagatttgtgcaaaacttgtgactttgtttccccccccgccttttttttttttttttgagatggagtctcaccctgctgcccagactgaagtgcagcggcacaatctcagctcactgcaacctccacctcctgggttcaagcaactcttgtgtctcagtctcccaagtagctggaattacagatgtgcaccaacatgcccggctaatttttgtgttttttatttatttatttttaagtagagatgggatttggccatgttggccaggctggtctcaaactcctagcctcaagcaatccacctgccttggcctcccaaagtgctgggattacaggcgtgagccacagtgcctggcaagttttgactttgttacttgtaaggaaaaaattaacaaagtatttattagaagatttccccttatctcttatgaccagaaggagggaaagtaaactactaatctaaatatatcccaagtagtatcatataaaacactacgaagacaactgtataggggaaaaaaaaatcatatttctattacaatgtaaaattaaaatgtgtagtactcaaggcaaactagtaagaaagactgagctgtgatagtatttacaagatcctgagccaagctatcacgggatccacaaacatttatgaagttaaagttcactaaaagctccatacatttacaaagctggaatcaaattctagacaaagaaaattatttaaatacaaataaggatctcttatgtttttatgactaatcatctttttttgtcattttagtgctataagtttgtagctgtgtaaaaaattttcttcaatatactgatactgatttttcagaaaaaaccctagagaataagagctcacaatgcaaagtcacattactatacaagccaataactaaaatcctaatctacattctagtctagaacactccagaaccatgtctcaataccaagagtactttagaacacaattttaaatgcacttggggatcagcaggaatcctacaactgcacaatggttaacatatcagatcgtaaatggctagcgggttttttttgtttgtttgtttgtctatttttgtttttttgagacagagtctcactctgttgcccaggctggagtgcagtggcatgatcccagatcactgcaatctccacctcctaggttcaagccattatcctgcctcagcctccagagtagctaggagtacaggcatgtgccaccacacctggctaatttttttgtatttttagtaaagatggggttttcaccatgttagtcaggctggtctacaattcctgacctcaaatgatctgcccaccttggcctcccaaactgctagggttacaggtgtgagccaccacgccctgcgtggctgtttttaagaggccatgtctagagatttacttgactctgtaatttgggaaacaagctgttttttctcatacacacaaatacaactaagtgttcaacttcgctgaatgtattttaagtatactgataccctgtaaatctcagattccataactaaaaagagttaacgtacactattaccaatttttttttttttttttttttgagatggagtctctctgttgtgcaggctggagtgtagtggcatgatcccagctcactgcaacctccgcctcccaggttcaagccattctcctgcctcagcctccggagtagctgggagtacaggaatgtgccaccacacctggctaattttttttgtatttttagtagagacggggttttactatgttggtcaggctggtctcgaactcctgacctcaaatgatctgcccaccttggcctctcaaagtgctgggattataggagtgagccaccacacctggtctattactaatatttttcctttatttcttacatacataatgccagacacagctatttctctctttaggataccttgacagaataatccaaaccactgttacaaaatatatgttgttataaaatttacccttaaatttctatggaaaccaaatacacgatctttcaagtccatttaactgtctagttaagacgcttaatagtattctataagctaagtgtcccagaggaatgctacagatttgatttttcaggtatactttgtattttaatgaaagcagtctgtatgtctatacaggcctcttccttgatttaggttgctagaagcttttaacttcagtgttcaaaagaacaatattccctcagtgcttaaatgtatataacagtttgtatgagatttgtataatgaaggtcagtttggctggatgtaaaatatttgactgacattttctttccttgagtatgttaaatgtacttctctagtgtcttctggcctaacattttgctgcaaaaatacttaataacaatctggttatcccctaataagtcatgtggtctttccatctaagaattttaccactttatctaggctgcaatgtttattgggactttatgatagtttttatatattatttctaattccttcttattcttaaccttctccttgtttcatgggcaaaggaggagtagacattctatgagatcattaaaaggactttcctccagaataaagaacatgagcttgagtacatgaactttagtacgtgaacttggacattgtttgtatctgttcaaaaactttgggctcatttctcggttcttaattatgtttcagataaataaatgtataatatattgaattatgaactgaagaaacataactgatcttagaatgagaaagtcttagctgagtcaaagtagaattcagaaatcagaatccacttaagacatgagatttcttttaaaagaaaaaattaaaaaaagagaaaaagaaataagatttatatctaaaagaaaaaattcttagtaactaaaaaaatttaacaattaaaataactcagaaaacagctctctggctgtttaaaactaaaagccctaattatccacattccaacctcaaaatataactaaaaaattaagttccttccaaaggttaggacctatttcaggctcctgctgttcatggagtgcaagggtatatattatagcacatatccatgtctgactcataactgaagacatgttcccaggtgtatgttacgttctcttgtcaaaaaataataataataatacactgtaaataatctaaattctaaactactctaatgaaattcttaattattctaaaaaatgagaaagagaaaaaaggtcttagagacaaactgactacaaaaagaataagtaaaaggtctctatgtggaaaacaaaactgatttttgagcctcactcgaaagccccacctagttttataatccaagaataattcatgctttccagtttaatcaccatcaaaaagtctaactcatgcaccaacttgtacatactcctttgttaggcacccaacatagcaatttagacatacttagtagactctaggcttagaaggcttataatccatgccagacaaaaagagaattagataaatacatgtcctaaaaaagggggttagtttactgtacctacataactataactacatatatttggaagtctgcatctttttatagattttattcccctagaatgttctgggctatgggacgaatatgtctttatcagtcaactttaggtttaatgtctgcaaaataaaggtttcatcttgatttatataaggtattttcaaactacacaaatctctatttctatgaatgttgtatcatttgacagtaggaagaatgcccttgcttataggtttttactttttaaattttattttagattcagggagtacatgtgcaggtttgttatgtgtatatattacacaatggtggggtttgggcttccggtatacccatcaaccaaatagtgaccattatacccaataggtaattatcaagccacaccaccctcccaactttgccccttttggagtcctcagtgtctattgtttccatctttaagtccatgtgtgcccattgtttagttcccacttacaagaaagaacatgcagtagctgattttcagtttctaagttttttcacttaaaataatggcctccagcttcatccatgttgctgcaaaggaaatcatttcattctctatggctgctttattgatttcttgttgctgtattctgacggactgtgttcttcaacaaaggccgaaacagtatctccccaactacctgctcttctactatcccttctactctgatgttctactatcaagaaatggactctaatcatgaaactgaatgagcgtctgatgtgcttctaaccaaaaagaatatagtggatgagactgtgtgacttttgaggctaggtcataaaaggaacacagcttccactctggaaggtgtgtgttacctttgggaactctaagttgccaggtaggaagtatgactgctctgaggccaccatgctctgagaaagccaagccatatgcaaagggcatggataggtgctccataaggctgtcctagttgtttatctttctagcccaggggccagatgtaagctttcagttaattctagtccccagccatgaagccacatcaagcccttgagatgtctcagttgaggccccagataccgtgaagcaatgggcaagccatcccagctttgtcttttctaaattcttgatacataaaatcatgaacaaaattaaaaaggggtttaaggctaagtttgaggataatttattatacaacaataatcacaacggtctttattctgctcaccacaacagctatgcaaaacctcctcctcggttctgcaggtaagatgtgccttcaatctttaaaagactgatcaactagctccaaaaatcactcatttaattcctttgttgctggcctttcaactctactcaaaccttatctcttctgcctagaaatatgcccagatatgtcacactaaaataaatgctttttcttgcacaaatctgaccccactccctagaagctacaatcatttcattgctaaatttcaccgaataatctgctatgctttgctaatatatcctcaccttgacatctgcctgactcatcactggccccacacatgagtctctagagaattccccacaggtagttcactgttcctgtcagcttttaccttcctgaaactgaaatttagcttaaactaaatgctattattaaatccttccgtcttgaaaactctttttttatacctcagaccatatagccttggaaagaccaccaccatctcagtgtgttaccaacacaggcaaaattactattgtccaagggaaggattttggtgtgggtgtctgaccagacgttcaggtttaaagtctcatggtgaatatgcgtggtgtagtaagcagagctgaagaggccattgacaggatcaatcaaaggttttttaaaaaaataggtaaaactcattcattataatagaattacagaagcaagtaagtcacaagaaaaataaacataaaagggacaaaggtgagtaaattataaccaagataggattgctggtgggaatatacagtgacacagccatctggggaaataatctgacagctccttaagtgattaccatatgacccagcacttccactcctagatacataccaaagaaatgaaaacaaatgtacactttaactcatatacaaatgttcacagcagcatattctcaatagccaaaagtgataacaacccaaatgtatatgaactgctgtgatacatccagaaaatgaaatattaatcatgaaatgaatgaataaaatacatggtataacaagaatgaatctttaaaacattataagtaaaagaagccaaacacaaaaagtgatgtattgtgtttgtttatatgaaaatgtccagaatagagacaaaaagtagcttagtgattgctaagggttgtagaggggaggagaatagggactggctgtcaatggacagtcatttcttctggagaatgatgaaaatgttctggaattttaaagtggtgagttgcaaaattatgtgaatatactgaaaaccacacaattgtaccctttaaagcagagaatgttatgtttgcaaattatatctcaattttttaaaatgtatgagggaaaaaatagcatgttttcaattactgcttcctagtcaacataaaccagacaaaaaatccccaacaaaatctggaactccattacttcatttcactcttttcaattccaggttaaaacaggatccaaaacaaagaggaaaaaattttaacaattctactgaatccagaacatcaatgttaaggagtgaaatctgaataaagaactctaagaatacagtccatttttaaattagcaccaaatgggaaataaaagagaaaagatattactcgtaacaggttctgtttgtaaatgtttttagaatactaccttagatcccaaataagaatcaaacatgcctgggcccttaaagagaattggtggatagccccaactaacaaaaagacttgcaagagtgttccagcttttagctgggagcataaaaggaaaaaaacccttatgctacagtgagcctaaagggggtggagggaggaagggacagagaatgagctaagaagaagccaccatgttaattgtcgacactttctaaacccagactccagccctttcctcagctgctgccaaggggctcagtacttctgggaaagctacagtcacactggggagaggccctcacttcatccagcaacttgcactgcatccaacagcagcaccagccccgccactcgcccgcaccacagcccctgaattcgcctgcatctactccaccctcattcttcactatgaacgaggtgaccgtcacagaggataaatcaaggccctaattaaagtaggtggtgtaaatgttgaaccttttcggcctggtttgttggcaaaggccctggcctatggtgacatcgagagactcatcctaatgtaggggttggtggacctgctccagcagctgctgctgcatcaacagtaggtcctgccctgtccagagcagctgctccagctgaggagaaggaagtgtaagcaaagaaaaaagaatctcggccggatgcagtggctcacacctgtaatcccagcactttgggaggctgaggtgggcagatcacttgaagccaggagttctagaccagcctggccaaaatggcaaagcacagtctccaccaaaaatacaaaaattagatgggtgggctggcggatgcctgtaatcccagctgctcaggaggctgaggcacaagaatcacttgaacctgggaggcggaggttgcagtgactgggtgacagagccagactcggtctccgaaaagaaaaagataaagaaaaggaaaaacaaagaagaatctgaggagtgtgatgatggcatgggctttggtctttttgactagaagttcttttataactctttttacaaatttttaaaaaattaaactggactccagggaccagtgggtgaggccactggctataggggtggtgggcacgctgtggcgtgatggcatggggctgttgcagacatatgaactggtctctcaccactgccatgccacacaactgtgctctggcactgagtacagtggggacagccttgtggcagaacgccacagcattctcttagtgggtaatggcagcaccagcaggagcaggccaggagcaggaaggaggatcacaacagatcacacatggggactccggtctggatcctgcgctccctctggcgacttccagatccaaaagggcagattatgcaggggctgacaagtgaggacaagagccactgacatctggaatgactgcaagtatgactgcccatctatattcaaacaatataaactttgggttacacaactgaatgtgttcaggaatgtgtcattcagaataacaccacggctgccatctcagtccactctaggtcaaaatgaacacatatcttggttgctctcctacctccttgactgctatgtctgtttcttgtacgtgttccttttcctcttgcattccattaaatttctcaaaggcttgtcattgaacagcctctctgcatcctttttttgtttgtttttttaaaccacttaccattatatgatctgttttacctatcaaatctataatatctgtgtaaggtttgggaacagtccaccaactgccttcccttctgacatgaatcacagagtttgggggtcccaaagaccatcctcacgttcaataatgtgccacactgttagactatcaggtgtggcccaaggcacccagatctctatgcccttggaaggctccaaggacaaaggctagatatctctttaggcaaggttaaattctttactaaaccacctgcttgctgatacttctgattctccgattcatatttctaaccaccttcttgatatttccatcaacagtcaaactcatcaacatcttccccaatccaactgcgacttcactgtttctactaataatgccaacattatttcaccttgtttaaaaagctatttttaattagtaagccataattgtatgtatggggtatgatgtgatgttttaatatatgttacactatttttttctataaggaattgaggcagcttataaaaccacaatataagatacaaaattagaaagaaattggggcacagaaaaaatagcccagaaaaagtaaaacagaataatgctacagtgaagttaggatacagaatgcatgctataaattactgttcacttgttagaggtgggctgcacatttggctcagagctttttcatagccaaacgatatccaatgcaaaaaagaaatgacaaccaccctgagacacatagggagaccccgtctctatcaacatttttaaaatccgccaggcatggtgactcatgcccacaatcctagcactttgggaggcagaaacaggaggagattccttgagctcaggagttcaagaacagcctgggtaacatagtgaatcctgtctctacaaaaaaatttaaacatcagccaggcatggtgatgcagacctgtagtcccagctactcaggaggatagcttgagcctgggaggttgtagtagtagtgagctgtgatcacaccactgccttccagcctacgcaatagaatgagacactctatctctatggggaaggggaagaaaagcagtttcataattcagagtacactaaaataaatgatgcccagaaggtactattcttctgattattccaggacttagaagtgtgtggggttttctggtcactgccctccatactcaacagattgttgaataataaagacggtacctccataacattgtttgcttttgtcttctccttgtatcttctctctctttaatgtcaatcaactaagatttcaaattaagcttccttaaatatagcacttccctctttaaaacctacactggttctttttatccttttgtaaaaaaaaacaaaaaaaacttttttttttttaaatagagacaaagtcttaatatgttgcccaggctgtcttgaactcctgagctcaaatgatcttctgccttggcctcccagagtgctaggattacaggtgtaagccaccatgcctggtccacttattccttttaaaagctccacttctgcttctgcttttttttttttttttaatttccataagttttgggggaacaggtggtgtttggttacatgagtaagttctttagtggtgatttgtgagattttggtgcacccatcaccgatagagtatacactgaacccagtctgtagtcttttgtccctcatccctttcctaccctttccccctgagtccccaaagtctacagtgtcattcttatgcctttgcatcctcatagcttagctcccacttatgagtgagagaacataggatgtctggtcttccattcctgagttacttcaattagaataatagagtctccaatcctatccaggttgctccaaaattcattactttttatggttgagaagtactccacacacaccacagtttctttatccactcatttattgagggacatttgggttggttccacatttttgcaattgtgaattgtgctgctataaacatgcatgagcaagtaacttttttatataacgacttattttcctctaggtagatactcagttagtgggattgctggatcaatggtagttctacttttagttctttacggaatctccacactggtttccatagtggctgtactactgtacattcccaccagcagtgtagaagtgttcccttttcactgcatccatgctaacatctattattttttgattttttgattatggacattcttgcaggagtaaagtggtattgcattgtgattttgatttgcatttccctgatcattagtgatgttgagcattttttcatagtctattggccatctgtatatcttctttggagaactgtctattcatgtccttagcccactttttcatgggatttttttttccttgctaatttgagttcattgtagtttctggatattagtcctttgtcggatgtatagattgtgaagattttctcctacgctttcggttgtctgtttactctgctgactcttccttttgctgtgtaaaagctctttagtttaattaagttccaggtatttaactttgttttgatcacatttgcatttaggttcttgatcatgaaatccttgcctaagccaatgtctagaaggatttttccgatgttaccttctaataatgtttatagtttcaggtcttagatttaagtccttgatccatcttgagttgatttttgtttaaggtatgaaatgaggatccagtttcattctcttacagatggcttgccagttttcccagcaccatttgttgaatagggtgtctgttcccttttttgtttgctttgtcaaagatcagttggctgtaagtatttgggtttatttctcagttctctattctgttccactggtctatgtgcctatttttataccagtaccatgctgttttggtgactgtgctcttacagtacagtttgaaatcaggtaatgtgatgccttcaaattttctctttttgcttagtcttgctttgactatgcagactctttttcggttccatgtgaattttaggatggttttttctagttctgtgaagaatgacggtagtactttgatgggaattgcaccgaatttgtagactgctttcggcagtatggtcattttcgcaatactgattctacccacctatgagcatgggatgtgtttccatttgtttgtgtcgtctatgatttctttcagcagtaaaagcacatattcttctgtatttacaaagaaatatatgctcaatgcagaaaacaaagaaaaccaatacaaagaggtaaagaagacaaaaaccaaaaccctacaatccagatgtaactagctactatcaatgttttttaaaattcagatatttacatgcaatgaaagtcaaaggttttatgtgtacgattccctgctttttgacaaatacatatactctaatcaatatacagaacatttttccaaaatctcactcttgaagttccctcccagtcacattctttgtcaggtaaatgtattgcaaagagcttctcccagtctgaagctggtcttttcatttttaaaaatgtcttttaatcaggaacagtttttaattttgattaagtctaattaattttttattttatagttaatgtttcttatatgctctctaataaatccttccctactcccaaggttgtgaagatattctcttactttttgctagaaactttacagttttaactttatatttaaatatatgatccatctcaacctgataaaggtatctaaaaaaaaactacatattcactgtaagattagaaacaagacaagggagatgtctattcttaccacttctattcaacctcatgcataaaagaatgaggcaaaaaagaataataatttataaagaatcataaggaagaagaaaaacctccatttgccctgaaatgatgaaatgattgtgtgtagagaaaacctagagaaatttacacatgcacaaacactaataaataagcaaacagcatagttacaggccacgtggttggtgcataagaatcagttacatttctataacccatcaaaaccacaccaaaaactacaaaacatttctgagaacaataaagacctaaataaacagacacaataccatgttaatgggttggaagattcaatattattaaggcgtatctaaaatttatatgtataagctgactctgaatttatacaaaatgcaaaggatcgagacaggtcaaaacaatcctggaagagaagcacaaagctggaagactgacactacccattcaaggcatgctatacaaagctatagtaaccagacctttagagcaagcattgaccaaaagagggatggagcagatggagtccacaaacaaacccccatacattctgtctactgatggacaaaggcaagcaactgaataggtgggggaacaagtcttctcgataaatggtgctgcagcaacaagataaaagtatatttcaaaaaaacacctcaggcctaccacatactgctgacattttggcactgctcttttgctaaatatatttttattttttgtttttatttttttgagacagagtctcgttctatcgcccaggctggagtgcagtggcgcaatctcaactcattgcaacctccgcctcccacgttgaagtgattctcctgcctccgcctcccgaggagctgggactacaggcgcgtgccaccgtgcccggctaattttttgtatctttagtagagacagggcttcgatatgttggccaggatggcctcaatctcctgacctcgtgatctgcccacctcggcctcccaaagtgctgggattacaggcgtgggccaccatgcccggcctgctaaatatgttttgtaaaaagaggagagattataacaccaggattctgtttctactctgctttctttcggttttctgtggggatttttggtaatattttgaagtgatgctttaaagttacttcaccacaaatttctcacactcatctctatcctctacatgatgctcccaaactgcttttaaacctaatcttctaccatcaatttttagtttccccatttgttaggaaaacacaagcagttagggcttcttacaccttgttctgcctccaggatttagtctgagtagtgccccatactctcaacatcatccaaatattctttactgacaaagtccctttcagttttttataacatcttttctgagtcctctattcaaatataacattcttccttttagccctcacatatcttcccttttctcacttattattaacgaaccacacttagatgaaaaaaaagatatttgagcagtctattcattcagtcactattcagcaggccacagattgttctactggggtgccagggaagctagacaggtcaaggctctgcccttaagtagctggcattctagtggcaaagtctaagaggccataatctagaaagtagggctgtttctcatttacctctatgtgccctgtagtaaagtacaacgttttgcacatcatcaagcctcaatgaataaaccatgaactcacctgtcatgctatttaaagcttgtatcataaatatccttgtcaatttaaagcaccaacagatcaggagtcagaatctccttggtctccataaaagaaatgtaatgaggccttatgtaataggttcaagagcatctattgctttgttcacatagataggcagggtttctttttaaggcttgaattaagccaaattaagccaactaataaatgaaaagcatagtgaattaagtatctgtgcagcattaatgattttaagtaaaagaactgtgaataaagaaaggttatctttctatcaaaaggaacagaaagtaaagaccacacgtctataaaatacttcagccacacaacaccattttaatagacaaaaacaggcatttctatggcagagattttccatctgggcactgctgacattaggagctgagtaatttctgttatgggtaactgtcctgtgcgctgtggaacctttagcagcatccctggctctgcccaagagatgccagtagcagcccgtcacggcaagcaaatgtctccaaacattcacaaatggactcccaggggtcaaaaccgcacccagcgaagaacctctgatgtaacacagccaacattacttggctgtacaaatatttcttttgtttgttattctttttactgtacaaatatcaattctaaagcagctttaaggttctttgcttttttttccttaaaaaacaacacagattgggcacagtggctcacacctgtaatccctgcactttgggaggctgagacaggcggatcacttgaggtcaggagttcgagaccagcatggccaacatggtgaaacctcatctctactaaaaatacaaaaatcagctgagcatggtggtgcatgcctgtaatccaagctactcgggaggctgaggcaggagaattgtttgtacccgggaggtagaggcagtgagtggagattgcagcattgcactccagcctgggtgacaagagtgaaactccatctcataaaaaataaaataaaataaatcaaagtcatagactcggagggttggggggcagggagggaaggagaaagggaggagggatgccaatgacagcaaatagccaccaacagtaaattttgtgagttattaaaattcaaccagtctaccgttttcacagatggaaaatagacacacatgggtaaaggcaatttgtgtataggaagaaactcatctgacatgcttctagtgtgtatacttataatattttatgctctattttgaagaaaataatgtccctaagtttttacaggtaagaaatatatgtcactcaaatgtgtgtgacaggttaagtattccggagaactatggatgattttaagaaaacgtgaggcagaaacaaaggccctatattctgatctgccagtcagcatgccagcctgctcatgccgacatgccttccccagatccacctgaacatcagcactctgcctatcccgtacttgcaacccaacactagagaaaatgcctttatccaaacaaaatacgtactgcattatggatggttcaaatgcagtggagttaacaaactacagggccttgaccaaagggaacctttcagactagagagggggagatacatgaacacagaaataaatgtacaattccacactatgataagttggggatgcgggggacaataccgtgggtaataaaggaaagggtctgattagaggtcgaataaatgcatttctaaggaaatgacatgttttcataccaagtcagaccacagctgttgatgtctccagaaataattcaagagatgaaaactgtacaaaggtgccaacttatctaagaatgatttaagagagcaacaaaactcatgtctgaggacagctactacaggcagcctgatattgcaaggcaatgttcctacagtcaccatttagtatgtccttgtagcaggtatacaccgagggttctggaaaaagttaggaacataaggtagttcaaagcaatgattccgcttatattgcacgtatagtatgaagggtgccttcatgtggttatatccttggagttttagaaggatgatacatgcagaccttagaatggagcagattttagtgttcaatgtgcagaaaaatcactgatgaatttgttaaatatttggattcctaagtcccactctcaaggattccaattcaggggtttacagtgcagcctaggaatgtttaccaggcaccccctactgcctctgaaaaccccacatgaaacacaaatcttcccacaaaaggaggtttggctgtgacacaggttttttttgctcaaactcatgaaacaagcatgtatgacacaaggcctcccgacagtgtttgtttacaggctgaccctgcccctgatcttggtaatccccagggcttggaagcagaatctgaataaactgcacagcctactgctacagcttgtgcccagacaacagaccagaggtgatatgtaaaaaagataggcagtgctgacagctctctctccagaggttaaggaaacacacccaacatgagacacggtcagggagttaagggagccagcactgatgggtatagacagcatgaagtacagatgagaacacaatgaaagaagaatgatagaacagacagaagaagagtgaaactcatatttcttatgagcctcgtatcagatactgtgtcatgaacttcatatatttcatttaaatcctcataaaaatcttaggtattaacattaatataatataaattatcatatcatagatgaaaaaccaaagcctaaagagaaaggaatttgtccaagaagacggagctacaaagcaacacagccaggttttgaaccaaggctcaggaatcagtcaataatgccataatcctcttggagatctaagataacgcgagtaggaacatggctgtcaggaaatgaagagtcctactccagagagaataccaaggcaagtaagtacacaagagcaatgaacaatgcttttgcaatatcagaactttaaatatggaccctcttattaaaacagctgagggttcatacattttaaataagggaaacttgtaaagatgaggtaaaaagttaagatgtaatctagctgatcataaatgatgaaggcttgctgcagctcttgctgagtagtgggatcacaggtgacttctgccctccaacccaagtgtctacatttcctgtgatgaacaaattttatttttaaaaagaaatacatgtgatgtcttttgttgttaatttttttttaattgtattttgaggaaactgagaagtaattgagggcagagactctccaggaatgaagtcaataaaagcaagagaaagaggtgaagtatcagaagaaaaatgatacctcagattacataacacacactaccagcctgggaaagctctctccccttcccatcctggaccattaaatcccaagccatgaggcagggccaatcaacaaaggatgtcagagcatgagttaggtgagaagggaagggagagacatagtgatggtgactggtgattcataccatacagggaaatcaatcaactaagtcaacgcaatgaggatgggaagagcccagactcttactatcagagaaagaaaccacaaagatggaaagggagaacaccaggctgaatcttctggtattagaggtatcagattaataaactcatggatttcaaaacatatgtaaatatataaataaatataaacataaaggaagcaggtgcatatgtttgtgttcctagctctgtactgagatctgaaagtgacaagccaaaagtaataagcacacctaatgcccaggtctagctttctaaatattattgtttaatttaaaaaaaaaaaaaaaaaaagcaggattctctgtgaaaagagtagactccagggctgggataggaaaaacacaagatgaacctggcatatcctactgtacttgaaggtaaagaaatgatcaaaggaccgggcatggtggttcacaccggtaatcccaatactttgggaggctgaggcaggagaattacttgaggtcaggagttcaagaccagcctggccaacatggtgaaaccccatctctactaaaaatacaaaggttaaccaggcgtggtggcatgagcctgtagtctcagctactcaggaggctggcacgagaattgcttgaacccaggaggtggaggttgcagtgaaacagagatcacaccactgcactacagcctgggtgacagagcgagactccatctcaaaacaaaacaaaaaaataaacgatcaaagaacgattgaggcatttcaaaaggacacagaaccaatctgaaggggctcctaagaacaaaatttgggataatctaagcatcaaaacatataaggagagtaagtgatcataacccactgaataaaacagagatccatgaatttatcagtccacccgagacagaaagtcagcccggggtggcggcgggggtagggataaatatttgaatgggttatatatgtagtctcaaagtaactctcaacaaaatacttattactaggggaaaagaacagctgtcagggatatctggcagacacaatcttgatcaagtgaaggcatcaactccaatggaataaatcaaacctgtgtaccatctgaaaggatttaatgcaaaaagacaacatcactactgtggcatcccaaattgagaaacattatataaaataaccggtttacaatcttcaaaaatgtcaaggacatgaaagccaggaaaacactgagaactgttccaaattaaaagaaattacaaaaacaagaaaacagaatatgcgcttctgccacagattcattacacataatggacaacactgggcaactggcagtacctgataagcccgaggtctgaatagtagtgaagtatcagtgttaaatttctgatcttgatggttgtattttgatatataggagaatgtacttgattgtaggtaaaatgtactaaagtattcagggatgataaaacaccatattagtaattttagctcaaccagtcctggcagagggtgaggggatttatctctttatccaagaacaaaaaatgagaaggccacaggtcttattccagacattccaaatcaattccttggactccctgaatatgtatatgtcagtaatcttatacaaactgttgtggaatataccacaaaattcaaagtagggcatctgtcacatgtaatgctaactaaaggtacaagttacttaccaaatttggggggggctggcacgggtataaggagggaaccttactatctctaatgaccttactgatgctgactttaatactctgtgaaggttagagttcagtgaatgttacctagaaacagccccggctgtggaatactttattcttagccctatatttggggtttggatgtccactgtgctggttcccagagatagtaaggggatgagagtattggttacatctcctgacccacatacttaagatccagatgaacaagacagttttcactcctgcttggtagaacctatttgctgaaggaaacagctcctaaagaatggttctagccagaccctgtcgctaccagaagaaaaaaaaaaaaaacttttcattaaccaggggtggtgacacatgcctgcagttccaactgctcaggaggctgaggtgggaggactgctcaagcccaagactcaggaggctgagatgggaggattgctcaagcccaggactcaggaggctgagatgggaggattgctcaggcccaggaggttgaggctgcagtgagctgtgatcacgccattgcactccagcctgggcaacagaacaagactgtctcagaaaaagaaaaaacaagaaaagaaaaaagaatggcacctacagatgaacctaatgctgggcctcagcagaaaaatcgaagacagtataagaaatgaagagtaagagggaggatggaaaacaccttcttgtcacctttcaaactggctctatcttttcttttactagactgcatagatctttggggttgtaaccactattcagacaaatgctaagtaagatctacactcttttctaaggaacacactgattctatgtggaagtacgtgcacctatgaaagaatcaggttagagtagattagttcctacacttttgtagtacagtaactttctcttcctcttagcaggtaattaaatgtacactgtttctgaaccaacatacaaatgatctatatctactagataaatgatgaattattaagacatatggaacccaaaattcattaatgctttatgttctgaacatgtctgcattttctgccatttattctaatgctatatagaatctgatttacaatttttaaaatctgtagcaaataaattcatctcaccaactttggctcaggagctccaaattccagaaaattaatgtccaaatcagtaagttaagtgacaaagaagcagctgaatagtcatttctctttctcctagattctcagttgggtccacacaaagcatggtgtctagatcatattgttcttaatattcatcacacaacacgcttgccctttaggagtttaactcttggtctttacaaagcatcaatacaagaacactccacttgaatagtttctgtgtcttccgtgaaatcatagctgaaaacataacccactatgtcacacaatggcagaaccccacagaatgtctttttcgttaagtacaatgccaggaaagaatctttctctgtaaacaaatgtgcatgcttgcttcccacagacaataaacgctatgtaattcaatgctacacaaagaaaggaatggttttcttttagccttagcagtcagaaaacagaaagtcaaatacagtgcacaagagttataattagctcccctcaggagcctggtacactttctcctctctatgttcttttattattttaatgtttttattgtactttattttttggaggcaggatctggttctgccgcccaggctggactgcagtagcacgatctcagctcactgaaacctctgcctcctgggctcaagtgttcctcccaccttagcgccccaagtgcctggaactacaggcacttaccaccatgcccagctaattttttgcactttttgtagagacagtgtctcaccacattgcccaggctggtcttgaattcctgaactcaagcgatctgcccacctcgacctcctaaagtgctgggattacaggcttcagccaccgcactggcccagtgctccttttagatggtttattatgtcctctaactgtcctgctgtatactacctttaattctaacagatttaagtccttctgaaagtacctagaatatgtatgtacaaatacatgtattttgtcttacaattctctctcatatcacttaatattttctgatatcagtctctatacaatgacctaagaatttaaaatgataatgacacaaggaggctaatttaatgaagaccaagcaatttgcatcactacctcctccccttgtccattcccccaacaaattactacacagcccaatggggaaggcaagccccacaccaccatgcttggcacatcacctttgcagtagtccgcagggtcctcttgctcctcatcatctgatcccaggatctcctcctctggctccgggggtgtggggtctggcaaaggtggcggtggtggtggtggtggcggtggaggaggaggaactaaaggagctttctgttgaggctccggcctgaaagagcagagagaaaattgctatttacttagaagtacatcttgcattatggatgcatttgagcacttcttaatatgggggaaaaaataaaacttgtcacatactaagaagaaatgtcatttaatgtcacttcacccattttagttgaattcaagtagtgtttcaacatataagtcaggccaaaaaaaaaaaaaatctgcccttattagctaaggaatttttttctgtaggtatcttttcacttagcgcttcaagaactaccaatgttaggaaatttcagtgcgctccactcaactcctaccaattctgggaaatttaagtgaaatgaaagcgtattccatggtatatagccttattggttagaaaacatcacaacgattataaaaagacaggcgcaagcagcactcaacttttgaaagcacttatttcctgttatctgaaaatgagaattcttttcccatagaaataggtggcaatgaggttaggtttcaataactcataaaagctgattaacatacactgtagctaaaatatacaagattgccagaaagattcttgtacttctataaggcctgttcgaagttttgaatgtattctggaagcggtgtgtgtgtgtgtgtttgattgattgagattattccctttcagggctctatgaggagaatggttcataatgggattcacttactattcctaaccatgccccagtgcggggaaataggaccctacagtctcaatctggatgccggaagcacatctctcccttaagctatcccactaataaaactaccactgaatgcgtgcgctgaagatgacggctgctgtggaaaggttgctctgagggtcagttgcccgacatgtgagtgccattccttggggcatttctgcaacggcagccctcaggcctgctgcgtctagaagaacaagcttgacaaacatattgtggtctggttctggtcaagcaaaattctttagcaccagttcctcacaccatgcacctgctgtcacccagcatgcgccctattttaagggtatagccgttgtcaatgaagagttcaaagacctaagccctagttgttgagagcaggtggaatcttggtgttattgctagatttccttttggaacactgttgctctctgcccagtggaaggccgattctggatcctttctctcctcactgcagcacagcctgcggcatacagtcaaagctcactcttcagccctggaatcttgagaaggtcagggtcttagcaatgcaagctcatctgtagctgccactaagagacaggccaaaggagctgcctcaaccactgcctcttctaaactgggcctctaaatccttgcccaatctgagagcctccaacaccaccactaatgcatgtggcttgccaacaaaaaaacccatacggccacaactgaaggaaggagtaggaatagaaggcagcagaaacacctgacatcatgaggaaggggtggggatcacacacaataggtcaacttaaaggcaaataatcaaaggtatgaatatctttagcaggacaactaaagaatatttataagctgaaaatgtactgattgctgctttctggaatttatgaagactcaacagttacagctccctgggtaacagacatcaggattgtagtgatgataacactccaagttaaccattctcttcacagagccctgaaagagaataatattcattctctctctctctctctctctcacacacacacacacacacacacacacacacacacacacacacacacacacaccacttccagaatacattcaaaacttccaacaggccttacagaagtacaagaatctttctggaagccatgtaaatgctcgcttctttttaacacatgtgcccttactgaaagtggaatggtcccaggcaaaagagagttctgaaggaggagaggcaagtaaggaacttcagtagtttgccacttccccagcgggaggaaaaggtttgagatgacgtccaaaagaagcacaacccactcttcaggggtgtgggcagaatcaatttgtctgacacatttcctcaatgagaaatactttgaaagctagctgtttcttcctaactcagaaactttatataaaaaatgagtacattctctgaaaacacacacacacacacacattgagtttgctgtagaaactacttgaagaaaagacaagaaatgatggctcttgtgctgccagtgcacggcactactgtacttagcacaatggattcttggactggataattcattgctgtggggctgtcgtgtgcactgtgggatgcttttcaccatcgctgccctccagccactatatgtcagtagcacacagccccccacccccaccccaccacccagctgtggccatcaaaaatgcgtgtagacactgacaaatgtgtgtgtgctgggggaggaggggagtcatgcccattgagaaccagtgcactagtagcattttctatatatggctttacctcaatggagtagactgcagtatggagaagagattctaattttcaccaccattttctctcacttgagagattcccgcaccttcattataatgtctctctcacttactctttacctacctgctgagctgcctacatggatgaccctcaaaattctcagaccctgcagtctaagtgtgtaggcacttctcattcctccagtgagggccacactgaacaggcagacagaaagcttcttaaaagccagctctaccaaatgaaaagtggtaagtcaggataccccaaagtatagaggaggtttagtaatgctgattaatagttcaactggctgtcatatcaaaacatctagaactgtgctgcccaatacagtagccaccagccacgtggggttatcgggcacatgaagtagctagttcaaactgagatgtgccagaagtataaaatacatgttagattgccaagactcagtacccaaaaaagtaaaaatattatattaataattttctacttgctcaatattaaaatgttttatacacgagtatttctagtggatggtagaactctggacctttcagatccaacctgtactgaggggcatttcagcctcacgttgagagattcctggccataagtgatgattatctttcctaggacttctaatgacctacttcatactaattatcaccaatactcaaatcactcagttcatcacagaaagtctcagttcaatgtaaccgccaattctttttcatccctccatccttgttactgtctaccacataggaaaatcaaggtaaatttctcctagggcagaaatagagaagagaaagccaagccatactgtcttagggctggattattttattttcattttgagacagggtctcgctctgttgcccagggtggagtgcagtggtgcatccacagctcactgcaatcttgaactcctgggctcaaagaatcctcctgcctcagcctggtgggtagctaggactacaggtgtgtgccactgggcctggccaaggctggcttctttaaagtggtttctgatggcttctagagtactgcaaagcctggttaaattacaacactgtagaagaccaagacatgacaggttatctcaccaaatacatactcattaagtctatcaacagattaaaaaaaacaactttcatcaatcctaatgaaagccgtaaggaagctatttcatataaaaattatcagaagtatataagcagcaatggcagtggaaatgacccataaatattttcaacaacaataccaaaataattaaatggtaaaagaatagtcttttcaacagtggtactacaacaaatacatactcatatgcaaaataaataaagttggacctctctctcacacacaggctttacatgaaagagctaaaactataaaactctcaggaaaaaaacataggagtaaatcttcacgaccttaggttaggcaatgtttcttaaatgtgacattaaaagcataagcaatacaagaaaaactaaattggacttcaaaatttttaacttttgtacttcaaagggcaccatcaagaaaatttaaaggccacagaatggggggaagtacttgtaaatcataagtgataagtgataagtgacttgtatctagaatatataaagaactcttccaactcaacaataaaaagacacactaatttaacaatggataaaaaggattggaaagacatttctacaaagaggatatacacatgaccaataaatatatgaaaagatgctcaacatcattagtaatcagagaaatggaaatcaaaactacagtctgacaccacttcatacccactagaatggctattaaaagaagtcagataataagtttaaggaaggatgaagaaataaggatcttcaaacattgttggtgggaagggtaatatagcatagccatcttggaaaacggtctggcagttcctcaaaagtttaaacataaaattaccaaataacccaacaattccactcccaagtatatacccaagagaaatgaaagcatatatccagcaaaatctcatccacagtgttcagagaagtactactatttttaacgaaaagcagaaacaacccaaacgtcccctaactgataaataaaatggggtatatcattacaagggaatgttattcactaacaaagagaaatgaagtactgatatatgctacaacatggatggatcctccaaaaccttatgctgggtgacagatgccagtcagaaaagaccgcaggttgtatgatcttccattttccatcaaatgtctagaacagataaatttatagagatggggtaaatcagtggatgctcatatcgggggttggggaaatggagaaaaaaggaggaaaatggggactgactgctagtagatatgggatatctgttaggagggatgaaaatgtcctaatgtggtgatggttgtacaattctgtgaacataataaaaaacactaaaatatatatgttacatgagcaaactgtatgctatgtgaattatacttcaaaaagctattgttaaaaaataaaagaagccaggtgtggtggtgcacacctgtagtcccagccatttgggacactgaggcaggaggatcgcttgagcccaggagtttgaggccagcctgggcaacacagcaagacctcatctctacaaaaacaacaataaatttttaaaaaaataaaagaaaaccccaatacagctatagatattttaaatatccaacactacaccgttataaaatgtatgacttcaagaaacaaatatctatgtagagatttaagcaatcaatatgcatagtctcttttacaataagctcagctacattcagagtgaaaattaatctgtaattctttaaaaaggagactgaaattttatctaagggtccaaagtttaaacaaggtgctaatttaagaacatgttttcatgtactataagaaatataaagaaatataccacttcaggccgggtgcagtggcccccacaggtgatcccagcactttggggaggccacagtgggtatatcagttgagcccaggagtctgagaccagcctgggcaacctggcaatacccacaaaaactacaaaaattagctgggcgtggtggcacacatctacagtcccagctactaaggaggctgatgtgagaggactgcttgagcatgcgagtctgcaatgagctaagatcatagcactgcactccagcctgcatgacagagtgagaccctgtctcaggaaaaaaagaaagaagaaaatagaaaaggaaaaaggaaaggggaaagggaagggaaggggaaaggaaaaaggaaaggggaaagaaaaggggaaggggaaaggacaatggagaaaggggaaagcaaaggaaaaggaaaggagaaagaaaaaagaaaaaggaaagagaaaggaaaacaaaagagcaaagcaaagcaaaagagaaaaagaggggaggagagaaaaaagaaaaacacagcacttcagtgatgggaatgaaattaatttagaaagcaaaattccactagctacttatatttttcacaaagaactatatttatttttacactacaaagaaaattctaatcattactctaaatttaaaatgtggtttaaaaaaacttaaaaatatttttctttcaatatcatactataatactaaaattatcatcatgctatgtacttcatactatattctgcatgtacacttgctctgtcagaaaagggaggaaaaactcaacaaccgaggaaactacaagtctcatctgctctaaattgccatggcaaccagatgagagttccgatttcctctcagctgctactgcgtatttcttttcagcagagaaaagaaaaaataaactctacatttagtaggaaaaatgtcctctcctttgctatcagcttagatggcaactgacacaatttaagaaatacagttcagttaatttttaatcaaacataaagaaaaggagctccagatgaatttcttcagttagtatttgagggacattcacataaagtcaaatttcattttctttcctccctatgtccaccctatatctataacttttctctctcccttcctccctccctccttcttcctctcttggtaattactgtcagcttgagaaatacccaatttctaattaatagtagaatcggtcaatataggttgagtatccctcattcaaaatacttgggaccagataatgtttcgaacttcagataatttcatgtattcctctttaatgaaaggttaagttcaaaaactttgtgtaaatcaaacctaaatgtgcaatgaccctcaatgaccctcatccatgttaaatctcctgcttctcttgagtatgggtagatctgtgagtgtgagatattacacctgttatccaattatctacactacatgccaaagggagatcacactgggtggcctgacctaatcacaccagtccctaaaagcagagggttttctttggctggtcaaagaagtggaagcggagcggcgggctccagctgcctggaaaaaaagcagacatcatttgtgaactagggccacagagagcaaagaactgccagtggcctctaggagtgacggtgctccctgccaacagctagaagaatagtaagataacaaagacctcagttctacgaactcaaggaaatgagttctgccaacaaccagtgagctggaaaagaactctgaagctcagatgagagctgcagatctggccaacaccttggtttcagtctagtaagaatccagccacactgtgctgccctgatttctgtcctacaaaactgtgagttaataaacaggtgttgttttaagctgctaagggtgcagtaatttgttacacagcaagtgaaagtgaatacactgccaagttcctcaaactgtactagagtagatcatggagaattatcagactttggcctcaaaaagatctgatttttttttttttaaataattgaaatggccaggggacttaagctgggtaatccagaatgggaaacagttctcttttgggaataggagtatcttattccctgaatgagtccattcgtgcattgctataaggaaatacctgagactgggtaatttataaagaaaagagatttaattggctcacagtcctgcaggctatacaggaagaatgatgctggcatctgctaagcttccgggaaggcctcaggaaacttacaatcatggtggaaggcaaagggggtgcaggcgcaacacagtgtgggagcagtaacaggagtgagagtgaggggggaggtgctacacacttttagaacaaccagatctcaggagaactcactgactaccatgagaacagcatcaaagtggaaatctacccccatgatccaatcacctcccaccaggtaccacctccaacattcgggattacaattcaacattagatttgggcagggacatagatccaaactatatcactccccaagtcctaatagcaaacaattgtaattccaagccaaatactacttacttatttcctaagaccatactgttttctagaacgtagtacacagccaactcaaagttagtaaggatgtaagtaaatcagacctgcttcccaactaatctacattttagaaaagaaaggagttggtgttctaaaggtattgctgcctgatcacctcactgagttctgagttcaggtttttatcatctatttcctggactaacttttcctcattaatttccttgtttcttgcttttatccttcccattttacacattaattccatatattctttgcaaaaagcaaacctctggttctaaaattgcatttcagcactacatatgtcttatgccactagtactattaatattttataaaacacttgtgggatctgacagaaaatattactactgaaatggagaaagactgacagaaaagttaaaccagtgagtccaaatgcatgtaaaatgacatccactgattctacaactacccagaagcacacagatgcccagcactgaggggtgtacagtctagtgaggaggggaaagtgcatgtaaacacacaaatgtaagcaactgctcctggtatcgttatggaaacagagatggtagtgggccaagtcagagacatctagaggtgatcttacagactggccagaatgaggctgactgcaggaggtccatgtctcagggaaccacatcatcaaaagcacagaggcccaaactaatctggtatgactggagagaggaaagaggttaggcataggaataatccacaattcaaaagaataaaccacaatgctaagaagcttgggctctatccctgaggcaagtagtagccactgaaatgcaaccatagaaacaaggattagctttctgcaaaaaacatatgaaattagagtgtagaacaggtagaaaggataaaagcaagaagaaagaaaattcatgggaaaacgctgcaattgttagtccaggacagagatgattaaaaactggaactcagaactcagtacagttgttgctctgtatccatgcattccgcatccatggattcaaacaactatggatcctaaacatggggtgatggctacatgtgtactgaacatgtacagactctttttttggtcattattccataaacaattaggtattacaactatttacatagtatatacaccatactaggtgatggaatctagacataactgaaagtatataggagcatgtgcacaggtgacatgcaaatactaaaccattttatatcaaggacttgagcatccatggattttggtatccgaatgggatcctggaaccaatctcccacaaatacctaaggacaactctaattcatttgctagaagtggatgtttgactcttcatttctggtctgaaatactgtaccattcatttcgacagagaatagagcaggtggatgaagaagggaaggggttttagagaaaagtaaccggctctagctcctctgagtttcacaggcaagtgggataccaagcagcatagaatacggtagggattgcttgatatataaaatctatagctgaaaagtaaaggtttgagctgcaaattgaagcaaaggtgattgaaactgaagcatactgaagcatgaccatgcagctggaagccaaagcctttccaagcatgtaagagtgctggggagaaactggggaataaaagagccaagggaagagcccagttcaaagccgaagaacaaagttaaacaagccaccaacattataatctatagtcaaggacccctactataattgccaatataagttttaagtgtcaaatacagattttagagcacatacatatacaaaagtaagcctaccttttacattaggataagatatacatataagaagaacaagcaaactaaagacccatacgctcttctatctaaaagctatgtttgtagacaatctgaagccagctaggtgcagagtgaataaaatgtcacaaaaaaggaactgtttactaagacttatattggtgaaagttgctataacaactaacgattgcctcatgctattcaggaaataatgtaagatgtaccactttacacaagccttctgcaaacttccacaagctttagatctaaaggcatacacaactactaatatataatggatcaacaaaattcaaatgcagtcaactttctaccttctaaagtaatttagaacacaggaaataagggaaatcctaaacctgtgttacacaatatggtagcaacaagacaaattaattaaaatggaataaaattaaaaattcagtcatcctccttcaagcactcagtagtcacatatggctggtggctatggcacagtatgggcagtgcagatatagaacatttctatcaccacagaaagttatattggacagtaatgctgcaggctctagatgctgtagcactgctctaggcatttttttaaggagcatgagcctcttccagcatatcactatttttaataagtagtaaggttagctgaaaaagagtttagaacattttttatacagcttattttaaataccttactgtaagttttaaaataagcagtaaaatgataaacagtcagtatatagccattttaaatttcacagatgattccaatatctgataccctgcagctcagtagttctctttagtagaattcaccttagtgatacacacactctgtggcaatgtctgcaaacagcaatatattgggatctaaatgtctatcaataggaaacttgttaataacattatgataaaattatggcacaaccatacaaaactctcaaaaaggatgaggcagaagaaacaattctagtcacaataataaagtacatagaaataaattaaacaaaagaagtttaaaacgtactatgaaaactgcaatatcttgttgaaattaaagacctaaataaacagaagacatcccatattcatggattggagacttaatactgtttgccaatatgggaaaatgccccctacagattcaacaaaatccctatcaaaatcccagccagcttctttgctgaatttgacaagccattcctaaaactcatatggaaatgcaaggtcccagaatagtcaaacaatcatgaaaaagaaaaacacaaaactgggggattcgcactttccaatttcaaaacttactacaaagctatagtaatcaagacaatgtcgtactggcataaggatgaagaccaatggaacagaattgagggtccagagataaagccttgcatttatagtcaactgatttccaactgattgccaagacaattcaattgggaaagaatagtctgttcaacaaatggggacggaacaaccgaatattcacatgtgaaagaataaagctaaattcttacctcccaccatacacagaaactaactcataatggatcaaagtcctaaatataagagctaaaattataaaactcctaggaaagagacacaacaatactagccatcagaaacatgaaaaaatcaaaaccacaatgagataccacttcacacctactaggatggcaataatcaaaaagacagataacgagacgtcagtgacgtacaaaacaagagaacccacaagtattgatgatgaaaatggaaaatggtgcagccagtttggacaacagtctagcagtatctcagaaagtaaaaaagagttatgatgcagcaattccactcctggcatatactctgcagaaatgaaaacatgtccacacaaaaacgtgtacatgaacactcacagccacactttcttatagcctaaagtagaaaccacccaaacatccactaactgatgaatggataaattaaaatgtggtatatccaatacaacagactattactcaacaataaaaagaaatgaagtactcatagatgctaccacatggatgacccctgacagcattaaagtattataaatcaaagccagccaccaaagaccacatgtatgattcaatttgtataaaatgattacaatagacaaatctatagaaacagaaggtagatcagtaacagcgtaaggctggaggggtacagaaaataggggtgactactcaagtgtatgaagttttttgggggggtgataaaatagttataaaattaagagggctgggtgcagctgcacaagctgattgtcccagctactgtgcaggctgagatgggataatcacttgagctcaggagttcaaggctataatatgccacgatcacacctgtaaatagccactgcactccagcctgggcaatagagcatgaccccatctctacaaaaaaaaaaaaaaaaagttaaattatgtggttgatggttgcacaactctgagtatactgaaaaaccactgaatggtatactttaaatgggtaattacatggtgtgcaattaatcttttaataaagttgttatgcaaaaataatgaaacacttctacatgtattaatatgaaagatatacacactgatgaataaaaagatgcagagcactgtgtatgctatgtatcatttgttttacacagacatcctaagcactggatggagcaacaagccaataatggttgtctccaggaaaaggaactcagtgactggtgagatgaaggaaaggaggtaattttttcaagattcttatcaccccccaaaaactcctttcaggagttcaagaccagtctggccaatatggtgaaaactcatctctatcaaaaaaatacaagtattagcagggcatggtggcacgcgcctgtggtcccaactactcaggaggctgaagcaggagaatcactttaactcgggaggcagaggttggcagtgagccgagatcgcaccactgtactccagcctgggcaacagaatgagaccctgtctccaaaaaaaaaaaaaaagagagagagagagagacaccaccacaacaacaaaataactgttacagtcatggtaaagttgcaactaattatcctagggctggagagtcaagatacaagccacagtccaaatgtacagctttctggtaacaaggctctaggttaggctgaatacctgttccatcacttaccaatccatgagaactcaagccagtgaccatttctctaggcttctgatgcacattagagtgttgtaaatattaaaagagatgacacataaatcccctgccatggtaactgtgtacatggtaggcattcaataaaggttaatcctcacctccccactcttctggtatgtggtgacaataaaactgtttattcagggttccagctgtgaccaataaatacaccttgatacattacgcacgatactgctacaggccttttggcatatctggagttcctcccattcctctctgttcatctctgactatcctaactgcaaaggtcaacatcgatcccaccacctaacaaccctctgcttctaaatctatgtattttataatcatgattagttaagagatttcttgagaaggttacaaacagttaattatcacatacttctacaaggcaatatgacaaaggcagtatttggtgagaaaaaaaaagatttaaagttgaacataaaaagtgacttacctaattaagcggaatagaaattcaaaacatacagtggtgctgagactagcacccatgaaaccaaatactataaattattctctcttgcattcacagaagacacagaagacactgtgccatacagcacaactgtatctgacaaatgaagactgtcctgaaatgtatcaaatccatatacctgacagagcaggactaaagccccaccagtggaagcatcccaccaatgcagactgatactctcagaactgattttctccttcccttgtgtcatgaatcttgtgattctaacccacagttccaaattctgcaggattatcccaagtatagagaatattccttatttacttgttcaagaaatacttacaaagctcaaactattttactgctaaaatgagaaaaaaatgagtcttttctcatggtaccaggaatctaacagatagatcagatagaaataaaaattagagcataaaacaaggcagaacgtagcttgataacattacttctttaattaactcaaggcatattcaatgtatccaatttccagtctcctgtataattcccaggggatacaatagcaaaaacaaaacatgtggaaaggtatacatgttctctccagctggctgagtgcctaaaaattctcaaagaaaggagagaaaattgaagaggcctatgacgaagaaaaaggtgtcaatagatctagctaggaaagggcgttctaggcaggaggacatgatggcctgagcaggagaaggtatggcagcaagaaagggctcatccacttctgccggcacacaaggtacccaaaggagaatattggcagaagtgctagagaaaggttgagaccagattttgacaccctggggtgaagaatttgaagttaatttgctaggaaataaaatgctacacaaagttaaatctatttctttcggaagctataacacaatagttctcaaatagaactatacagcacaaacaagtggaagtttttcaaaatgcaaaagtgagaatcaagagattcttctgactcagtaggtcaggaatgtagcctgggagcatgtcaccaggtgactgatacacacccatggttaagaatcaatgctccaaggaatcattaccatctctaacgggtgtcaactggcaatgcactaacgtgagtttatggtccaaacacaagtaaggaaagtagatacaaatagacgtaggtaaagaaaggcagatagaaataagaatttgtaatggtccaaaaggtttaatgaaaaggacctccacttataataaatgatgtttcctaagaagttactgcatgaatcagttttcaatcacctactacaagtgaagtaaaactaatttttagtgaattctattaaaatataaataatcataccacaatgtatttagagttccaactcagaaaagcatgcctaagggagttataatttaagcatgactggggactgagtgacaccttaaatatgactgataaatcctattcatttttcttttctccttcgtagttgaaaagaaaaagaagaaaaccccaaagaacaaataaaagaaaaaaaatcaaggaacaagaaattcaacaattttttttaaaaaaataatgagaatagagaagagatgacaactagaaagaacataagcagctataagcaaaagtggccgcagaaatagatactgaccagaaaacagtccaccctgggaccacaagagcttcagcactacaaccaggggcgggggagacattctgggggatgatgctggagacacatagcttcgttggatggagtggtcggcgcatacttcccacactcccacacctccagtgtaaccagatcacaatcttttccaaggcagaagacggaacattttggagacactaggcacaaggatatatagtactgggctaagaaacagtctttatgatgaacagttagaatcagaccaggatcttagtctccttactccactctgctcccagaacatatccccggctcatgtctacgccctggacaggaatacggagacttcttcactggagaaactaaatagccccactcaggccaggcctatgtatcattataacagaattacttttttcacccttccctttaaaactaatgatcttcaagaagacttatgttttactcactaggttctgctcctatatgcaagatcctttcaggcttttaagtgctagaagccactccctgtttactaagtatgacgttagctatgtgcctaagaacagactgagccttagtccctacgtacttagtagagctccttacttagacattaaataacagatgttgaatgaaaaatcacaagtgaaaaagtatatgcctaatgcttggtaaactatttaagcctacaatctaatactctgatttcataatctgacagtgatcataaacttttaaaatgttactcaaatttgcagtatttaagagtaatatttcctactcatttattttcccaaaatatgtaggtaccgtgtgaaagcacacaaaattctgtttatttagtggagataatgtttctatgtattaggagttcatgagtaaagaatcttgctaatgactcagccacaaactggtggcaagaacaggcaaaaattcctaaccagtgtacacctgacttagagccatgtaagccaaatagcctattcatcactacttagtagggagaagtttaagaactcaaatagtatctgacttaatcataaaaaatgaaatacggtttaatcaagtgattaatgtttttaaaataagcaggcaaaaaactaaacatagggaaaaataatgcagtttaaatgtggctataaaataaatactttatatacagaataagtagttttgtttttcctaattcttagatccacttacgattttaacagtctagcttgtgccgggtgtggtggctcacacctgtaaccgggaggcggaggcgggcagatcacagggtcaagagatcgataccagcctggccaacatggtaaaatcccatctctactaaaaatacaaaaattagctgggcgtggtggcgcacacctgtatcccagttactcaggaagctgaggcaggagaatcgcttgaacctgggaggcagaggttgcagtgagctgagatcgcaccactgcactccagcctggcgacagagcgagactccatctcaaaaaagaaaaaaagagttaatacaagtgttcaaaaactcaaatttaaattgtaaaagaactaacattaagaaaaaaagtctagcttgtcatacttagctaaaacaaagtctttcaatcatttattagtatatgaaacaaaccaccaaaagaatctaaaactagcataccatttaccactccagttgaatgtcactatattgttttcactaagactcactttaaccattttttttttccatcaagacatccagacccccagccctgatttgatgtcatcccaggatgtgtctcatttgtttcagaagccatcttgaattgtttaaaatgttttaaaggtttccctttacaatagtctaatcctttcaaaaagtggggtcaggggcaggaagagctatacaataattttttggtactggaggtaaataagagtagaaaatgaaaaaataaattataaatcattacttcaaaaaatattagcagtatttatttggcagaatcagaaaataaagttcatgtgagctaactggtctaataaaaaggtttactaaacccacacaccagttttcgacaaaaatctctaaaacatattacggatattcctcaactcacgatgaggaatatccaaaacacccttcataaagttgaaaaatcctaagtcaagtcattatgagggacttgtatctgctgttgccattatacgcttgtctttactaactaaataatatttcactcctgtcactagaatttgaaaagtacagagtagtagttaaaggcatagtcttaaaagttgagagcttggtttaagttccagctccatcagttataaaccctgtggctttgagcgagtgatacccacttttctcaccaatcttattctttctccagctacaacagtcctcatgcccttcttgaatccagacaagaatctacactgcctgatgatctggtttacgaaagcctgtacattttttctgggatttcaaaccaatatcacaccaacgccaaatgctactttggccccaaccatacctatttgccaaggtcagcatcacggagcattctgtcactactgcctcaatttccatccctgaaacaagatgctgcttttttctgtggtgtctcccttatataaccccctgtccacaacagtcctaaccatatcctttgccatctatctgtggcgccacatccctctccccactcaacccatcttcctttttaacagagccaactttccaaaattaacatacaactggtgatttttctgcttgaaaagtagtatttatttttcttcggattaccaaaataatatttgttcattatctgtaaatcacagggctataaacaaactaattctttacagccctagtatccacagataaaccaaaataactccatttatttcctctcaatttttacccagatataatttgagatccctcttttcataaacatcttctcctatcattaaaaacactgtaaaatatcactttagcaggcacttcatcatacacgtctaccaaaactactgaaccattcctttgtttccagtcttgggaagattgtatatactgtgaaaaacatctttaatcatgcatctttgtctataccttaccaattaaattgttagggcacagtaccagaagtaaaactgccagatcaaagattatacacattttaaaaccaaacataatgccaaactgctttgcaaaattctgtgtagcactctaaacaccaggaagaatctttattggcagttaaactgcttctgatgcccttgcacagactttaatagagagacatcgtaccaacaaaagaattgttcctcacaataacttgtaacttaatattaacaagtaacattcctttttaggaaaatattaaaagcactaaaatcaaaggcttaaaacttaaaatctgaagtaaaatttaaccaaacaataactgaagacaatagtctaacaatttaagcattttaagcagaaaatagttttttaaccataaaatcattagtaagtttgaaacttctatttttgcctactttagtatctactctgagcagtgctaactctttaaatactataatgccaaagcattccttaaaagttttccatcattagttacatttttgagaaagatcaatctggtataaatatagaaattcaatccataataacattagttttaaaacataattcagaaagatttacacttatggcaaatataaccacaccagccatttactataaagttctgtgtttgtttcatcatgaagaagaatgatatggcctctgacctcatggagtcgtctgtggaacgacagtggaattagcagagaaatttataattttactgatgaaaaaaaaacagctaaactctagtatgtggtaagaatcaggcattatctatttgctttcacatttattcaaatacattcttttaagttttaattttcttaaaggcacaaatgacacagaaaaaactttcctactgagacaattactctttgtgaaaaataagaggtaggctgaagtggcccagctgaccactgagcgcatacagtccagggcctcagcccagggccccagtcgaggaacggcatgttgggaccacaagatctcacaacctccatttgtccagaccgggctcaagcgcaataaatccaaaaaacatctgtcatctcttcagctgaaaaaagctcaactgcaactattctttgtcactgccttccagatccttttcctaatgtgagcaaacctgaaaaggcctccaaagaggctcctaataggctgaccagaaagtcacagaatctgtttccacattttaataacccagacagaacacggagttgaaggctgtttctttgcactttgtccctgacatacatacctccctgcccaagtgtcaaaaaattaaatgtctcccatctcagctcaaccttgtgtcttctaccctataaaaagccattcttccttattttagccagattctacttttctttcaacaatcatctcaaaccttattgactccctgtgaattgtctatgtcccccacagatctcaactatagcacctcccggggttcctcttgtattttaattaaccacatacatgttttcctctgccactagagatgaagcacttgcagggtttagctaaaatttccacatacatctctctccttgcacacacatacaagagtttcttgaagctaatttttgtcaagctatactcagaaagcaatgaaatcaatacacagcttttttaaaaaatgaaataaaagtataaaatacctaagtgtgcttcatgcggtaaaagtattgtttcttgagacatatttcagttgtgtgtgaacagatctgtatatgcctcgagttacacaaaataacatataaaaaatattgctcaagggtcttaaggagcaggctatgcatatcttcaaatatgcaaatttagatatatattccccacctggaatttttgattaaattctgaaacagagctctagttttagtttatttcatatggataaccaattgttccagcaattatttattttagattgagttacacacatatgctgaatttacagatttttaaacgacatctgtaccatattaagcagccccattctatatttttaaatatttatattttatgagtctatatattcattcaaaagtgattttatgccctttaataatattttgtaatttttttcataaaggtcatacaataagacttttgttagagttactgttaggaattcagaatctgtaacctttactcaaaaataattttaaggtgggtgcagtggctcacacctgtcatcctaggactttgggactctgaggcgggcagatcacctgaggtcaggagttcaagactagcctggctaacatggtgaaactccgtctctactaaaaatacaaaattatccaggaatggtggtgcacgccagtaatcccagctacttgggaggctgaggcaggagaatcacttgaactcaggaggtggaggtggcaatgagctgagatcccacgactgcactccagcctgggcaacaagagcaaaactctgtctaaaaataataataataataactttaagatattttaattatccagtaaatacatctcttatttatcatttggttaatgttggctcaagtttcagtttcccctcatcttccattttaaaacacttagaattctaaattaaactccaaactgtcagttaaaatacatcatgaaattcattcctattttctttcatgaatttagtacattcagttagtattcaaagtgaacaaaacattccccttgaccccaaaatgaatttgtttgctgaagttaaacttctcatgataaaaagccccaatcttaaaacacacgagctaaaacataaaaaagacgttaaaatattaaatcgaaaacttccctttccttactgagctttcattaatcaggttaataatagttaaatttacctagaagactgccaccatcaaaaaactgtaagccaggcgcagtggcacatgactgcagtcacagctacttggaaggctgaggtgggaggatcacttgagcccaggaggtttagatcacttgagtctagcctaggctttttttagagacccccatctctctctttaaaacaaacaaacaaacaaacaaacaaaaacaaaaaacaaaacaccactgtcaataaaatctgacttgcttttctgcctataaaggctgtagcttcttaagatctattttatttaaggctagcaactatcctctttcaatatgtattgggagaatcattatggttcttaacgctagagcaagctgcagtgagctgccaaccagcagatcgtctgccttagtaacttcctatttatgactcatacatgaaaccagtagtttctccctccatgtcctgaatgaagtatggcagagctcccaaatcattagccagcctctccaacagaggatggccaccatactcccaacaaaaccacttttaagtatgacacatatcctatatttttagtcagatcatccaaaaccttctaaatttggtgaaaatctacctagtcatttttcacattgcaattacagacacagagatacaattttaattgtatttataaagtttaataggctgtttctaaaaaacaagcattcttaagactgtagagaaaatagtaaataaattcagtaatttttttcccaaaatatcttgtgcttttccttataaatgtcttacaactaaacttacacttaaaaaaaaaagtaaaagtgggttattggggttctagacttctgctgtcctataaggtagccagacacatgtggctatttaaagtaaaaataagcaaacaaagattcagcacatcagtcttactagccacatttcaactgctcaacagccacatgcgggggttagcagactggacagaaaaatcacagaaagttctactgaacaatgctgcttagagtttaaaagctgtaaactgtgctaataaaattatctttaaaatgtagcttgttactaccaagtaagaagttctgttaagtctaggaacctaaagacttccaaaatatattaataatcatgtcaaaatattagatctattttttcaataaaagaaacataaaataatatttgtctatgaaacatttagtgatcatattcttcccaataaacaaaatggaagatatattttgcttgatttttttttttaaaaaacgcactatatatgtgctcaagaaagaaataattttttttttaacagagtctcactcactctatcacctaggttggagtgcagtggcacaaattcagctcaccaaaacctccacctccagggttcaagtgaattctcctgcctcagcctctcgagtagctgggattacaggtgcgcgccaccatacctggctaactttagtatttttagtagagttggggtttcaccacgttggccaggctggtcttagaactcctgacctcaggtgatctgcccacctcagcttcccaaagtgctggaaaggtatgagccaccatgccgggccaaaattcatgttttaagaagatatccaagccacgcataccaaagacctcccctttaaaagaaggccttttttcaagtgcaggattaaaacaaaagaatatactttcagacttaaggataagacagtgtagatctctggccaggcacgatggctcatacctgtaatcctgggaggccaaggtgggtggatcacttgaggccagggttaaagaccagccatggccaatatggagaaaccccatctctactaaaaatagaaaaattagccaggcttgaacctcggaggcagaggttgctgtaagccgagatcacacaactgcactccagcctgggtgacagagcaagactctgtctccaaaaattccaaataaagagagagcgagcagtgatttctgtcatctgctcagcagcaaatcgtttctcattgctggcaccctctagcgcttgtgtgtcaccagattactggaaacattttagcagagagaatggggaccataaaacactgcttggtccttctctccctaaaagttaattctcaaaccaagtaacaaagcaaagaactcttaactcagtaataaaaaaagacaaaagacacaatttttaaaaaactttttccataagttattggggtacaggtagtatatggttacatgagtaagttcgttagtggtgatctgtgagatcctaatgcatccatcacccaagcagtatatgttgcaccatatatgttatcttttatcccttgccccctttccactcttcccctaagtccccaaagtccgttgcatcattcttatgtctttgtgaaaagacacaatttaaaaaagcaaaggatctgaatagatgttcctccaaaaaagacatacaagtagccaaaaagcacatgacaagatggctcaacatcattagccatcagagaaatgcaaatccaaactacaatgaaataccacttcatgtccagtaggataactacaagtaaaaggatgctaacaagtgttggtgaggatcctgggaaattaaaaatctcttacactgcaggtaggaatgtaaaacgactctgctgttttgtaaaacattctggcagttctacaaaatttcaaacatataagttatcatacgacccagcaatctcacttctaggtatttatccagtagatataaaaacatatattcactcaaaaacatgtacatgaatgttcagtcacaatattcagaacatccaaaaagtaaaaacaatccaaatgtttatcaactgatgaacagataaaccaaatgtagtgtatccacaaaacagagtatcattcagcaaaaaaaaaaaaaaaaaaaaaagtaactaacaacgataagactccaaataatggatcagtaatccaatttttattactttactatttctagcctactatttagaaaaggaagattttaataacaaatataaatggtgaaaaccaatatcctaatttctttttttctgagacgaggtctcactctgttgcccagactggattgcagtgatgcaatcttggctcactgcaacctccatctcttgggctcagcctcccaaagtgctgggattagagatgtgggccatggcacccagcccaatctcctaatttcatatgaaaaaaagttatacaaagactggaaaaatctcagtatacctgggaaattaatgggctgtcactagaatagtacagtggctgaatttagatccttcaaatactgtttagaaaatttccattggaagctttataaagaaagcacatcaactcaactttctgaaattacatttcataaaagatgttgttttaaagagaaattgctgaaattccaatttctggatactaacacaaacttgaaagatgaaataaaaagttctttagatgtatcctaatgggcctaatgtaagaatgtagaaagattatgtcaacacctttaaaaaaagtttttggagacgggcgcagtggctcacgcctgcaaggggccatctgagctgctaacacaccaccgtccgcagacagcggaactaagagagcagtgtaacaccctctctcaggcctcggggtcacgggcaccctcacctaggcagcgccacaagcggcaagatgagctgctaacacactgctgtctgcagacagcagaactaagagaataccgtaacactcactctggggcttcagagtcccaggcaccctcacctgggcgctgcgagagcttgttcccgtgttggcgcctggagcagccagccggatcccgcactcgctcgctcacatgctccctcctgcaagcgctggagaatggcaggctgagtaaacagggcgcccctgttacaagtccagtgaagaggccgagaaaagccctgcatcataactactgctcacaatagtagtggtctctctgctactttttcactgtgaaattgaagctggaatgaaaatggtacaaacaccaacagctagctgttttaaaaaggctggcccaagagagccagcaccgagttcagggaactgcagtgagttcaactcaacagacaaagcacataaaaccacccaaaattttgaaggtacacttgttgctttaaaacgaccatcctttggccgagcaaggtggctcacgcccgtaataccagcactttgggaggccgtcgcgggcagatcacgaggtcaggagatcgagaccatccttgctaacacggtgaaaccccatctctaataaaaatacaaaaaaattagccgggcatagcggcgggcgcctgtagtcccagctactcaggaggctgaggcagaagaatggcgtgaacccgggaggcggagcttgcagtgagccgagattgcgccactgcactccagcctgggcgacagagcaagactccgtctcaaaaaaaaaaaggccatcctttttgtgctaacataaaaaatccagacatctaaatatgtcatttttattatatcaaatacgtagctttgatcttagctatggaggaggtatctctccctctccttccgcagtgcccacaacagatgaagggggagcgcaggaataaaattctagagtcaggttacaggactatcatagagtaggaataagtcttggttagactattcctcagagaactgaggttaagagctgagaaatatcaaacaatcatatacagagcaaaaagatctcaatattctttcaagtaagaacttgcactgctgtgttcagccagaggcagtgggtgggggggaatgggggtgggataaaatcaacagcgaagctgagtcgctgtcccagggatctagtccaggaatcaaggcaaaaactgcacgacagtttttattttaagtactaagtggttttgatggaaatgaggaggacttaatcacaccggaaggtttcaagaagacgtgggactgaactggatctgacatataggtagattttagccagcagtggggaagacattttgtaaaaggagaatcagtgcctcttctatccttaaaatgctaaggcaggaattaccaaggtctgtcagctgaacactgtaatgctcatcctgagcaaagcaagaatgcctgaggataagagggcccaaaaccacagagtcctttaataaaacagaaaggtacaaatgagaatgatacctaagatggatatggaaggtgtggaagactttgacagagatggaggctggaacatttcaggtagagggagcagtaacaagaacaaagggcggacaaacagctgcattccaccagctgggcagcagcagggcatacgtccaatataatgaatgtagctgcaaaggtggtggacaccgacactggagaccataaccaccaggctctcacactggcaaaaaagcaagtaagcagtagatagagaatagggagatggcaaaaccatccatgtgctttagaaagattactccagcacacttaagcatgatgaagaaagaaagacaggaaggtaaaaagatttacccagagaccagatttcttttcctataaaggacatgtataccaacgaggtgcccttgcttcaccactcacatttgtcccggtttttaaagacaatcatatacacagataaaggaatgctgaaatggacactcacatgttgacaaacgtcaactgttaaaatagctgggcaatatgcatgaaaaatcttgttgattcttgtcttaggaatgaatatgatctctgtcatatgttgtgattctatcttaggaatttatttctggaaaataaaccaaccatttttcagttaaaaaaaagtatacaactattatcaaaaatcattgtttatgacagccaacatattgttaatactataaatgcaatattcttgaatttattacaagcaaaatgtgttttttattttaacttttaggttcaggggtacatgtgcatgtttgtcatataggtaagcttgtgtcactaaggtttgttgtacagattattgtagtaagcctagtaccaatagttaattcgtctgcccctctccctattttcaccctccctcgccaagtagaccccagtgtctgtttccttctttgtgctgatttgatgagttcttatcactcagcgcccccttataaataagaacatgtggtatttggttttctgctcctgcattcttttcctaagggtaatagcctccaggtctatccatgttcccacaaaatacattatctcttcttttttatggctgcatagtgttacattttctttatccagtcggtcactgatcggcatttacattgattccatgtctttgctattgtgaacagtgctgcactgaacatccacatgaatgcgtcttcatggtagaatgacttatattcctctaggtacacacccagtaataagattgcggagtcgaatggtagttctgtttttagctctttgagggatcaccatactgctttccacagtggttgaacaaatttatgctcccaccaacagtgtataaatgttcccttttctccgcaatctcgccagcatctgttattttttggctttttaaccatagtcattataattgatgtgagataatacttcactgtggttttgatttacatttctctaatgatctgagatactgaactttttttcatatgcttattggccccatgtatgtcttcttttgaaaagtgtctatgtcctttgcccactttttaatggtattgtttttctcttacaaatttgtttaagttctttatagatgctggatactaaactttggtcagatacatcatttgcaaatattttctcccattctgtagattgtccatttactcttttggtaacagggtctcactctgtcacctagtctggagtctagtggtgtgatcataactcactgtaaccttgaactcctgggctctagcaatcctcccacctcagcctcttgagtagctggaaccataggcacttgccaacacacccaggaaattttaccttttgtagagatgggtcttgctatgttgcctagactggtctcgaactcctgggcttaagcaatcctcttgcctatataatctgcctgctttaagaattcaaggcatgagccaccacacccagactaaaatttatttttaagatcaagtttgcaggccgggcgcggtggctcacgtctgtaagcccggcactttgggaggcggacagatcacctgaagtcaggagttcgagaccagcctcaccaacatggagaaatccgtctctactaaaaatacaaaattagccaggcatggtggcacatgcctgtaatctcagctactcgggaggctgagacaggagaatcgcttgaacacgggaggcaaaggttgcggtgagccgagatcgcgccattgcactccagcctgggcaacaagagcgaaaccttatctaaaaaaaaaaaaaaaaaaaaaaaagatcaagtttgcaaagagtttttaagtacaaaagtaaaacaaaaacggcaataaaaatttgtacttaggatattatcattattcaaacacttgtaatctaagtctctaaagtgaaaaggctgcaaaacaaaacaaaaaaaaacagtaacagaaatattcacatgtgaaataaccattaataaaatcagacccttttcaaatatctctccccattaaaaaaaacaacaataataataaaaaaaaaaaagataaccaggctcagcggctcacgcctgtaatcccagcactttgggaggctgaggcaggtggattacgaggtcaagagatcgagaccatcctggccaacatggtgaaacctcgtctctactaaaaatacaaaaattaggtgggtgtggtggcgggtgcctgtaatcccagctattcaggagcctgaggcaggagaatcacttgatcactgaacttgggaggcggaggttgtggtgagctgagataacgccactgcactccagcctaggcaaaggaaaggagggagggaaagaaaggaaaagagaagagagaagagagggagagagggagggagcaaggaaggaaggaaggaaaggaaggaaagaaggaaggaaggaaggaaggaaggaaggaaggaaggaaggaaggaaggaaggaaggaaggggaaagggaaggaaggagtttaatgaaggcacaggtcaattaatagtctttgatagaaactgagtggctgtctatagtcacgccaccctgaaaacacctaatcgcatctgaaactaagcagttgacaagagaatgcagatacaattcaataaacctgaaaaccttacaaaatatgcaagacttcatggtagcaataaaagccttgttgaccttagtaacagccaagggtactggcaaacaagaacccagcagaccaactaacaactgtagaagacaatatcaacaaagataatggactgacaggctctttaatggagaacttgcatatgagagaattagagatcagtggaaaagaggtgaagctctcaactacttttacaaaatagttcctttataattcctgtaaaaataaaatacgggctgggcgcagtggctcacacctgttatccccagcactttggtaggccaaagccggtggatcacttaaggtcaggagttcaaaaccagcctggccaaatgatgaaatcccgtctctactaaaaatgcaaagaaaaaaaattagccaggcatggtggtgtgcacctgtaatcctagctactcaggagactgaagcaggagaatcgcttgaacctgggactcagagattgcagtgagccaatgcactccagcagcctcggcgacacagcaagactccgtctcaaaaaaaatgaaaaatgaaaataaaaataaaataagtaaaaaatcatatttttttggaaactattacaagagaaacaatatttgggtcaattctttgttcattctataaactaacagatccaagagtgataaattttgttaaatattaaaataaaactaatttcattttaataattagtatctattattattaaaataaggcccaattaaatttttttatgacttacataaaatttagatccctgttttaaacagattcacattaagaacacctttgctgcaccagttataataaggtaaatgagactgattattttagtaatttcagttatgtaaaaagaaaaagactacaaagatttatactagtagttgccactggaaaatgcggttgtgggtgttttttgtttgttttaaacaaagggacagaattaaatactgtttaaaacaatgcaaatatattaaccagtaaataagatttttgaaatgtaaactaatatttcatcaatggattgctattgcttttcaatctaccaaaagatcattagagaaacttctactatctcatttaagaaatatttcctggatctctacgatgtgctaaataccatgaagacaaaatttaataataggctatactgatgcttactatgtgccacttcaacccgtaaaataatgcagccaacaaactaattattatcaacgtccagagactgagaaacattaagtaacttacccaatggtatataactaaatagtaactaaaccatccttcaaaacaaagactgtctacaaagcccaggatcttaagcacttagctatgtattgcgttggagaggcagccttaaaataacttacacattagaagaagaaaagcagcaagcagaaaagcaccaaagcaatgaagataggtgtgctgatataagattcaccacatgctatatgaagcaggaaaaaaaaaggttcagtgtgggtaagaaaagagggcatcacagacatggagaagatggtaacagaatttcaaagaacacatgaattccacaagaagaaagaggtgttagaccaagcctgtccaataggccacatgcagcccaggacggctttgaatgaggcccaacacaaattcacaaactttcctaaaacatgagttatttctgcaattttttaagctcatcagctatcgttagtgttagcgtatcttatgtgtggcccaagccaattcttcttcttccaatgtggcccagagaagccaaaagattagatacctctgtgggagaccatctgaggcagacagggtaatgtaattttttggaaactacaagtattatttggcaacggctcccaccaaaattttgtaaacttgtaggaatagagataaaatagtcaaatgtttgcttataatatttaatgtttaattcaagtacatatgtatttaaattcatgttatagattatttggaaagactgtatttcccattgtcacaaagcaagtttatttcaaatgctttatcacatgcacctttaccatcattgtactcatcagtaaagccatctctttagtctaaagtcagttttctgaaatgcagcattttcacttctacgttgtctgggattgtgtgtgtgtgtgtgtgtgtgcatgtgcatgcattttaaatatgtatggtattgccaaaggaagtgttccccaagtcaaaaataactactcattctcgttcatgtcagttagcttttccatttggttttatacacaaacaaatatatcctctctatatcacaatcacttattgttttgctttttcatatgatctataaaaggcatgagaaacattcaacatttgaaactatgagaaataattaacaaaacaggtgttaaaatatctttaaaaaaaaaactatttctactagtgaactctaaattacctaaaactaacaaaagattgaaaccatttccatttatgtcatcacaaagaattattagctattcaaaataaagtcattgagatagttccctctaatatgagagatgttgcacagcactattctccgggggataatttcttggggaaaggggaattcatttatattctagcagtacttctatactaacatctataggtacattagaggaaaagcaaaaggaaagaaacttgaaataggcctgaataagatctgtggttctcaaacttaggtatatgtcagagtctcctcaagaccttgttacagtacagttgctgggttccatccctgtgtttctgattccataggaatggggtagggtctgagaaggtgccttcctaacaagtactcaggtgctgcagatgccacactctgatctagattatgctagacgctgttcatcatacgaaggttgattttatctttcaggagtttaggacagggaaatgacattataggatttgtggtttttaaaatatcactgacagcattatggacagtagtgttttcacataacatatttcatttattctaatatgtattttttcacaatttctgataacagagtgcatcttcccatcaacagtatatcatagtttaattagcagtgatttttctttcttggtggtgcataaaataatggtgtaaattatcacttacaggcagcagattcactaacatacagtattatcacctctgatataatggcactgtgaagggggaaaataggttttattcccgttttacagatgaggaaataggtttcaggacaatacaggaaataacatgcctagtaaatgacaggtccaagatgagaaattcagaaatttttgacacacaaaacaaacaccattcccctcaatgataccacttataacaacctgtagttcacttgccagagagaagacaagacaagagcataccagtgtaccctaaccaacaacaggagcaaagagaagagtccatgggtaccaggtgtgaaatgccaaatttaagtaatcaagaaaaagtgtctcaagattttcattaaaaaactaaataaatgaaaagacacaatgaaccacctccacaaatatagagatagaatcaaaagactagtttgggaacactgtttcatgcagtgctgagagatgcagaatgtgacataacatctccaaagcaacagacatcagcttaaggatttaaattatagttggtgatactaggaagtcaagtttgtgtaaagacaggcactgggcctggagagtggccagaggccagaatgccatacatgaccagctttctgaaagatgactagaaacccaagatactgcagcagcatcaaatgcaacacctctcaaaagcccacaaacttagcttctgaccaaaccctgtctggaaaggtgtgatgttctaaataccattctgtaggctgccagatgattttttattttgaaaaattaaaggaaaaatcagaatagaaaatctaaccattattatttgtcataacatcctgcatattcctactccccactgcaagtctactaataaaagatacactaaattatgcaatcttctcagtacattctgaaaagcacattacacctttacttggctcaatgacatgttctaattcctaggagaagaatgtgcagatattctagttcatcaaacaaattttcctcattaaaacaactcaaagctcagaggagcgaacagtctaaactgatcattattctggagcccagatagttttcatctctaaaaggaactctaaatactacttaaatctcaaattcaacttctaactagaaaaatgaaaaaacaaacttagaagagggcacaaagcttttgctgtgaccatgatacatactttaaaacttgaataccttgacagataagcagagttatcacaaagaccgaatggggatagggtctacaaccagacatgagacatctgagtgctgtggtaaagctacaagccaaacatgaagaacgtaaggaagcaccatccagggcaattaactcaagatatttctatttttcctgcttggttataggtgcattataaacatttaagtcttaagactgatttaggggaaaacatttaaatgtttataaacaggcaataaaagcagcagtagagtctgacagagcactaaaaaagccacattattattaagtttgacacaactcatgagcaaaataacctagagttaaaggcaaggcatatatctaaatcagctcctctgtcaaaataactattccatactcccccaaccagacaaatgacaaaagcttctaagtaaaggctgaatcgtgcagggtaaacaacagcaaagcagcatcacttgaataaacaactagcaacaaaattaacaatcattttcacttcaaggcagatggcccctgaaaggtgatacttgcctcaaagtcctaactgatcaatagtcaaggtaacaaaatcatcatcgtcgtcatcatcctcatcatcatcatcccttgggtgagaaaagatgctgagaaaagtctggacaggagtcagcataaagcactgcttcccactccaggagcctcaggaggtacagtctgtccttactcccaggcagccaaggcagaggcccacggcctaggctcagtttgtaacatgcccactggtggtgactctccaaagaagtctcgaggtcacaagcggcaaaactacaggggaaaatcactggaaggactcagcttcagtggcaagacacatctagcaccatggcctcaaggctgatccagtggtttgcccacagctgctgcctctcccattgcccactcttttattacacaacctacttcaatcactgtaactagaaataaaatagccagtcagtttgtattatttggaacccagaagcctgaatgacaagcttcaccattacacagtcattatttcatttttattaaaattaaataatttctgaaaatttgttctgtgttttgattttaataagaaaatcattttcagtaggaaattagaaatgaacacaatgaagaaagtaacatcatttataaccccaccacctagaccgaaatacccacgaccactttggagcacactcttctaagctttcttccaaaatggacaacttgacaagagaacaaagcacgaaggcagtaagcaaacttgtggtctacggagtcattaggccggggcagccaggtaaagttatcatccaatacacttctaagaacgaaggggcttcattccacttctcctaataagcaagccaaaaaacatataaatcacagccatccctggcaaaccagagtgtacaattgcactacatatctgaatagtccagcctcctgattaggaaaccctactctagaaatagtcccattcatcagaagaggcaatgaattataaattcttcctatatagcacaatttaatcagttgttaaaaagggcaacaataaaataaaccttcctatgttataagcgacctaaaatttttatgaaaaacttctcaaacaaaagctacaatttaacatcagaaagcacaaagtatagatagcattccttccttcctattaagtcagaaaaaaatgtcattacaatttatctttgcataggtcactcaaataaaaatatagagagaacaaaggacatttttcctaaattatcaaggtatcactgaggcagttacatctagtccttctcaaccaaaataatacatctttgttttctcctcctgtaagtgggtcagagcccttacaaatgctggaagcagggaaacagcctgaacatcaaaatatattgtttcaaacatactcctaggagctgacaagatgttctgggatgagagcaaaaaaatggagccataattaacaaaatctggttagacggagtctgacttaaaaataatactccacaatataaagcaacaacagaaaccccactaaagtatggaaaatccaagtctagattcaaatacagtgatacatggttgataagaataagaaagccaattctctgagcttaacattgatcctgttaaactaggatcttcgcagcagtgtcagatttggcttcctgcctttctcagaaactacttacctacaggctattttcttacctcttttctcaaaatactctattttaaagatgaatcctgatgaaattccctatctccactgatcaaattctacttacagaagaataacctctggatcaaatacactgggcacaacataaaaggtcttactctgtttaggttgctataacaaaataccaccgagtgacttataaaaaagagaaatttatttctcacagttctggtggctggaagtccaagatcaatgtgccgacagactgattctggtgagggctggtttcctagctcacaggtggggccttccagctgtgtcctcatggtggaagatgcaaggggcctttctcagtcctctttataaggatactcatcccactcatgagagctatgtgttggtgatctaattgtctctcccaaaagcctcacctcctaataccatcacattgggggttaggaattcaatatatgaattttaggggaacatattcagaccatagcatggtcaaaagtaaaacttatttttatcctttcatggagcaatggtgaaataatcattctatctggaggaagtatggaatgaacatacattaaaacaattctttaaactgagtcctaagaatatagaagaggtatagaaatcatgtgatttattatgttttctacatataaacccttcctggacagaaattagggggcagtggaggaggagaagaaaaggaaaaaaaaaatgtttttttaattttaaagcctaaccatagattgtagtttcagaaagtacaaggagaagtgacaccaaactttgaacctcacttgactctaaaaatgggaagatctacaggtgatgagaaagaattgcactttgaaatggcaacttttaccatcaatttttttctgttatgttgcatattaaatatgctcaatttattatgggccttcaatttccacaaataaaatactcgtccagtatgtactgaaatacctatctgctaaatatttataaagtaacctttgtcagtactatgccagttcacagcctgcaatgttttattgttattattctgacttcatttgcctgttttttaaagaatgttccagtatcatttttacaaaattggagggaagggattgaaagcaaaaagatgtaagaactcttaagtgaaagcacagaaatggtgtcagaaaataaaataaattagctttaaaagaggctgcatggtaagaaaaggatgtaaactttttaaatgttgtttctaaggaactctaattttgatgccaaaattagatggtgacatattgaggtatataacaggactgtaaagctaaatttagatgttccttctttaaagcatccgccagctcctagaccacttattgaataggtaacttgtgctaaacagttatgtacattatttcagttaaagctcaaaatgtgtatgcattatagagaaactggactccggagaaggactccggagaaggttacctatttgccctaggtaaacatcagtgaccaagttcatatgaaaatcctgcctgactccaaagcatgtgatcattcctctaaatcaagttgtccctcataccatccacccctcttcagcatctactttatattgactgtccccttaaatcctcacaaccctatgtgaggtgagcattatcatctttattataaggataaggaaaactagcacaatgaggttaggcaactttccagaatttagcttctggtccctggctccaaagcccatatattctatccaatatattttgctgctttcagctctaacaatctacaaatctatcatcacgcaacaatctattcctttacaggaaaccatgattctgtgcaggaagatcgagtcagacgtgatatttcattaccagcccaactctcatctttctcccttcacacgttccatatcacctctcctcccagcaaaatgaccagacatcttctcatagattggcattactatcagctactccccctaccacacctatagatgaccataaacgatgaagaaaagtaggaggaaatgttcccaccaagaaaaggtcattggggccacttttacagtctgccatattctacctgataatcttactccaacaagcccaaggatcaggtcaaattcaatacatatttaaaataaaaatttaaatattcccattgtcattttgatcttatgtcattatcagctggttgacggcaggcaacatttctaagtctgtgacttcatctataaaatgaatatgatatcaaatgacccttcaaccttagagctctaagttaatctaacatacatcccctcttcctttgcctgcttgtgagaaagcagctgaaaatttggcagggtgcagtggctcatgccagtaatcccagaactttgggaggctgaggcggctggaatgcttgaggtcaagagctcaaggccagcctcgccaacatggtgaaaccccatctctactaaaaattcaaaagttatccgggggtggtggtgcacacctgtattcccagctactcgggaggctgaggcaggagaattgcttgaacctgggaggcagaggttgcagtgagccaagatcaccccactgcactccagtctggcaaaagggcgaggttccatctcaataaataaataaataaataaaaagcagctggaaatgtataagcaaaggcagataaaactcgacagtaagtaaagcaagtgatcattattaggttctgcaatatacacaaggacctactcagaggcaggtgtgcatgcacacatgtctaatctgaaacaagtgacaaaaacaatctagagtttattcttgccaacctgaaatgaatcacctatttttacctcatctgcattcaagagggggcccagactgatccaaaagagccaatgaaccatgttcaccattgagtctcgaggcaagccggatctccaatccttaaagtgacctctggcttgactgcagctatcaactgaacatgaggaatggaaagctacaaaagcctaaagcttaccacagaagtagcatttcaaatataaatctacttctgtattttattaattctggtagaaggtgaggccagggctcaaaaagcctggatatcttaacattctaatcgttttttattcttcttcttcctttttagagacacggtctcactctgtcactcaggctggggtacactaactcaccgtagactccaactcctggcctcaagtgatcctctcacctcagcctccagagtagctgggactccaggcccgctaccatcccagctcctttttcttttattatctgggtagataaggggaatccctatgttccccaggcttgtcttaaactcctggcttcaagcaatccttccccatcagcctcccaaagtgcagggattacttccatgtgagccaatgcaccccgcctacattctaatcttaattctctaaatctagatgatgacacttcacagttgaggagcctgagataggatcaaaggtggcaagattacaattaaaatcctaaagtcatttgtaatcccaacactttgggaggacaatgcagacagatcacctgaggtcaggagttcaagactagtctggccgacatggtgaaaccctctctctactaaaaatacacaaattagccgggcgtggtagtgcatgccttgaacccaggaggtggaggctgcagtgagccaagaccgcaccattgcactccagtctgggtaacagagagagactccatctcaaaaaaaaaaaaaaaaaaaaccacatgccaagcaatctcaaataacgaacggtaaatttagggctgtgaagaaacttgagaattacaatagactgaatttgcagcaagacaaaaaaaaattttaatttcagttacaaagatgttattatctctaaaccataacacaataagaatctgcagctcagcagattacctaaattcacacgtgagaagtggaatgaacaaaatttaccagtccaatccagagacctttgtcgggaattctggctgctgccatcaataaaatggaagagaaacagccaaggtaactgagttggagtcccaactctgccattaataagatgagtgtgcctccaaggttcagaacttgtgggtatttcaaacattgagtgggaacttctagaaggaaagagctgccataaagaagccccacgagggctgaagagctggcaggggtagagggcccaagtcccgtccgctggtcaggaggcttttccaggccaaccaaaaccactgtagtaggtggagaccccactgagtccatgagaacacagagaagttggggtaaaaccgctataaaaagaaacatttgcaaggctgttcagaaggcagtaaaacaaaaagatactgtccaatatttcctattaaaaaatacagggccgggcgcggtggctcacgcctgtaatcccagcactttgggaggccgaggctggtggatcatctgaggtcaggaattcaataccagcctggccaacatggtgaaaccctgtgtctactaaaaatacaaaaattagctgcacatggtaccaggcgcgcgcctgtaatcccagctactcgggaagctgaggcgggagaatcgcttgaacccgggaggcggagcttgcagtgagctaagatcgtgccactgcactcccgcctgggcgacagaacgagactccgtctcaacaacaataaaaaaatcccagagttccacgcggcgccagccccagcgcgccagggccgcctttggagagcagcagccctggctctgcgctaccctatggccgtgggcctcaacaagggccaaaaggtgaccaagaacgtgagcgagcccaggcacagccgccgccgcgggcgtctgaccaaacacaccaagtttgtgcgggacatgatcccggaggcatgtggcttcgccccgtacaagcagcacgccaaggagttactgaaaggtctccaaagacaaacgggtcctcaagttcatcaagaaaagggtgtgggcgcacatccgcgccaagaggaagcgggaggagcaaagcaacgtcctggccgccatgaggaaagccgctgccaagaaagactgagcccccttccctgccctctccctgaaataaagaacagcttgagaggaaaaacaaaacaaaacaaacacacacacacacacacacacacacacacacacacacacctctttttcttagtatttcctaaccaagtgggaaagaaataaaaatctttattcaaataaaatttgtgtctataggccaaagaacgtgctaggcaccagaaacgtgaacatgagacagttaaagctccttgcgtctcgagctagtggagtgagaagcactgagtctcagtacaaaggtctagatggtgctctaggaggcagcaggaccctctgcagtgggatggtaagggcagcgtgcaggggacatggcatcttctcagtgaggtccaggcagagggaagtacacattatgaagataagaagggtaaaagagccagaaatggcaggatcagtgaggactttagataaagaggaccaccagactgtgaacgacctgttttaagctatattaatgagtctcttttaggaatataattctggggatgatgcaaagggcggaggaacaggaagagaggctagtgaacaatatttgagggcaaatgaggaatgacagatgaaagcagtacagcgagttttgacggaagcatttggagaggactcctgcaaagaaaccggtaggatctagtgaccaactagatacagactacgggggaaaatgaggagataaagtaactcgggcttctgcatttagaaaacactttttttcccctcaagagacaagttctctctgttgcccaggctagagtgcggtggttattcacaggcacaatcttcatgcactatggccttgaactcctgggctcaagtgatcctcccacctcagctgccagagtagccacaactacaggcacacatcatcgcacccagctggagacacttttaaaaattaaatagcagagtgacaaaatgttaggtcaccgcgaggcaggataaagcctgtgggccccactgttgtagaccctggcaattaacaactagcatgagtaggaagcctggcagagagaggataatggctctagcagctgctgcaaaaagaaaagctggaaggttacatcggcaaaaatccttactatttgctagagtaagattagggaacttaattctattcttacatagaccttacaaaatttcttgttgccttctactttctttcaaagatatttatgatgttcatttaaacacagacagaaagttacacacagagtaatttctgtcaccgaccccagagcccctaaggacagccataaaccaaaaggaatatttattccctccccctcaccctgcaacattttacaagaaagaaaactgaatgaagcacaggccatatgatctatctttcattacggtcaggaaagattagacaagataatgagtttggtttagggccagttatatttgagatgtcgacagacatttaggtagtgatgtaaagtagacagctggacatatagatctgtggctcagaatacagagctacagatataaatgtggtagtcaccagcccacaaatggtattaacaccatggaaacagatgcgatcattttcaaagagaatgcagatgagaagagcaacagacctacgacagtgacactgaggaagggccaacatttagataaaaccaacaaagaaactgagaggtactgctttgggttcaacttctatctacttcttcactaatcaaagacagaaaccttttctattaaagcatatatattttttttcagtgccaaatactgaagtattggagtactgaagacaatcaactataaattttaacaatttcagtaagttgccagcagttagtgacagcaatctttcactttccctgaactgtcagagagaaatggattccacttaagtgacatttcccaataaaggaagcttttccctttttgtgaacagctcatagctcaaattcttccaagagccaggcaggtgagtgagaagcactaagattcagacagtaaatgctgggtcctagttctactggagtgggcctgtgcctcctaagggcattcacattcagtcttctgtagagaaaacttgagggccctggtacttgcggtaccatgtgacctagaaatccaaaccatgcttccatgggctttttaacgactgcacaaggccacatagtaacaaactttcttacatttatcatctccaaggtcttttctccagctattaaccatttttctctatatactaactaagtcctcataaactctgtgttgtaaaagagacaattcaaaaaatgatcggttctgtggcttgggtaagttatctcacagcctcactttttcgtctgtaaaatacagatgattaataatattgttatgaggactaactgaaagcgtgcttgaagtgaggtcgttaatggtgaggaagaggggaagagaaggtgagtaaatgacgatgtcctttaagtacatcactgatgatcaaagtgccaataatgcctacacaactacaaataacaccggagtgccatacataccaaaaaacacacacacacataaacacacacacacacacacacacacacacacagaagttataccttttcttggtttttaattgttcaaagtttttaactattaactgaacaaaatatgacaattaaatggtacctaacaaaatgcatcactaaaaagaagaagtttaattcttggtattttaattgactgtattaaccacctattttttttaaaaaaaagttttttatttttatagagatggtacctcactatgttgcccaggctggttttgaactcctgggcttaagtgatcctcttgccttgtgactcccaaagtactgggattatagggcatgagctgtcatgcttggccttaacaatcttttttttttttttttgagacagagtttcactcttggtgcccaggctggagtgcaatggtgcaacctccacctcccgggttcaagcgaatctcctgcctcagcctctcgagtagctgggattacaggcatgcaccaccacacccgattaattctgtatttttagtagagaggggtttctccatgctggtcaggctggtctcgaactaccaacctcaggtgatctgcccgcctcggcctcccaaactgctgggattacaggcgtgagccactgcgcccagtcggccttaacaatcttttaaatcatctccggaaaaggttggtactacttaaaggaagcaaattttatagtcctaaaaagtcagaatcacatttatatttaaacaccagtatcctagcctaagaaatcacacagttctcttcagatagaaaagaactggattaggggtggtggcacaagtacttaattccaatactttcagaggatgaggaaacaagattgtttaagtccaggaatctgagagtagactgagcaacacagcgagatgccatctttacaaaaaatttaaaaaaaaaaaaaaaaaaaaagtcaggcatggtggtgtgcacctatagtctcagctacttgggaggctgttgtgggagaatcatttgagctccagggttgaggctgcagtgagctatgatcataccactacactccagcctggtaacagagcaagaccctacctcttaacaaaaaacaaataaacaaacaaaaaagatttgaaactaaaaattcaaaggttagtccgggcgcgatggctcacgcctgtaatcccagcactttaggaggcccgaggcaggcagatcacgaggtcaggagattgagaccatcctagctaacacggtgaaaccccgtctctactaaaaaatacaaaaaaaaattagccgggtgtggtgttgggcgcctgggctgaggcaggagaacggcgtgaacccgggaggcagagcttgcaatgagccgagatcgtgccactgcactccagcctgggtgacagaccgaagctccatctcaaaaaaaaaaaaaaaattcaaaggttaaaccaggctggtctaggagagggtggaaaataacaaaactgtcaattctgtccacgtgtgctagttgtgtctgttctatttgatgaccaaggacatcacacctcgtctctcagccttcttgaggcatataaatggaagtgactggagaaaagacatgaagagcacatcctgtttcacacatctgcagcctgatgcgggccaccttgtacatataaacaatggacatctttgttgttcagatattatactctgaggcataggggtttggagctccaaaacatagcttttagagcatctctaatattaactggtatgtgacattcttaagtcatacacttactggtttttttaatctacaaagtgagaataaagccatctacattacttatcaacaaggatttttttaaagaactaaatagtgaacaggaaaatgctctgtaaaatgaaaggcatttaagttatttcttccctggctaggacacagctagaagaacagtactagtataatttaaaataatcattcttggttttcttaaagaacagaaaaaaaaaaactggtcaaattcctttgtactaagttcccagactctaaatgcctgaatttcaaatactggaagttatcagtttataagaatcccatctagaacctgagttgtatcaattcaccattttgggcatcagtttttctatctaatgtataaaacaagggtgtaagatgacccagacttccatgttcttttcttgctatcatgctttttcattccattcatcatcctatatatgtctggtcaaaatcaagcaataatagttaaatgcttttgaatagcaaataaaaaatattaaaatgctacatcattcataaatgaacttttaacttccaaaacctcaactatactaaagttaaaaaaaatagtaattctcaaatgtggagattcctcctaataatctattcttacgcatatgacctagaatgaggatgacatatgatatgtaaatatttttctcatatgagctcttgttgcccatgtgcctctcaaagcatgaccatttcactgagctaagcgttattctactgttaaaaagtcgtggctactttggccaggcacagtggctcacgcctataatctcagccctatgggagtccgagggaggtggatcacctaaggtcaggagtcaagaccagcctggccaacatggtgaaaccctgactctactaaaaatacaaaaaattagccagacatggtggcaggcacctgtaatccctcccagctactcaggaggctgaggcaggagaatcacttgaacccaggaggcggaggggaggttgcagtgagccgagatggtgccattacactccagcctgggcaacgggagcaaaactctgtctaaacaaacaaacaaacaaacaaacaaacatactttgtaccacatgcccttacatgcaaacaatgcaagaaaaaaaaaacaaaaacctgatgtgttgcatcactggacaaaagttggctgtgttggatttacagaagtatgtcatcagtcactgtaatttcacatttggagatatacaggttttcccttacatgcatgcaaaacactaggccactgactcctaatagggatttttaagttcgaaattacaaaatgtaccaaatcacaccaaggaactaaatggagccttgttcttagaaaaagttaacttcagtagatctactttaaaaacatttaaattggaagaatattttttggaaaatgcttgacttgtactgatctaaaagctcttctccaaattcatcatgaatatctggtccaaagaatcggaaaacctttagtggtccccataaaacctgtaattccattaaacaagtagatgaaccgcttaactactatgataatcagctccatttttttcaccagctgttaaatcttttctagcaactctggggaggcaagggataataactttgtttttcttcaggagctagaggtactgccaagcagagcctaagctgccactaggaacatggctgatattagggcagcaacagcaacagaagctactcaggggtacgtggcagtggaggaatgaaatgaggatgaaatggacactgcacaactcattacacccaaacacaatttcttcatttgtgtactttgaaataaatacttacatctatgttgaaatgaagtaactataacaggacaacgccatagcaataaatacatcaatacaccttttccttcaacaaaaggcaccccaaaaaactgacagccctaaactgaggcaaaggtcacatgtaaaagatctggtgtttcttatatcacaggcacccaagggttcctctagagaagtctttcatttattcaaacacagactgtcaaattataactgatgaatactcagtaagaaaggaggcaagcttttttcttttctttttttagagacagggtctcactatgttacccaggctggtcttgaactcctggggtcaagctatgctcctgccttggcctcccaaagtgctgggattactggtgtgagccactgtaccctgccacaagcattttttatgaaaaagactgggctgaacagcaacaacaaaaattctttcctctaagcttaatcccacaaggcttccttttcaataaatgaatataataacacctaccatcatttaattgtaaaccttccacagctctgcattaaacagaggcttctcctacaggctaaagattgtgctggtctcaggaaaaagatgtcctttttgcatactgggcccaaagagtattttaataatcattagtaatcaccatgtgggggtgtgtctggtgatgggtacaagaattgaaatttgaatccaaatttgggggttttgtattttttgtaagctctagctagactgaatggcaacaacaaactgaggctaaattcagtgtcgtggcttgagggggaagaaggagctgactaccatcataaaccataatttctctactgacctttatctcttttatcagacaacacagagttcgtctatattaatttatctttccctttaaaactgaacatttaagaaactacactccttttactttaaaactgttttatgttagtagaacattaaaaagaggatataacaccaggcaagtaatatgatggcagataactgaatatttttctccttaaatgatgacagaaaattaagcagctccttaaaataaaaaatgctcaaaataactttatacaaggacaaataactgagtgcagtttcctttaaattactaatttgagttacaatgaaggaaataaactcttgcctgtaaaatataatactgtcaggatagaaagggcaaaagaattttaaaaaaacaaaaacagagtagggtggagcttaggaaacaaagggcaaaaggaagcaatattcatttaggaactaaagaacaataaaggaaacaatcttcatttctaaatttaaaaagaaaggttaaaataacagttcactggcgttctcatctgaaaagaaaaagttgagtggtttttgaattttaaaattaggtaaaattaaaaatttaatccttcaatcatattagccacatttaaaatgctcataggttttactgatattatactatcttccatcagtggaagacagactgcccagaaattccacttaggcagcactggcctaagtattttaaacaatttatagaaatgatactttatatatccattgagtaagaatttctgcaacaaaatgattagtgaaacattccaattatcatctttcttttcttttttttttctttttttttttttgagacagagtctccctctgttgcccaggctggagcccagtagtgtgatctcagctcactgcaacctcctgtctcccaggttcaagaaattctcatgcctcagcctcccgagaaagtgggactataggcacgcaccccacgtctggctaattcttgcatttttagtagagacaaggtttcatcatgttggccaggctggtctcaaactcctgacctcaggggatctgcccgcctcagcctcccaaagtcctgggattacaggcgtgagccaccgcgcccgacccaagttagtatctttaagttaggatttctttaatcataattaactgcgtaaaacctaggaaaaaaatacgtaagacttaacaggtcaatcacctgtctttagaaagaagcacctctaactatggtactccatttcgatgtttaatacccccagtgtcaaggaattcatccactctctgtcactcattgtaaatgctgccataatattcccaccaatttccagaacagatgaataatatcttgctgcaaagtctacagcatatcttatagccttccatgctagggggaaaaatatatttctttagactttctttaaaagaccttacttcatgcccacaggaaaatgtgcatgtattatctacaaacatccttgctaaaacctttcaatggctcttggtaaacatcagcataaaattcaaagacctttctttgccacctggtcactatatacccctctcatctattttcccatcctctcctccatctcttttcccgcttatgcaagtatttagagtttcaagatggtgccacaatgtttcatttcaccctgatttctcagatgctgtttcctggaatactatttagactagatccaagccgtcctgagactacacagagagcacgcccctgtcccccacaaaagtaattcaaattccagaaagaaaaatgaaaaggtcttgaccaaaaaggtgattacattttagaactgtcttagaaggggaacaaaattaagtagtaattttattgtagtgcaacaaaattaagtcattgaaaatatattgagcaaccaatcatgaggccatggttgaaaaggtaaggttagagaatcttaattcctgtacatctttattttaaaaaaaaacaaacaaacaaaaaaaaacaagccagccatctgtgttgaatgttttgtcacctgtttagagtgagaggcttgaatcacataacttcttgaaatccttacaaaatttagattcattagcataaatagaatacccaaattttctcagtgactatgtcacttaactgctaacatcaatggctcatttagctgtttcgtaaatgcttgactgaatataagaatctattgatgaatcttttacctcgttacagctgattgtactgatctttgacttacccacacccaattaacacagaaagtaccacaataatacttaacttttactagagtaaagacctaaagaacagagactagtaagtcaacactatctggaatattcttcaatgtcatctatacgacattcagaaagaggctgttttgagaatttcaagtgagggtgtaagttaaaaggttctcttatacactgccaatgacaacgtaaagatgtatctttctgaaaaacaaacactcctttataaagagccttacaaattggcttcacaagtgattccatttctaagactcaatcaataaaattatgtacatccatccatatcatgaactcagttctatgcaacctttataaatgatactacagatgattatttaataacataagaaaatttgcatatgttaagtataaaatgccagtttgaaaatcatttctcagtatgatactggattgtacggttggtgatgatgttatcgttgaagtacatctgcttgttttttttttgttgttgttgttgttattgttgttgttgttttgagacagagtctcgccccgtcacccaggctggagtgcagtggtgtggtcttggctcgctgtagcctttgcctactgtgttcaaacaattctcctgcctcagcctcctgaggagctgggattacaggtgtacaccaccacacccagctaatttttgtatttttagtagagatggggtttcaccatgttggccaggctggtcttgaactcctgacctcagatgatccacccgcctcggcctcccaaagtgctgggattacaggcatgagccactgcatctggcccatctgctttttatagatcttagactaaaacaaaaaattggccagaaaaaattaatcatggtgactgaactttaatgattaacagctcagtgccttatcatcattttatctgaaatttctaaaataaataagcatttaagatatgtagaaaaaaagttatgctaaaatgataattaagttagaggaaaaggtttggttctaccggggaaactaatattgtttctccttacagatgaaaagagcaatgttaattatttccttagtatggctgtcaagaagcttaaagccaattttgttagtcacctttactagttgcacagcaaatacccgtatctgcgtgtgcatctgactatcctccatcataaccttctactgtgatctgcattttctctgacccccttttttctactgcattataggtagttatcaaactagtctcaatatatttcctggggggagggtaggtgaagggaggaaaagacagatggaaaagaaggaaaagggaaaggcggggaataatgaggtggcagttttgaaaacagaacatttttctacctccaccattttcagattatttataaagcttaagttctaccatagtgggtacataaatatttacagaacaaatcaatgatatccaagttgagaaacgcacatctaggccaggcacagtgactcttgcctgtaatcccagcactttgggaggctgaggcgggcagatcacctgaggtcaggagttcaagaccagcctggccaacatggtgaaaccctttctctactaaaaatacaaaaattagctggacgtgctggtgggcacctgtaatcccagctactcaggaggttgaggcaggagacttgcttgaacctgggaggcagaggttgcaatgagtcaagattgcactccagcctgggcgatagtgtgagtccatctcaaattgaaaaaaaaaaaaagagagagagcgagaacaagaaaaatgcacatctgtcagggctcttcctattacatacagttaataccttattgaattttgtactgttattttagtatggctattagagcagtgatctgcagtgtttggcatgcctcaaatgtcagaaaaatccagagacacacctgtgagcatcaagataattttacttccattatttcaatctacagctaatgcttagtaatcacagtatttaaaaatcccctacaataagtctgcacaagtctgtggctcacaaattgagaatcaatgtgctatagcacagaagaaaaatatttaccataggctgaatctgaagaggagatactcttattgttaaggctgttttgagttactgttttgtttctaacttgcaccattatgtatgtatgtacgtacgtatgtatgtatttttagagacagagtctcactctgtcacccaggctggagtgcaatggtgcgatcacagctcactgtaacctcaaactcccaggctcaagagatcctctcaccgcagcctcctgaattgttgggactacaggtacacatcaccatgcccaacttatttttaaattattttgtagagacgggggtcttggtatgttgcatgggttggttttgaactcctggcctcaagcaatcctcccactctggtctcccaaagcacttggattacaggaatgagccactgtgctcagccacacaagcatttaaaatgaagagatttgacataaaaatccaaatgttcaactcgtaaaaaaaatcacaagagcaggcaaaacttgcccggtatttctacacggcagcaatcagcaagagagccgatcagcacccacatctagatggtgtcatcatctccagtttctgtgctccccacctggctgtagccactcattggacatactcttggtaagcaactgtgtttgtaacctctttaccataccactcatcttttaaagtaagtttcccagaagtgcaattattagttatgtgcaattctttctaaggagtgccaaaagctactcactgtagtgttgtccattagagtacttagcactgcatgtccaagaaacagaacaaattatgccaggggccagccacccacgaatgtgtcttccatgcaaggtttgtacactgatattctgtacaaaacctacatttctgtgctggctttgtggctccctgatttccaaatcactaagtggctagtgcatagcagctgctgaaaaaaatgctgggtggatggataacaaataaaatctactaaaattagtcttaatttcttccagccccagtacataaaagattgttacaaaaggaatctgcactatgactgttgaaagtagagtttttattgttgctattgttattataatagctgctcacatttgttcagaacctccctgataaattcatcataatctacattgctggagcagaagaggatcccaaagagaagaggaagtgccactgctgacatgcaaaattatcttaggtgatacttgaaacctggtattgaattacactgaatcaaatactgaggaagttattccttttccgaggttctttcaatctgtctgggtgtatgagaacaactctcactttggtgctaacacatatttatgtccctttatgacacctgcaaatttaacttcccttgtaaacacagagagcatatggctcaggcttggagcctttatcagacaacagaatctagacagggtttaacagtcatttttttttttaaggcaaacaatacaggttctctattgctggtggagacacaaagattcctttttaaagaaaattaagctttaaaaagcattaaaaggttttacatttattttaagaaatttaaaaataaaaaagaatggccgggtgcagtggctcacacctgtaaacccagcacattgggagtccgaggcaggcagagcaagaggtcaggagactgagaccaccctaacacagtgaaaccccgtctctactaaaaatacaaaaagttagccaggcgtggtggcacgcgcctgtagtcccacctactctggagggggaggcaggataattgcttgaacctaggagacagttgcagtgagccgagatcgtgccactgcactccatcctgggtgacagagcaagactccatctccaaaaacaaaaaaaaaaggaaagcatgatatgaggccaggtgcggtggatcacgcctgtaatcccagcacttcgggaggccgaggcaggcggatcacgaggtccagagtcctacaccagcctgaccaatatgatgaagccccatctctactaaaaatacaaaaatcagccaggcgtggtggcatgcacctgtaatctcagctactcgggaggctgagacaggagaattgcttgaacccgggaggcagaggtaatagtgagccgagatcatgccattgcactccaacctgggtaacaagagcgaaactcggtctcaaaaaaaaaaaaaaaaaagaaagaaaaaaagcacagtgtggagtgcaaatgtgacaaaaaaacaccaaggtgatacacaaaatactaatatttgggatgtaaatgactatgttttatcagtccagcatcatcctgataccaaagcctcgtagagacacaacaaaaaaagagtattttaggccaatatccacgatgaacactgatgcgaaaatcctcagtaaaatactggcaaactgaatccagcagcacatcaaaaagcttatccaccacaatcaacttggcttcacccctgggatgcaaggctggttcaacatacacaaatcaacaaacgtaatccatcacataaaaacagaaccaacaacaaaaaccacatgattatctcgatagatgcagaaaaggccttcaacaaaattcaacagcccttcatgctaaaaacgctcagtaaactaggtattgatggaacctatctcaaagtaataggagttatttatgacaaacccacagccaatatcatactgaatggacaaaaactggaagcattccctttgaaaactggcacaagacagggatgccctctctcaccactcctattcaacatagtgttggaagttctggccagggcagtcaggcaggaaaaggaaataaagggtattcaattaggaaaagaggaagtcaaattgtctctgtttgcagatgacatgattgtatatttacaaaaccctatcatctcagcccaaaatctccttaagctgataagcaacttcagcaaagtctcaggatacaaaatcaatgtgcaaaaatcacaagcattcctatacaccaataacaaacagagagccaaatcatgagtgaactcccattcacaattgcttcagagagaataaaatacctaggaatccaacttacaagggatgtgaaggacctcttcaaggagactacaaatcactgctgaatgaaataaaagaggacaccaacaaatggaaaaaacattccatattcatggataggaagaatcaatatcgtgaaaatggccacacggcctaaggtaatttacagattcaatgccatccccatcaagctaccaatgactttcttcacagtattgggaaaaaaactactttaaagttcatatggaaccaaaaaagagcctgcattgccaagaaaatcctaagcaaaaagaacaaagctggaggcatcacactacctgacttcaaactatactacaaggctacagtaaccaaaacagcatggtactggtaccaaaactgagatatagaccaatggaacagaacagaggcctcagaaataccaccacacatctacaaccatctaatctttgacaaacctgacaaaaacaagcaatggggaaagcattccctatttaataaatggtgctgggaaaactggctagccatatgtagaaagctgaaactggatcccttccctacaccatatacaaaaattaactcaagatggatgaaagacttaaatgtaggacctaacaccataaaaaccctagaagaaaacctaggcaataccattcaggacacaggcatgggcaaagacttcacgactaaaacaccaaaagcaatggcaacaaaagtcaaaatagacaaatgggatctaattaaactaaagagcttctgcacagcaaaagaaactatcatcagagtgaaaaggcaacctacagaatgggagaaaatttttacaatctacccatctgacaaagggctaatatccagaatctaccaagaacttaaaccaatttacaagaaaaaaacaaccccatcaaaaagtgggcaaaggatatgaacagacacttctcaaaagaagacatttatgcagccagaagacacatgaaaaaatgctcatcatcactggtcatcagagaaatgcaaatcaaaaccacaatgagataccatctcacaccagttagaatggtgatcattaaaaagtcaggtaacaacaggtgctggagaggatgtggagaaataggaaggcttttacactgttagtgggagtgtaaattagttcaaccattgtggaagacagtgtggcaattcctcaaggatctagaactagaaataccatttgacccagcaatcccattactgggtacatacccaaaggactataaatcatgctgctataaagacacatgcacacctatgtttattgtggcactattcacaatagcaaagacttggaaccaacccaaatgtccatcaatgatagactggattaagaaaatgtggcacatgtacatcatggaatactatgcagccataaaaaaggatgagttcatgtcctttgcagagacatggatgaaactggaaaccatcattctaagcaaactatcacaaggacagaaaaccaaacaccacatgttctcactcgtaggtgggagtttaataatgagaacacatggacacagggcggggaacatcacacactggagcctattggggggtgggggactgggggagggacagcattagcagaaatacctaatgtaaataacgagttgatgggtgcaggaaaccaatatggcacatgtatacctatgtaacaaacctgcacattgtgcatatgtaccctagaaattaaaaaaaaaaaaaaaaaaaacagtatggagtgcaaatgtgaccaaaaaacaccaaggtgatacacaaaatactaatatttgggatgtaaatgactatgctttaatgttgccattttggcacagagatggaaagtgtccaaatttaatttccattgtatattaaatgaaaaataaatgtaacaataagctgtgcgcttttatggtgacagaaaaatctggccgggtgtggtggctcaagcctgtaatcccggcactttgggaggccgaggcgggtggatcacaaggtcaggagatcgagaccatcctggctgacactgtgaaaccccgtctctactaaaaatacaaaaaattagccaggcattgtggcgggcgcctgtagtcccagctactcaggaggctgaggcaggagaatggcgtgaacctgggaggcggagcttgcagtgagccgagatcgcgccactgcactccagcctgggcgacagagcaagactcgagactccatctcaaaaaaaaaaagaaagaaaaaagaaaaatctaagacctgtaaccttgacagtttgtaacaaaattatcttatgattatttattaatctatgccaataccacagaaagagataactccccataccaagaaagtcttcctataaagctcataatttgtaaaatgcaaatgaacattatttgttttgttgacattttgtgatgaaagcacttctatatataagatcataaggtggggttaacagtgagtaagccagtaagtagaccaaatgtcactgatacgccccactgtcaaacagcagctgtgacaaatgctacaaaggagaagtacatggtactgtaatttgatacaggcagagcttccttgagacaggaaggatgggaacagcaaaacagccaggacatgaccaaaggaagagatacatgagacaaggctggagagggagatgaggacagagaaaagaggtactcactgacccaggtatggagtttacctaactcccaagcacaaggggaagacagctgaaaggttttaaacgtggaatgacctacctgatcagatttgtgttctgaaaggtttgctctggctgtaatgtaagcaaccctccagagaagcatcagtaaacagacagaatcaaaattgattacaaaataatgtagaaactactacatctagaccaaataaataatggccaacagaaaacctgatcagaacattgtccagtctttcattggaaactaacactacacttttatttaggtatatgatacataaattttagagactaggaacagcttaaaacttaacacttcagaagctatcaaaatgtcatgatttcttggacagacctaaggtggcctacctacctcaagggctttaagtaaagaggactggagctcgaggaagtggctccaaggcggacggctaagcatcaaaaactgcggctctgatttacattccccagctcccaaaccaagcatcttctttatatattttacatgataacttcctattaaggtttgacgaaagaaggttttgctactgaaaccaagtctgaaaactaatgttaatacccacggcctctagtacccagttacaagactataatcagtgggaaagcagtgcctccaacaacaacaccctagggtcacttactggtctatgcttctaattctgttccccctcaggaacgctcatgttcagaaatagtccagtttctacttctaatcctcctcaaaatggtgcaaactctgggtaacactggtagagccaccagaatgctaacaaggaaaaaggaagggagaaatggagggaaaggtaagagaaggaaaaaaatatatacaataccaaattgaaaagaacctggagcatacacagttggtggaagtatagagtggtacattcactttggaaaactgacaatacccactaaaactcagcaactgcactcctaggaatatattaaacaaatgcatgcaagcttcattaaccaaaagacatgtatggaaatgctcacggcagactgggcaaggtggctcacacctgtaatcctagcactttgggaggctgaggtgggtggactgaggtcaggagtttgagaccagcctggccaacaaggcaaaaccccgtgtctactaaaaatacaaaaattagccgggcgtggtggcgcgggcctgtaatcccagctactctggaggctgaggcaggaaaattgcttgaacctgggaggcagaggttgcagtgagctgagatcgctccactttactccagcctgggcaaaagagcaaaactccatttcaaaaaaaaaaaagaaaaagaaatgctcatagcagcactattcctaataaccacaaactgtaagcctcccaaatgctcattaatagaatgaataaactgaggtatattcatgaatactgtacagatatgagactgaattaattacaactacacacaacaatatggatgaacctcacataggtaacctcacataggtaacagaccaaaagcttatccagagggtttctatttatataatgttcaaaacagatacaactgaactgtcatatgcaaaaaattgaatctcaatctttaccttaatactaaaaccccaaatgaatcacagacttaaatgttaagatcctaaaactcctaaaagtcaatctagcagaaaatattagtgaccctaggcttggcaaagatttcttaggcacaacacacacacacacaaaacaaacaaacaaaaacactgaaaaaaaatttcaataaactgtatttcataaagatctatgatctgggtactattccatatacgtatcttcaatgaaaatactaacaaaaattaaataaagaattgagtgatgagaagacaacacaatcaaccactatgtcatctcattaaggaacaagtacacctctacaaggagagaaagaaagccaacagtggcagagcaggagttggaaaagggaaaaatagttatcaacaaatgtttttcctagtctttgcattgcaacggggggagaaagggaaaacaacgaagaaagaccctttggttctcctcctataactgctcttagtccaccacacatcataaaagaaaatatatcaacttaagagcaaatcaaagacatcttggtccaggatccttttccactgaatgccctttacttctttctctcttcatctggtaccttcctcacttttgaattttttcccttcctttctccttatttttccaggtatagctttttgctctccgcatccacacatcgctatgtatcactttcacctttgcatacgaggcaccaaaataagaagagaacaattaaaatacacacacaaaaacagcctgggttccttatggatttgaaatacccttatattggagaagggacaacacacaatctctatcaattctcaccaatcctttttattcggcattggtagaatataggccacagcataaatattactatgacactttttccctctccgcttctctcctctcctgaacaagacagctacagtttgtgaattcagtattggctagctaactgaaatgttaaggatctaggctaggagttcttatctattgagctacaagtataaagactcccttttaaacactaaaatacatcaaaaacccacaaacatgcaaaaagaaattatcctttccgtatctgttccctgagaaaatgcaaacctatatagcactgttgtgagttgttaatttttagttcattgtgaactttatcaattaaaacaacatccactcacactgaacagcagatgtgggcaatgctatgtgtgaatgcagtctcagcttctcagatctcctcatctcacaaactcctcagccctccttgggtttacctaggcagactgggaatcagctctgaccactctgggctcaactttctttactgattaagaattgtacaattttgttacctgagttccctgaagaaatagcaataaagtttgacaaaaatgatagtacggtaaagtaccttctgttcacacaggattcttctgggatgatttattaaacagttctcccaataaccattccttctacacacaacacacacaccccttccctctctttctcttcacctaaaaagcactcagaactggtatctagactgtttaataaatgattagagtcagccctccacatccacagatttgacccactacagatcaaaaatatttgggatataaaacaataaaaaataaaatacaacaataatacaaatttttaaactataatataacaactatttacagagtgttttcattgtattaggtattgtaagtaatctagagatgttttaaaacatatgggacgaagtacacaggttatgtgcaaatactataccattttacatgaaggacttgagcatctgtggattttgatatctatggggggtcatggaaccaatcaatcccccttggacaccaagggacaactgtactacacctttttagctattatggttattactactactactctcccccacgcacattaccccataaatcccagaagtgctctagctaagaaagggcaaaatgaagaaacgagaacttgaaaacctagtttttttaatcagatattcacatttattactgtaaacaggagtaaacaagggagtaaaaatgtgtctagcaccgactctactatattcaagatgaattcattcattcaacaggcactcaaaaaaaaggaaaatacctgcagtaggatttacccctaaaatctccagagggtactgtcttgcagcaaatatcttcctcgtaactattatatacatcatttttcattcatcattaggcattttttttaaaaaattcattcaatagcattctctgctcttaattttttaaatggttatgctgagtttttttctctctcttcaaaacacaaaaccaaaaaataaactaacgttttgtaaccctgatagttttgatcttaggagtcagccattcagaacagaagtactccataactcccctacaaaatggcactcttcagacttccactgttcctttaaaggtaaaaacataattttagatttcaaggtgttattgagatctattaggataacgtatttcccaatttagccccccaaacaaccttcaaattccattataattttacttcaaatcgtatgtatatttttcagtgaaggactcttaagattctacaaaaataaattaggttgttttgcttttcccattttataaaattgaacaaaaacaattcaaccaatactaagctcttgcaagactagcaattcttttaaaaggataaaaatgagatgaaaaattactagaaataatcacatcagggtttttgtatttatattttgtatttagaggtacttttctctacccagttttctgaattatcaaaagataattctatatactgcaggaacaaaatcagttgtggtgaatgataacttttggtttgcttacaatcaagcagtttctcccctgctaaagaaagaagtcagatttcttcaacctttctaccagtagacagatgggaacactgactatatgcaaattccaaatatctctaagatttagagcaccatgcctcaaaccattaacttattttttttttaagtgaaagcaaaaactcttaaaatgtagctggactggtgaacaaggaatttaagaatgtaatgataatgctacatgatattgtaaggtgttaaattcctggacaggatatagtgttacaagccataaattctttttaaacttcagattcttatttttcaagttcctccaaacaaattaaaaagacaaatgatttgactgttcattaccatatgacttttaataaaaagtaggggcaagggagagtaccttcttgttgtaatatatctacattaacgaaacaacttctatgtttgcaaagtgttgtctgatttataagctacatttatcaaccattaagtcaggacagcataatggccatgaaataataatacataaattaagtaatctctggtaaaactgtgcatgaagttatcagaagcaatagtggctgatttctaaactttaaaatcatgaccacatgcgtcctccctttccttcaaataaccaccagagtgtaggtaagtaaataaataaaatcactaaaatatcttagaatatctttccttacagaatgtattttaaccagaaaacctcatccactcctaatttgtttctcaataatattcatccactctgtccaaccctcaatttatcagtaaagaattcatgatattccaaaaagctaatgtaattattactgtcatctcattaagtgtgctcttcctagtaccaaactctaacattacagctgatacccagctcgttcactatgcacaccaccctcttctacccttcccatcaccaccattttactggcagaatattcacaaggctgaagactgtttctcatctcagcaaacagaatgcttaagatcagatggctagccacaaaccaaaagttagaagccacacaaaaataaacactagcagtcctaaaattttctactttcagtctctaacaaaagcagtaacatcatttttatttgtgatgccctaagttagagccataagctttttcccctgattatactaataaatcaatttaaaatgataattttacatcagattatgtccttcatatactagcatactttaaataaatccattttaccatggtaggttcttcaactcattttttttgtattttttctgtatcattccttaactaccacattatttctccattatttttctaaatattacatctatgaacaaaaaagataaccctgcaaaccctagaaaagataaatcaacatataccttaagtataaaatatcaatattaagtataacctattaggtaaccaagagaaaggtaagcatcaactgtatgcccaggaatctcaatttaagacatcatgtagtatacactattttggtaaacagaactgtatacaatatttgcatatcaaaataggcaactatagccttatttctgacttcagataaaaatatcttaattctttttataaggcaaaacagtcattttaatgaaatatctcttttcagatataatcatatgattgacagataaaataattgctttaaaaatacttctgagtcattttgtccttacctgcaggcatgaaccattactgcatgcagtgactgttccatttcctagcacagacttgaagaagcatcatatctctcttacagaatgtgactaatctgtgggtttgcaattcctaagctatttacaaatggcactcccttaccatataagaataaatatttattacaacccaaaatcaagtatttttaacctacattttacaaataaccttcgtaattctgtagagcagcaacctcaacatataggaagaaaacctcacagcatttccctttaaaaaagcaagatttttcttttctgctttttagctaaattatttttaaagccttcaacagctgtcacacatgaaccagcggtctgctgtgttatggtgtgcatgctgcagctgatcaggctccactatttttcttaaaaaaatcaatcaccctttgcaaaagcagaacagcttgccccaatacacatcttcaatacagcacaataccagcatgcaggacaatacgttatatagcaaacttgacaagaaaaaaaaatatgtcctggtttgtttcttagcaatgctacaccattaattgttcatgcaagagatgtagctgtacctttctgaagaggacgacttctcagagttaactgacatcagcagctcaatcttctgcttgatttctggaaaaatcagaaaatattcacaaccaagattgcctgcccttgctttcaagccttatatcaagagatttttcttctctaatcccttttgttcagaatgaggccacaagattcgcagtacttctgttaggactgggattcaatggtgctataaagggaaaaagctccagaggcatcaggccttgctaaactatgcacatgactgtttatgaaagcaggaagtaccatttctttaaagcagaggggtgttttcttttttaaggtagaactagcatggttctacaagatgattttcaatttagcaaaataaaatacaaacaagaaatcttgaacatctgaattaaatatactagataatttgagaagcctgggtaatcacgtcacaggctgtaataaacagatatgcaacccttggctgtttctatttcactagccctaaaaaatatggctcagtgaatcatttttgtcacttaagaatgaaatattaaaccagaaccccgatgtatagatttcaaaatgtttaacctttgttttaatttcttgattgtgtttaattaaagacacatttaatatctagtgttcctaactcctctagaaagagacttctgattttataccttaattttcccctcctccttagcagtacagtacaagtgaacagcaacacccatttaccgagcagagataatatatttgtccttttaggaaaggattgacaatagacatctacaacaggaatgtaagcaccagttcaacttaattaaaagataattgctgatactgatttggaagggagataacagactaaaagggaaggaagggtgaaaataagagagggaaaagataaggagacaatctaacacgtttcctttaaaacatcaacgactgactaaagcacataattttaagttaataaaactgacatggtcctattacccagactatttcatgtgtaaagctgttttcctatccctaataagtatttccaactggatttttaaaactgaagtgtgctttcataataaaaagttcacatactaaaaaataaattagtgccaataaaatgctatcaacagtaccaggatttcaaaatagacctcaatagttttttaagcagtaaagcaaattttttttaaaatgttgactatataaatcaaagttgaatatgagaagatgtaaaggaaaaaggaataaaaattagttccataaaatacaatggacctgtacagaaatatcctctcagcgttgttaaaataaggatttttcccaaatttttaagcttataacttcaatgagcattataaaagcggcatgaatacctgatgagagagcagaatctaccacagggtgtagccaagctgccgagccactgggagagcagagcacagcgcctatagctggggtggtgctgagactcaccttgaggatcaggcacatggcgccacagtgagccctcagcagggcccctcccctcattttggaaggagcagggtgtcagagctcagactctgccttggatttaggaacagcctcctctgcccttttttttttttttttgagatggaatttcactcgttgcccaggctagagtgcaatggcacaatctcggctcactgcaacctccgcctcccgggttcaagcgattctcctgtctcagcctcccgggtagctgggattacaggcgcccgccaccatacccagctaattttttgtctttttagtagagacagggtttcaccatgttggtcaggctggtcttgaactcctgacctcagatgatgcgcccacctcagcctcccaaagtgctgggattacaggtatgagccacagcaccaggcctcctctgccatttttaatagctgtatgaccttggagaaattacttaaactctctaaagcctctatctcctctcctgtaaaatgaggataataacatatatctgaaaggctgtggcaaggatttaatgaaataacccatgaaaataaagtagtattgtgcctgggatgccatgagccctccctgcttcatctctcaataaatatttactgaattagttaatgaaggataccaggcctgtccaatgttaaatggtttttccatagtttaaatccaccttctccttcttatcatcaacctcaacatccccatttttatcactgtagtgttattgtaggtgggaacttaactttaatctgtatctcagcctcccttcctagagaattgtgctccatgtatcaacttgctgcttcagaaaagagattacacttgaatccatcttcatcatggcaattttgtattccaaaacaacaaaaagttcacacttcagtatacgtacgtatatcaatgcacttaagatgaaaaagcccaagattaaattacacagctctaacgaagttaatgcctatcttgtaaacactggaaagaaaagttcaagctataaaccatattctgactggtgacactggaagccccaaaccaaagaggattctaataatacatgaaaaggtttccaacttcattttcaccttatctctaaaccttcagatttgttcatcgctccagaaggactcagaaatcaaggaacgttaacactatgatactgtatcctttgaggcccacatactctgtctatgctaccatcaactcctccctgtccttatcatccataggtctggtaattccccacattcgtgaagaattccagaagccatttaactgatttccattccaccacaacacctgccataatcgggggtacctggatgtccatactgatatgacttattagaaaaggcttggctatcgactccaggctcctcagtccacagactcttgaacctctacctcttgagccatccgttcccttgaccatgctcaggacactttcttacacacaccgcaaacactttccccctcaattagtcagttgttttggaattttattcaattacttccagggtagtatctgggaccctatatgctttatttttctgcaataaagtcaaccaatcttttccttgttaaattctggccttcctgataaacttagaaacaaacttagaaacaccttcctcacaccaaagtttttaaatttttcatccaattttcctctaatatgctttataatagtatttgcatgtaaatcttagaaccttctagattttgttacattaattgatatagagatccagtctgcttttacaagtcagattttaaaatgactctcttgtcattttaaaatgacacatcttcacaattctaaaatgactctcttgcccaccacttcatggttcttccaaagcagcacccactgtctccatgtatacatttagaccagtgagtgcaaaaaaaagtccatcaacctgattatttaacagttgtattccctatggatgtaatctgaaaatgcttgacagtacactcaacagctccttctacatctcagcctttaatcaatcctttaccatctgccctactcccacctcaagaccacacttgcttatttcacacagaaaacaggcaagcagttcctgtgtagtttgaataaatatattttaaattatggttgcttttatttttagtcataattttgtttcttaactgctaaataacattataggaggacataagtttttgtggcttttttttaatgcttttacatttgctttctccttctaactctgggtactttgcaagaccgttatcttccatgcagcccttaaatgctggtaatacctgtaaggaccctcttttcactcactgatccttctgtctacatacacccttgccatcaagaactacagggcattgatgataacggtaacttagtttccagcccaatattctctcctacaacccagaaccacatatcctccattttcacctagacagtctctgcatggcttgaatgcgatgtctaaaattgaacccataaacttataagcctaatgtcttcttatatactcctgatctcagtgaacagcaacaccattgccgtaccaaacctgaaatgtttgagggatcccaggctagttcccccaatctcatttgaaatatctttcccggccgggcgcggtggctcacgcctgtaatcccagcaccttgggaggctgaggtaggcaaatcacgaaggtcaggagatagagaccatcctggctaacatggtgaaactccgtctctactaaaaatacaaaaaattagccaggcgtggtggcaggcgcctgtagtcccagctactcaggaggctgaggcaggagaatggcatgaacccgggaggcggaggttgcagtgagcagagatcgcgccactgcactccaacctgggtgacagagagagactccgtctcaaaaaaaaaaaagaaaaaagaattatctttccctccattctctcttttttatatcatacgctctggaaatactgagctctagtctacgtggctccccaagcatgccatgctttttcacgccactaaatcttttcgtatacagtttcctctccctggaataccaccgttcagtcgtctcccttgtacacccaactcgttttttctttttctttttttcttttttttttttgagacagagtctcgttctgccacccagggtggagtgcagtggtggaatctcagctcactgcaacttctgcctcccaaattcaagcgattctcctgcctcagccccccgagtagctgggattacaggtgggcaccaccacgcctagctacccaactcacttttctaatctcagtcccaaatgttacctccacacaaacacattcccagaattaagttcacctcctctacgtctctgtatttgcattaccaaattactaaaatatataaattacttgtttcagtccccatgagaccattgcttccctaacgacaggcacctgaatgttcaattcagacagcctggcatatcagacactggttgttgacaccttcatagtcttctcagcctgttacagtcaatctaatgttagttacaattgagctacattaatttattcttaaatatacatttccagatacacttaaccaaagatccaagcaattttagaactagactgatcctcagatcatctcatagctgaaccacatgaatttataaaggggaaatctaaggggcaaaaagatactggaggcaatcacattcttcatcttctccagaagattactgttgctgagacctacagtaaaatttccaagaacttcaacaacccaaatagtaaaacccacccaatagtcccataggctgttcttttggataaacacagaaactgacctttctggtcttaaagcgtaatacaagtatgttttatctaagttccttcctcagcaaaggaccctcaagcctccaaaaaaaaattaacaataaattccctctctctctctctcaaagaactgaaggccaggcacagtggctcatgcctgtaatcccagcactttgggaggcccacgtgggcggatcatttgaggtcaggagttcaagaccggcctggccaagatggtgaaacaccaactctactaaaaatacaaaaattagcctggcgtggtggcagatgcctgtaatcccagctactcgggaggctgaggcaggagaatcgcttcaacccgggagctgcaggttgcagtgagccgagatcacaccactgcactccaagctgggagacagagcaagactccgtctcaaaaaaaaaagtataaaaagacggatgaatagggagaccacagagagccatctatgtgcgtggggctccacctcaaagaaagaaaaaaaaaaaactgaaactcaccaaatcaccacatccagacaatgacactttggatccctcattcatcatgattgcttccttgcccctccctagttcctattttcttacacactgttacatttcttccctgctatatcaagctctggttttagtctgggagatggatttgagactgagctcccatctccttgctgcagcatccaattaaagccttcttcctcggtaatacttgttctttcagtgattggcttttttttttttccttgaagacaaagtctcactctgtcgcccaagctggatggcgcaatctcggctcactataacctccgcctcccaggttcaagcatttctcctgcctcagcctccgggatagctgggattacaagcacccgccaccacgcctgacaaatttttgtatttttagtagagacgggggtttcaccatgttggctaggctggtctcaaactgacctcaagtgatccacccgcctcagcctcccaaagtgctgggagtataagcatgagccacagcacccagccagtgattggctttccttgtggagagcagcaggacctagaccaaacccctggcattttggtaacagtaggacatttcaatcttattttaaatcagcttttaaaatgctattttcttttatctccaatcaattcaaattatccttattaatcaactttcttgattgaaacaactaatcatctggggcatgatactcttcttattcatcccctttatacatccctcaaagccaacaattcactgtgatttcccccattcattctcttgcatccaacctacagatcttcctcataactcttttattcttgtttttactcacaccttaaaagatactcaaactccttatgaagatgaacagtttttaactcttcagttaatggcctaggagctctaatgcttcacctgtctacgttgtaacacactgtaagtttaaggctcccagaccactaactaagggctatcagtacagcactaagccaagcccctggaaccctgatgaggagtagcagattaccagtaactctactcaaaatgatgtcccatggggtggtgcttcaaagatacagacatcctaggagaaaaacggagccgccctgaatcaacctagaatcctaggagtgaggggaacataagaacacacagaagctgtgggcatgatatgctcctttgtcattcagatcactaaacctgggcatgaggaccctgacttttgtcaagtggaaatttaaaaagacataataactgggcagattattctacctaaataattagagctacatcctttttcaatgggaatcattctggcaaatttaataaacttcctttcacttgccaaattctttacataatcatccacaaacttaattttgtttggggtgtacatgaggaggatatatatatattttttttttttagagggacagagtcttgctctgtcaccgaagctggagtgcagtggtgcaacgatagctcactgggatctcaaactcctgggctcaagcaatcctctacctcagcctcctgagtagttacaactacagatgcacaccactatgcttggctaatttttttttttggtagagacagggtctcgctatgttgccgaggctggtcttgaactcctgggctcaaccgatcctcccaccttggccccctcaaagtgccaggattgaaggcatgagccaccacttctggcccataaggaagatttttaaaaattaattcgtgccttacatttatctggagccactttagactatgacaaacaaatgcagctggtcaaggtggctcacacatgtaatcccaacaattaaggagcccaaggcagaaggaccgcttaagcccaagagttcaagaccagcctgggcaacatagtgagacttcatctcttaaaaaaaaaaaaaaaattaggtaagcatggtgacatgcacgtgtggttcagctacttaggaggctgagatggcaggatcacttgggcccaagaggttgaagctgcagtttaccaagactgcaccactgcactccactctgggcaacagagcaagaatctgtctgaaaagaaaagaaacaaatacgtgttaaggttgcctgaaatgacagggaatactgcaagaatatacctagaagttaagaggaaaatgcctcagcaggcttcaaaaccacacgcttcttcagaagtcagagcagctcccaaatcaatatttccaggtgttcagtgggatggttctccaccttaatgctccactattctagggtttcaacacctctcccatcctaactctacttctcctgccactaccaattaactgcttcttctctctatttcacatgtttacacattctactgcctcaggatacacgcttatggagcccttcttggtgtctccaacttattattattattttttttttgagacagagtctcactctgtcgcccaggctggagtgcagtggcgtgatctccgctcactgcaagctccgcctcccgggttcacaccagtctcctgtctcagcctcccgagtagctgggactacaggcgcccactaccacgtccggctaattttttgtatttttaggagagatggtgtttcactgtgttagccgggatggtcttgatctcctgacctcatgatccacccagctcagcctcccaaagtgctgggattacaggcgtgagccactgcgcccggcccaacttggtatttttaagagacttctcgctgaaatgcaaaaggcccgcaaaggcttttctggctcaggtgccaatttctaatactgctatctgaagccaagtattgaggtcctgattcaaaactgactgactcataagtgaatgttcacaaaggtgcaagaataaagcaattcctctgcgtaatctaggagggtggatgattaactgaccaacatctgctaaggccagtctagccttaaaagggagtccctgttatcccagtgttcattactgaagtcctctgttatgagaattcacagaaaagcagaaattctgcaaaacataaaaatcatcattggtaaactgaacattcaaaaaactatccccaattatcactaacttttatccccacccatcaaaatcctttgtcactctctcattaataatcacacagtctaacaattcaataaaatacaaatctagagccaagtgaaaacttaaaatctgcaaaggatgaaaaaagtgacaaagttgacagaaaatactaaagaaattctagaaagccaggcaaaatcaatgataaatgaggatagaggagcaggttatgaggtttgtaaatgaagagaaaaatcaacaaggacaataacatgctaagtggctcaagaataattatttgaggccaggcgcggtggggctcatgcctgcaatcccagcactttgggaggctgaggcaggcagatcacttgagatcaggaattcgaaaccagcctggccaacaaggtgaaaacccgtctctattaaaaatacaaaaattaaccaggtgtggtggagcatgcctataatcccagctactcaggaggctgaggcaggagaatagcttgaacccggaggcagaggttgcagtgagctgagatcacgctactgcactccagcctgggcgacacagcgagattctgtctcaaaaaaaaaaaaaaaaagataattatttgattattagagaatacataacaaagcccttaaacaatttgcaaaaatgaggctgggcgcagtggctcacaactgtaatcccagcactttgggaggccaaggctggtggatgacctgaggtccgcagttcgagaccagcctggccaacacggtgaaccccatctctaataaaaatacaaaaaaaaaaaaaaaaaaatagccgggagtggtggcatgtgcctgtagtctgagctacttgggaagctgaggcaggagaatcgtttggacctgggaggcagaggttgtggtgagctgagactgtaccactgcacaccagcctgggcgacagagccagactccgtgaagaaggaaagaaaaagaagaaaggaaagaggaaaggggaaagggggaaaaggaaaggggaaaaggggaaggcagaaggcggaaggggaaaggagaaaggggaaggcgaaggaaaggagagagagaaagaaaaagaagaaaaaagtaatttgtaaaaatgctcttcattatggctgcattataacctaaaagatgtccaatcatgttattatacaacttagtatggaaatgcacaccaaaaacaatcaacacttggtataatctttgttcattctaaaaataagtacatattttctattacaatttaagatttttaaataaaataggcttactttcagattgtgatttcatttttcaagatgaagtcccagttccacccccttccttaaacgtagcctttgccagtaccagctttcccctgctgcaattccaaagcaagatcatttgtgctcctgaacacagtgcccacagactatgtcatgttcgctccaaactttacagtgggggtgccagagggcgggcggcggggggaggagggagcggtgttggcgcaggcagaagagaatgaagaaggaaaaggaggtagtctcaggctggttaggtttctgatttagatagctgctgctactacttatgagaaactctgtttgagagaaaatgtttttctgtcacttttaaaattattattccaagcaaaatttataacccaagagaaatactagttcaaaaggaaaggggtttgctgctgatttctaagttctggcaagaaaagtgagtcattctctccaaaagtgggatccctattccccctacccccaggagggtgtgaacaaaagccaacaagcaagaagacagagaggaagctcagaccacccagcctaaaggctgcatggatacactaaaacctcacagttcaccagaactgtttgttaccagtgtttcggtataaaatttgagaactaaatacaacaatgtattaaataaatttctaattttattagcctcacaattactcccgttagcaatgaaatgtggtgaaaccaatctctgaaaactatctaaaggtttctcactatgacaaagtatcattaatagttaatccagcccctcaacagaacaaagcctcttttaccctgactctgtcaagtagacagtagaagtaacacaagttcttagataactgtgagctgttaccaaactcaaggtgaaacccaatgctgtgttcagcaggaggccaagttttaaagcttttcctgcattattcttaatatatgaatatcatttattttactgataaaatacataaattttacagattatatcatagagtaatattcagaaaaaataagtatttttataatcttaagagacagttttttcataccagatattaacagacaactgaaactacttggttcactgatattgggatgtacaaagtcaaaaattaagctgagcgcagtggctcacgcctgtaccccagtactttgggaggctgaagtgggcagattgcttcaggtcagaagttcgaaaccagcctggataatatggtgaaactccatctctactaaaaatacaaaaattagccgggtgtggtggtgcacacctgtcatcccagctactggagaggctgaggcacaagaatcgcttgaacctgggaggcagaggttgcagtgagagcgaagactgagatcacaccactgcatgccatcctgggtgacagagtgagactgtcttcaaaaaaaaaaaaaagtcaaaaattaagatgttattatttattttattattatttgcaatttttgcatacaaacaactgtgaattcaccaaggcaatgaatgcctgatttctaacttctttggtaagccaacacccactcaaatcatctcaaaaacaaacttcattatgttaagaggtggtaaaatgattgtgggaggctatttacatgtataagaaaacaagtcattaaaaaaaagggggggggggccgggcacagtggctcacccctgtaatcctagcactttgggaggccgaggcgggtggatcacgaggtcaggagatcaagaccatccaggctaacacagtgaaaccccgtctctactaaaaatacaaaaaattagccgggcgtggtggcgggcacctgtagtcccagctactcaggaggctgacgcaggagaatggcgtgaacccaggaggcagagtttgcagtgagccgagatagcgccactgcactccagcctgggcgacagagcgaagactccatctcaaaaaaaaaaaaaaaaaaaaaaaaaaaaaaaaaaaaaaccttgtttataaggcataagagttagtgcccctaactctcaacttacattaactttcaacccatttcttccttcttttttttctttttgttgttgtatttgttgtttggtttttcccccgctttttctgagacaggagtctctctaggtcgcccaggctggagtatagtagcgcgatctcagctcactgcaacctccacctcccaggttcaagtgattctcctgtctcagcctcccgagtagctgggattacaggcactgaccatcacgcccagctaatttttgtatttttagtagagatgggtttcaccatgttagctgggctggtctcaaactcctgacctcaagtgatctatccacctcggccgcccaaagtgctgggattacaagcatgagcaaccacgcctggcctcctaactttcaactgcaaaaaccgcaattacatttgcaccaacctaataatttccatttaacatgcatagaaactaaaagttaaatttgctcaagactccagcgctacccaccagttgcagtggcacatgcctgcagtcctagctacgtggagactgaggcaggaggatcacttgagccttgaagtttaaggatataatgcactatcatcacacctgtggatagtcactgcactccaccctcagcaacacactgagaccctgttgctaaggtaaaaaaaaaaaaaagatcccaaagctaaacagtttcacttacaaaagcagcaaaaagaataaaatatttacaaataaattcaaccaaggaagtacaaggcttgtacactgaaaactatagaacactgttgaaagaaatgaaagacctgaataaatggaaagatatcctgtgttcgtggatgggaagatttaatattgttaagatggcaatattccccaaattaatccacaaattcaacataatcccccgataaaaattccaactgccttttttgcagacacaaacaagctgatcatcaaattcatgtagaaatgcaaggtacaatgaatagccaaaacaatcttgaaaaaagaaaaagttggaggactcacacttcgtagtcagttttggcttcaaaactgactacacaaagctataggaatgaaaagtgtgaggaaagaggcctaagggtggacatttaaatcaatgaaagataacggaaagtccagaaataaaccctcacattacaatcaagtgatttttcaacagggtgccaagaccatctaatgggaaaagaatactctcttcagcaaatggtgatagacaactggatattcacatgcaggagaatgaagccagagttccccttcacaccatatacaaaaatcagttcaaaatggatcaaacagctaaatataaaggctaaaactattaaactcttagaagaagacatagaaatgaatcttcataaccttagaagaggctacagtttcttaggtatgacatgaaaagcacaaggaataaaagaatagataaataaacttaacatcataaaaattaaaaacatttgtgcattaaaagacattatcaaagggccaggggcagaggctcatacctgtaatctctgtgcattgggaggccaaggtgggcggatcacttgaggcaagcctgcccaacatggcaaaaccctgtctctattaaaaatacaaaaattagccaggtttagtggtaaacatctgtaatcccagctactcgggggactgaggcatgagaatcacttgaacctgggaagcggaggttgcagtgagccgagattgtgccactgcattccagcctgggcaacagagtgagactctgtctcaaaaaataaaatacattaaattataaaataaaataaaatgcattatcaagaaagtaaaaagaaaacccacaagatgggagaaaatatttgtaaatcacgtaactgataaaaaaaaaaactagcatccagaatatataaagaactcttaacaatcaatttaaaaacccaacaacccaatgataaagtgggcaagggatttaaatatacatgtgccaaaagaagaaaaacaagtagctaataagcacacaaaaagatgctccacatcatttgtcatcacacagaaatgcaaatcaaagtaacagtgaaataccacttcacaaccaagagggctataatcgaaaagacagataatacctattattggtgaggagacagagaatttcgagacttcaggcatggctggtgggaaagttaaatggtgcagctttggaaacacgctggcaattcttacaagagttacagagttaccatatgacccaacaattctcctcctaggtatatacccaagggaaataaaacatatattcttactcttcacacaaaaacttgtacacaaatgttcacagcagcattactcataataatcaaaaagtgggaactcatatgtccatcaattgaggaatgttaaataaaatgtggtatatacatatgtaaaagaaagagtactaatacatgctaccgtatggctgaacgctgaaaacattatgctaagtgaaagaagccaggcacataacaaatattatatgatttcatgtgtgtaaattgtccagaatagagaaatccatcaacacagaaagtagattagtgattgcgggtagggcagggtgggaatgaggagtgtttgctaacacaaagaggttctctttgaggtgatgaaaatgttctagaattatgtaatagtggtagtttcaaaatattgtgaatatgctaaaagctattaaattgtacactttaaaatgattaaaaccgaggcaggcaagtcgtttgagcccaggagttcgagaccagcctaggtaacatggtgagacaccgtttctacaaaaaatacaaaaaaaaaactagccaggagtggtggtgtacgcctgtggtcccagctactcaagagactgaagtggaggctgagcccagaaagtcaacgctatagtgagccgtgatggtgccactgcacttcaacctgggagacaggctgggagacagggaccctgtctcaaaacaaacaaacaaacaaaaaatgattacaatgctgacaagttacttgggcgttttttgtttgttttttttgtttgtttgttttttaaagaaaaactgcagagctagtatgtaactaagccaggataagaaaccggggcggtctaacaccaaagcctaaatccacagctgtgctgccgagcatgaaaggagatagttatcaatctgaccagggaaagggagtggtcatcaaggtcatttgggcttggttataaaggtcagaatgactttgccaagtgaagaaattaacactgggcccactccaaacagaaaaaaatggtacatgcaaagctacagagaacctctcgtgtacgccatcttagtggttttggtggctggcatgacttaagcaggtactggtaagaaatgaagccagagataatggcagagctgttcccagaacaccttctgtgccatacaaagaaatcctacttttaagtatggcagaaacataaccaactatacagtcaaatttaaagattcaacaggtgattgagatttaaaagcaaaattaaaaaatcttatatcatgctgggggaaaaatattaaacttcatggagctatttataaggcttgtcaattcaccacaattcattttgtgtctgtactcccacacagtacccctcaggagctttgccaattatcacttctctcatttgtaaatcctaaaattctcacctcgagcatcagtagtcccttatttctacaaaaatatctttcactgcagcaagtaatagtaaaatctactttcaagactttggtgctttatacaatattatgaagtaccacaaacacttcagccaaatgggctgggtctactttattcctgtcttgctgtttgtgaggtttcccacataggcaccaactaaaaatctaaactcgttcttcaatttaataagcaagaatcaacatacagggtcttaaacacagcaaggacatacaagagtcttagctttgttataataaagttaccctgagtcaatattccaggatccaagttcttcatttttatcagctttggccatgtactgagttgctggtttccaatcacactgaaacagtattttggccaggtgctgtggctccagcctgtaatcccagcactttggaagcccgaggcaggaggattgcttgagcccaggagttccagaccagcctgggcaacatagcgaaaccctatctctacaaaaaaatcaaaaattagctgggtgtggtgatgcacgcctataatcccagctactcgggaggctgaggtgggaggattgaatgagctggaaggcagaggttacagcaagccaacatcgtaccactgcactctaaactgggcaacagagtgagaccccgtctccaaaaaaaaaaaaaaaaaaaaaaggaaaaggaaaagaaaaaagaaacagcattttaagcatgaaacagtgcttgacattaaaatatcaggataataattgtatttcaaataaattatatgtggtttagatatttgtccacttcaaatctcctgctgaaatgtaatccccagttttggaggtggggcctgctgggaggtgtttggatcacggggactgggatggatcccgcatgaatggcttagcattgttcccttggtgacaagtgagttcacatgagatctgattgtttaaaagtatctggcacttactcccgctctctcttgctccagctcttaccacgcaacccatctaaccacctgctctccctttgccttcaccatgattgtaaggttcctgtggcctcaccagaagcagatgctggacccatgcttgtaaagcctgcagaaccgcgagccaattaaacctcttttctttaaaaattacccagcctcaggtattccgttatagcaatgcaagaactgcctaatacaaagtagaaacagaaacaacaagcattttacaccagttacaatgtatcagacatgcatctatttgctttacatataataattctgttgatactcccatatccctgtaagataaatactatcgcattatcttcattttacaggaaaactgaggtacaaaaaggctaagcaatttgtcaaagatcacagagccactgtggtagagggaaaatctgtaccaagacagtctgtacatagggtttgggttctaagccactatgttctatgcatctccactttcaaatgtcctcaaatttttcaatgacattcctttacattcataatatttgtaaaagctatgatgcaaacctacaaatccagtcgtattcagacttcaagtttataatcttgctgctccatccctctacaaataatttcttttgtcctctctgctaatcttaaaacaattatttattagatttactatgctaagtgtttggagggtaaaagtcattaacatattaactgtccataaagaagatcaaaattttttgctatatttgaccgtagtttatgaggtaaactacatttaagttaagcgctgggtaatttgggcattctaagacagtctcagaatgcatcctctgtatttaattttactcttcatgctaaaggacagctgtactgatttacagaccaacgaaatcactctctgggggtggtaacacctaaaaagttccataagcaattctgatgcacagccagtattgagatcactggttttacttacactggcactccctaactaaaatgacaatattgcaaatgcataattcattttacaaacaattagtcaatcatgccaaacactattctacttattgatttaaatatgaagaatgctggctatgtatgctccagcaattcctctcccaaatctaccctagaaagacatttacacgtggcctaggagaatcacacaaagatgtttgtcacattgctgtatgcaacagcaagtaatgaatagccgtgcaactgtcagatgaactatggtacattcataatatacagcatttgaaaaggatgcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccaccactgcactccagcctgggcgacagagcgagactccgtctaaaaaaaaaaaaaaaaaaaaaaaaagaagaaaaggatgcagaagatccacatgtactgataaacatatccaaaacataactctcacaaagtagcttgtagaatacccagaatatactatcattgttatagatatttcacaggtacatatacatgtgtatatacatgtaaaatatattcttaaataactaggaaatggctgggtgcagtggctcacgcctgtaatccccacactttgggaggctgaggaggggagatcacttgaggtcaggagttcaagaccagcttggccaaatgacaaaaccccgtctctgttaaaaatataaaaatttgccaggtgtggtggcacatgcctgcaatcccagctacttgggaggctgaggtaggagaatcgcttgaacccaggaggtggaggttgtggtgagctgagatcacaccactgcactctagcctggatgacacagtgagactccatctcaaaaaataaaaataaaaaataactataaaatgatattccttattctggggatggagtgtagaaagaggaaacataggcaggaagatctacctttatttgcactttaattttttacagatattatttgtgtaactaaaatgtatattttaaataatcttgtcttaccaaaggatgccccatttaaaatacatgccttttgtggttatatggctttcaaatgggtactacacaaaaacactgccatcacaccattataaatagcctccaaaatgccaattttcacttttaaataaaattcacactttaatcaaggtcaaagcaatgctctgttgggattctgagagtgttatattaaaggaaaaaaataacaactaaattcttctcacactattctatcatttaaaaaggaagtcttatggaagttgtacaactggcattctaaagagactagcgttaaaaacttaaattcagtctgtcccttctatttccacccatagtaggatcttacaacataacaaaattgctaaaataaatcactgaacttaaaataaataaataagtaagtaaacaaacaaacaaggccaggtggggtggctcatgcctgtaatcccagcactttgggaggtagggcgggtggatcacgaaatcaggagtttgagatcagcctggccaacacagtgaaccctatctctactaaaaatataaaaaattagctgggcgtggtggcgggcacctgtaatctcagctacttgggaggctgagccaggagaatcacttgaacccgggaggcggaggttgcagtgagccaagaatgcgccattgcactccagcccgagcgacagtgcaaagtgcaagactccatctcaaataaacaacaacaaaaaaaatatataaaaacatattaattaagcagcccaaaaaataacaagtttctactgcgaaatgggtggagtatgcttacagaagatactgctgttagaaacagagaatcacatgataaaaatataggataaaaactccaagtctataagtagagccatcctcccagatgctcttctcctggaccatgcagaggaggaagacatgtgctaaagaaactggagccaaatgtctagacactgacttaggaagctgctgcgtaccacaaaagggctaccacaataaagaggtaagtataaaatctctcaataacgaagctttcagaaattctagttttcctttttttaaaaaataacttccagccaggtgcggaggctcacgcctgtaatctcagcactttgggaagccgaggcaggcagatcacaaggtcaggagatcgagaccgtcttggctaacatggtgaaaccccatctctacttaaagcacaaaaaaaaaaaaaaaaaaaaaaaattagccgggcatggtggcaggagactgtagtcccagctacttgggaggctgaggcaggagactggcgtgaacccaggaggtggagcttgcagtgagccgagatggcgccactgcactccagcctgggcgacagaacaagactctgtctcaaaaaaaataaataaaaaaaaaataaaaaataacttccttccagtcacatcattatgtaataacaaaatcactctcagtgtatacttaaaaataaagacatacctccaggatatcacaggttcaattccagaccacctcaataaagaaagtcacacaaattttttggtttcccagtgcatatacaagttctgtttatatgataccatagactattaagtgtgcggcagcactctgggaagctgcggcaggaggatctcttgagcccaggaattcaaagccagtctgagcaacatagcaagacctatcattaaagtgatcataaaaatataaattattcacactaattattcactggttgatattctatccatacccaacattcagactttctccatatcagcaataagggtgttttgctttcttatcatttgtgttcactgaagtaacactttaaatttccgtcaaaaatttttcctttgcattcatacttgtctaattgtttgtcataagaggtctagctttcctccttctcagcctctgacatgccttcctcactaagcttaatcatttcttacttttgatttaaagtgtgagatgtgtaactcttcctttcacttaaatactcacagaacattgtaggattatgaattagcttaatttcaatactgttgtgtcgcaggaagtaggaaggccaaagaggagggagagagacagagtacaggtcagtggagcagtcagaacacacacagcatgtatcaactaaactcactgtcttatatgagcacagttcttagaaccccaaaacaattaccatattatcagcaacgatcactcatcacagatcactataatcacagatatacaatgaaaacttctgaaatacttcaagaattaccaaactaacacagagacacaggctcttcaaaaaaaaaaaaaaaatggcacaaacagatttgcaagatgtagttgtcacaaaatttccatttgtattaaaaaaaaaacagcctggacaacatggtgcaagcctgtttctataaaacaaacaaacaaacaaaaaatatatataaaaaattagccaggcatggtggcacacacctgtggtcccagctactacccagaaggctgaggtaggaggatcacttgagcccaggaggcggagttcacagtgagcggagactgcgccactgcactcaggtgtggatgacagagcaagaccttgtctcaaaaaaacaaacaaaaacaaaaaccacaatattagcaaagtgcaacaaaatgaagtataggtcgggccacatctgtaagtccaccattttgggaggctgaggtggaaggattatttgaggccaggagatccagaccagcttgggtaacacacgcagactctgtctcaacaaaaaatacaaaatgtagccaaatgtggtggcacacgtctatactaccagctatgaaatttagaatgactttgccaaatgaagaaatgaaggccgggcgcggtggctcacgcctgtaatcccagcactttgggaggccgaggcgggtggatcatgaggtcagaagatcgagaccatcctggctaacaaggtgaaaccccgtctctactaaaaatacaaaaaattggccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaagaaatgaagactgggaccattctaaacaaaaaatggcacatccaaagctacagagaacctatcatgtgcaccatctgagtggttttggtggctggcaggacttaagtcggtactggtaagaaatgaagccagagatgatggcaggggcctgttcccagagcactttctgggccatacaaagatatgtcacttttaagtagggcagaaataaaatgaggtatgcctgtacttgccaaagtattttcactcacctaaagtgcccaactttttccttattctaaagcctaactctgtctgacatttggactgagactactttctttaaagacagagggaaggccggacacagtggctcacacctgtaatcccagcactttgtgaggctgggcacagtggctcacacctgtaatcccagcactttgtgaggccgaggcaggtggatcacttgagttcaggagtttgagaccagcctggccaatatggtgaaaccccatctctactaaaaacacaaaaaattagccgggcatggtggcgcacgcctatagtcccagctactcgggaagctgaggcacaagaattgcttgaacccagggggcagaggctgcactgagccaagatggcaccactgcactccagcctgggcaacagaacgagattttttttcagggggagggggtctcaaataaataaaataaaggcagagaaaataaaaaacatacagaaagtaaagcgagaggaaaaattaacagcatgaatataaagaaaaaatatctctacttgtggtagcattccatttctcaagttagggattgactattttattattctttatgcttataatttcctgtattaaatacatttaaaaattcacaattttcaaatattttaaacagaagaataactgaaagatgtgccaaagcaaaatggaatgctgtttatcccaaaatgatggcctagtcacctcctagttttcccgttgctctcacgtgttcccttccatatttccttctctgaaatacacatgagcctcagctaccaacacttcaaggaatcaatgattcttgacagtcatatgttcatgagttgaaaggttacctatcttaactttatttaagccatcctaaattgaactattcatgtctggttaaaaagtaaattaggctgggtgtggtggctcacacctgtaattcccagcactttgggaggccgaggcgggccaatcatctgaggtcaggagttcgagaccagcctggccagcatggcaaaaccccatctctacaaaatatacaaaaattatctgggtgtggcggcatatgcctgtaatcccagctactcaggaggctgaggcaagagaatcgcttaaacctgggaggcagaagttgcagtgagacgtgccactacactccagcctgggcgatagagtaagactctcaaaaaaaaaaaaaaaaaaaaaaaaaagagcataatataaagtttcttggctaactccaggcttttccttattggcactactcagatattctcagggcctctgaaacgcacctgaagatctgctacttctgcaccaatggtgccatattgggacagcgctttttgcttgctattgtttttctgttttattccttacagacagactattgccttatgttgccatctgtgtacccttctaattggctgatttgatcctgttgagaaaactataaatggtagtttcccacactgttcataaagttttccttaaaccatctatggcacttgaatgtttatgagttctacatcaggttcttataaagacagttctactcctgctctctctcttgagggttccattgccatagtacatctgcttctgtttgagcatctccttgattctttcccaagtgattagctctacaactgtagcttccaagtggaacataacagtatgccaggcttggccaggcgtggtggctcacgcctgtaatcccaacactttgggaggccaagggggaggagggaggggggcgcggatcacctgaggtcaggagttcgagaccagcttggcaaacatggcgaaaccccatctctactaaaaatacaaaaattggccgggcatggtggtggatgcctgtaatcccagctactcaagaggctgaggcaagataactgcttgaaccagggaggtggaggttgtagtgatcgcaccactgcatgagtgaaactccatctcaaaaaaagaaaaaaaaaaagtatgccaagtatgccaggctcctttatatgatggttacaacactaactgttgctttgtattatggtgacaactaccactctagaatttggcaagatgttacatatcttcatcctcataaaatcagtattaggtagatacaaatatcatttccttttttgtgggggggtgggagacagagtctttgcaaccttccccctccaccccccaccccgccccgggtttcaagtgattttcatacttcagcctcctgagtagctgggactacaggaacccaccatcacactcggctgattgttgtatttttagtagagacgggtttccaccatgttggccaggctggtctcaaactcctgacctcaggtgatctacccacctcagcctcccaaagggttgggattacaggcgtgagccaccatgcctggcctcatttccattttagaggtaagaaaaggaggtgaaaccctgcaagataagatatgtccaatgttacctagctaagtaagtaacaaacccagaactgggccccagatctttcactataagtcaatgcttttagtatctacaatgctatccccattgaactgacctaatctcttagaaattcaaattcctgaggcaaggaaagcattatcccagtttatcttttccagccaggctacaccatccacaaggttgctggactatctgtgaactgcctgcaccggggtcagggggcacacctaatccaatccctcggagtgatacaacatacaacatagccaaatcccaaagggctgccagtgggcatctctagtccatacctgtacccatgtgcccctagttcctgacaaccagaagggttaagagaatgcctggcataatcaggcccaatccccaaagttcaatgaatggaactgggaaaaagaagttccgcagtttgaacaaaagttcttttatccagtttcacagcaccctctgcaaatttctcttcgagctctactcagtattcaacattttgtattcaaatgttaggtacctattgtttaccagcactgtatttagcaaggtatgaatccaataaaattttgtcgatccagttccctaaaccgtctcttcagaggttttggtgaaaaaaaattcacagtaactgtttgttcctttaaaggctaccatcccttgtgaggtttgaaacgaagggaaagctatgcctggatctttcttttttgttgttgctgtttttttgttttgttttgttttgttttgttttgtttttttgaaatggagtctctgtgttcaggctagagtgctgtggcacaatctcagctcattgcaacctccgcctcccaggttcgagcaattctcctgctcagcttctcaagcagctgggattatagacgcgcaccaccatgcctggctaatttttctatttttagtagagacaggatttcatcatgttggccagactggtaacgaactcctgacctcaactgatctgcccaccttggcctcccaaagagctggaattacaggtgtgagccaccgcacccaacccttagtcattttctaatcctgtttttctatggctgatgcccagaatcttctctaataatatgtcttttggcaaatattagttttctttaaaaaatacaaaataggccgggagtggtggctcacacttctaatcccagcactttgggaaaccgaggcaggtggatcacctgaggtcaggagttcgagaccagcttgtccaacatggcgaaaccctgtctctactaaaaacaaaaaaaatcagccaggtgtggtggcatgcgcctgtagtcccagctactcaggaggctgaggcacgagaatcgcttgaacccaggaggcagaggctgcggtgagccaaactgcgccactgtgccccagcctgggtgacagagcgagaacccgtctcaaaaaaaaaaaaaattgaatgaaaatattttattaatatttaatatttaatctatctttacatatttatataacgttttaatatattttaatgtttgttttatgttacaaattcatataaatttacatattatataaatatttttatgtaaattaatatttcatactaattacatgaataagactatcttggatgtgttaaactaaatgcattataaaattatataaacatacaatggagtattattcagccactaaaaggaatgaagtatgacacatgctacaagatggataaaccttgaaaacattatgctaagtaaagtattgtttaactctgcttatatgtggtagcgagaataagcaaatttcattgacaaaaggtagaacagtagttaccaggggccaggaagggaaaatggggagttgctgtttaatgggtacagagtttctgtttgaaatgaaaaatttctaaaaacagtggtcacggttacaaaacaatatgaatgtacttaatgcaactgaactgcacacttcaaaaatgtggttaagatggttttatgggatatacattttaccacaatttgaaagtacactagtggctcacacaatatttctcttggataacattagacacacagggttcaggttccacaatgacagatactgaggattaagaatggctataaaagtcacctcaaattctcagtatacaggatataaacactgctagcaaatgagttcatggtttcttgaagtacttctaatgaatactacccaatttaaccccaaaaggagaaaagtgtggggttaaactgggttgctaataaatggcttgctatcatcaagcttaaaatatggaccttattttctcctactaaagaatggctctgaagagtacaagaatactttgtgcaatctcacagctgtttccataaactactccacaagtgcttttcaacaggcatcttcaaaatactcttcacaaaaacaatcagctttgtgctaagagtacttttctctataaaagacacacaattttacaaaagtaatatcatacacagagaagcaagaaagtggatgttcttttgatttctagtattcagtcctcttaatttaccaacttttctgaatcttggccttcctagcctcctaacttaggagataaatagttttgactcatatttcttaaggcaaatgaaatagttttgagcctctgaacacaaaaggaaaaaaatgtaacaaattatttccagttagtgtataagattttaaaaaaaagtctttagaaaaaagattccaaatgcatcaagcatatttcctaaaattcaaatgtataataaagtataacttagaggaattacagtgaaacaggagaggaaagaaaatacaatggaagtccactggctttacaagaactaaggaaatctgatttcaggaagccaaaggagagatggcatcataggcattcatgtatttaaatatctgaggaaagcctatgaggctattaactgacacagaagaaaaacactaatagagcttactatgtgccaggtactgttgtgggggcttactacttattagctcatttaatccacacaaaccctccatggagtagacactgtcattatcaaccctcttttacagaagagaaaactaaagcagagaggttaaatagcttggcccaaggtcatacagctagcaaatggtaaagctggaaaacaaatccaggcactccagctccagaggcaactatacatactgcctctcataatatttacagcaggttcagaataatgtgtggtggggttttaagtctcataaactaattacaaactagacactaagaatacttagtgaactcccctcacccatctactggacaatactctagggaattgtcaataacagtaactcacaggtatgataaaattctcaaactgaaataaacatgggtcaattttattaggttggtgcaaaagaaactgcattttttgcgattacttttggaatataaagtaaaaacaagctgttagaaacagcaaaccaattgccaatcaaagacctttagttttacatggtgttcaataaatacactgaatgaagtgacacagacacagatctgtggtccataaatcacagtgatcacaagtgctggaaacacaggtagaatacagctatcacgttttcactataaattgtacttaatgttaccttattgaacatttgcatatttttcaaaacacattggctttccctgatatggtggccatctggcccctcagatgtatcaacatcctacagcccatcgccttggttgttcactcctataaaagataaggcacaccgtttaccattttagacatacagaaggtccacgctacaattacctaaaaggtcttccgagattatcacaatctggcaagttctcttccccaaacctacaaagctctataaagctttaacaattaacaaaatctttgttacattaattacttttgttttattttcatctttaattaagctgtaaattttttttttttttttttttttgagacggagtcttactctgtcacccaggctggagtgcagtggcaccatctcagctcactgcaacctccacctcctgggttcaagcaattctcctgcctcagcctcccaagtagctggaattacaggcatgcgccactatgcccagctaatttttgtgtttttagtagagacgggttttcaccatgttggccaagctggtctcgaactcctgacctcgtgatctgcccacctcagcctcccaaaatgctgggatgacaggcgtgagccaccacgcctggcctgtaatttttatatacagtaatattcatctttttcatgttcagctgggtaagttttgacacagttgtgtaaccactaccacaaccaaaatatagaagagttccaacactcaaaaaattccccattgccacactacaaccaactcctctcccacctctacctcttggcaactactgatgtgtttcccagagtctgtatgcttttgagtctagcttctttcacttaacataatgcctttaaagatgcatccacttgctgcatgtattagtagtagtatattttttaactgatgagtagtattccattgttatggatgtatcagagtttgtttatccattcaccaattagggaaatttgaaaagcccacatttttcttaactgttaaaaaagaaatgctgctacaagcagttacatataggttttttttctgaacctaagtttctgtttcacttaggtaaatacccaggagtaggtcatatagtgtctgactctaagaaactgctaaattgtgagatgactgcttgagaccaggagtctgaggccagcctgggcaacacagcaagatggtatctcttacaaaaaggaaaagcaaacaaaagtatcaaataaaaaggccccataggatagcatggctcagattatactgcaaccccctgcctaaaatagttcatccccatccctcctcagctgatgcctcacgttagcagtaggagacagcagaggcacagggcccactccaacagagcccacctcccgctgtaaggagggcttcacgcagccctgcatcacaatgccagcaagagaacctgtgacagcagtctttccagggagacaatgtaggccaacgcctcatactctgttcagctcagttagcacacagtgaacccagttatccatcatcacccaaaccctctcctacatcccactttcaccaccatgaatgccctctacgttccaccagccccagaacaccctcccccatccatatgcactgaaacgttaagatctgccatgtctccagaagggctgctccttgccctaacaggactggctgcccagtgggcactcttcctcctgttggaactgagaatgagcctctgtttctctacagtcctgtgttctgcatggcctgcatggaggtggggccacacagtctcaccatcccaatctgaagactgggaagttatcttcctaaacctgcaaagctctatcaagctttaaaagttaaaatctttgctacgtcaaccacttttgttttcattttttattatgagtggagtcaggtggaagagcctgatacttccaagtaaaggatctaccttaaggcttctttcggatatcctttatcttctcattttttaaggtctaccaaaaataatctgaacctaaaaagacactaaagctaacacatatattgctagctaaggaaaattagcaaaagaaacattaagaaattaaatatattcatcttttagtctgttgtaccacagacactggagagatataacggtcccatcacctcacaagaagcataactcattttgacacaatctttagaatgtaatgggatgaggcctggtgccgtggctcacacctgtaatcccagcactttgggaggctatggcaggcagaccatctgaggtcaggagttctagaccagcctggttaacatggtgaaatcccatctctaccaaaaaatacaaaaattagccaggtgtggtggagggtgcctgtaatctcagctacctgggaggctgaggcaggagaatcgcttgaacccaggcggcgtaagttgcagtgagccgagatcgcgccactgcactccagcctgggtgacagagagagactccatctcaaaaaagaatacaaaacaaacaatacatagatctaaaatatttccaaaataaaaatcattccttccagtcacaagcatatgaagtgcccatcaaaaattaaatataataaatatttaacagagaaattctttatgcttcaacttaattcaaatgtacaaattaatttttaaaacacagtattagcaataattggccgggcatcaccatgtacagatacaatacatggcgtgcatctgtaggccccgctactcaggagggtgagacaggagaattgcttcaactcgggaggcagaggctacagtgagccaagatcacgccactgcactccagactgggcaagagacagcgagactccatctcaaaaaaaaaaaaaaaaaaaaaaaagtatatatatacatatttagaacactatgtgcacatagaaaacttgtgtgacttgtatagttatacatctgacatcatggctgggatatactaatatttcaacacaaacacaaatgtgactataaaacaaaactgattttctgccacgacttatggaaacagaagaatagccacaggaggaatgtattgtaatattttcatttgtactgtaaccattttcaaggccaaaatacaactaatggaaattaatgcacatctaagcttcatgtcagtataaaattaaaaatgacctgagtacaacctacagaatgggagaaaatttttgcaatctacccatctgacaaagggctaatatccagaatctacaaagaacttaaacaaatatacaagaaaaaaatcaaacaaccacatcaaaaagtgggcaacggatatgaacagacacttctcaaaagaagacatttatgcagctagcagacacatgaaaaaatgctcatcatcactagtcatcaaaaaaatgcaaatcaaaaccacaacgagataccatctcacaccagttagaatggcgatcattaaaatatcaagaaacaacaggtgctggagaggatgtggagaaaacaggaacacttttacactgttggtgggactgtaaactagttcaaccgtcgtggaagacagtgtggcgattcctcaaggatctagaactagaaataccatttgacccagcaatcccattactgggtatatacccaaaggattataaatcatgccactataaagacacatgcacatgtatgtttattgcggcattattcacaatagcaaagactgggaaccaacccaaatgtccatcaatgatagactggattaagaaaatgtgccacttggctgggcgcagtggctcacgcctgtaatcccagcactttgggaggccgaggcaggcggatcatgaggtcaggagatcaagaccatcctggctaacacgtgaaaccccgtctctactaaaaatacaaaaaaaaaaaaaaaaagccgcggctccgggtccgagcccacagcccaccgctggcagctgggcgctgccgaggccaggggcacgcacgattggcacctgccagtgccaagactgtgccgcccccacaaccaaggcgccaaagggggtcgccgggcctctgggccgctgccctcgctttgtcttcgttgttgcaagcaccgtccactcaggaggcgccccgcaaccggtgtgacgagtgccaacgaggaccaggagatggaactagaagcattacgctctatttatgaaggagatgaaagtttccgggaattaagttcagtttcttttcaatataggataggtgaaaatggtgatcccaaagccttcttaatagagatttcctggacagaaacatatccccaaacacctccaattctatctatgaacgctttttttttaacaacaccgtatcatcagctgtaaagcagagtatattagccaagttacaggaagcagtagaagctaatcttggaaccgctatgacctgtacattgtttgaatatgccaaagacaataagagcagttcatggagaatcacaatcccattaattccacaacatcgataagcaatatcatctcaattgaaactcctaatacagccccatcaagtaagaaaaaagacaaaaaagaataactttcaaaagcccagaagcgtaagctggcagacaaaacagatcacaaaggagaacttcctcgaggctggaactgggttgatgttgtgaagcatttaagcaaaactggctctaaggatgatgagtagcacttggaatttgagacaaggaaagagcattctttaaaaagtaaaactgggttcaaaatctttcattaccattttctggtattgaggtggctttttataaaataatttttgtatgtttcttacattaaaaaggttgtaagttgaaagttcatgaagagatccagttgtattaaattattttcacaaacttgccttaataaaaggtgaaaatgttacagtttagtatactttatgaagcctcttgagctttgtaaatggacaggcatgtggaataagaatcagtgttaatttatatgatcttatcctggtggatgtgctgtcttttaaaggagtatgaagcccttttcaaactatcatcctggtggagccaagtactcagtgaacagttactccatagtgcaatccatattaataggcttcttatcttaaataaagtcttcatctcttcttttgcttaattactgaaccgtaaattgcttcagagaaatttaaatgctggtatttgaactttatacatgatactttttctagtttcttttaatttttgaaaggtgaactgcttccctttaataaattaatatctatttatatttttctcttgatttgggtcaagatgtgtgatcatgagtgctttgagtgataggtggaacaggagaatataaaaacaaatctgctaaatacactagaaagcattttagtaagaaatgctggcccttccttaaaacatttctcttgcatataccaggatgggagtaaaagatgccttaacatttaatttctgtattgttgaagacactgattttaatgaaatcctacttttctgaagaaaaaaaaaaaattagccaggcatggtggcgggcgcctgtagtcccagctacttgggaggctgaggcaggagaatggcatgaacccaggaggcggagcttgcagcaagcctagtttgcgccgctgcactccagcctgggcgacagaacaagactccgtctcaaaaaaaaaggtgggggggagaaaatgtggcacatatacaccatggaatactatgcagccataaaaaaggatgagttcatgtcccttgtagggacatggatgaagctggaaaccaccattctgagcaaactattgcaaggacagaaaaccaaacaccgcatgttctcactcataggtgggaattgaacaatgagaacacttggacacagggcggggaacatcacacaccagggcctgtcgtggggtgggagctgggggagggacagcattaggagaaacacctaatgtaaatgatgagttaatgggtgcagcaaaccaacatggcacatacatacatatgtaacaaacctgcacgttgtgcacatgtaccctagaacttaaagtataattaaaaaaaaaatgacctgagtaaaaagtaattaacatttaattaggggtggcattaaatccacaagatttatggaaataaaagggaagagctcttaattttcatattcttatatgaaaattaattcatattactaaaagaaaattaaggaggttatggctgatgtccatcctggcagcattatacactgaaaaaaaacccagaaaactgggatttgaatcttgactctttagtatctctgatcccttaaatcaagtctcatctttcgtaaacctgtttcttcatctataaaatgatgtcaaagtaataactcaattcgtacagtttaatggttacatagtaaaaaaacaaaacacacgaatatgtggcagagggtcaaactatgtgaaaagctagtgaaaacgtttggaagaaattttcaccaagtgataaagagcagttacaacctgttcactgttttggatcttttgttaacagctgaaaaaaacagaaatattttgagaaaatcggtagagttgacttcaaaagttttcattacgacctgaaaacatgaaatttgcaatggtatactttgctgtactacaaacccaagaaaacatccatctcaaaatcacaagtgaggacaatgttaacttgtttatttgatctcaatggcactgctaatgtagcacaagaccaagagtcaattggacccattgttcaagactgctgaatgttaacaaggagttaactgtggcttagaaactagtttcatcatcctattttggctcacagtccatgagtcaaaaacaataaaccaaaagctctaacaacccagattgcctatccaggttattcaccaaactcggcacttaatgacttttagctggttccaaaaattgattctaacatcaaaggataaagatttatgaccaatgaacatattcaaatcctaaagaagaccttggggtacaatggcagcattgttggggtaagtacactacacaccatttggaagccagattcatttcaatttgaaactagtaactgtatttataaataagtctcagaccataaaccacagaaagtgcacagcagtgccaccttaaatcctttttggaacaaggcaggctatgcatgtatgcatactaaagtaaacagagttgtcttgcccaaagacttgccctgattttgtcttaactgttcatttcccattagacagtatcccgagccttacttagatgactcaaagaaaaactgataaactgaaaaacaaaatatttggtccacctttccgttttagtatcatgactacaggaatcttgaaacagatgatatatagacaatccactgtgaaaaccgcagggctgccctggccccgggctacaatcactgattgatacatgctgcctacagatgccctcagactagggacaccctcttcactaaaagaaagactaaaagccttcttagcctaaatagaagtcaaaaagcatacagctttaaaaccaaactattacacagctaaatatcctgacctaacaaagataaaaactatcctctagtctaaactttagaagcatctagaaccacagcaataaatattattcaaaatactttaggtcaagttcatattttcataggtttccatgttttctgggatttctaaaatcttggagacaacagaggatgattatttaacaaaaatcctgttgccagccaggcgctgtggctcatgcctgtaatcccagcactttgggagactgaggcaggcagatcacctgaagtcaagagttcaaggccagcctgacccacatagtgaaaccctatctccactaaaaacacaaaattagccgggtatttttacaggtggtgggcacctgtaatcccagctactggggaggctgaggcaggagaatctcttgaacccaagaggcagaggttgcagtgagccgagactgtgccacacagtctcgcacaatagagcgagactctgtcacaaaaaaaattttctgctgcctactagtttattataacagtatacaaaagaccaaggaaattgtagagaaataactttatttaaatgcatctgacagataaatctatgttcgcttcttcattcctgtgttactttaattcttctgtgtaattttggggagagtcagtgttgaattacccaacaggaaaaaaatgaagcacactgttggagaggaaaacactctttccctaccctcttagattcagtggctggggtccctgaatttaacagataaaagattaacaggagggggaaaaaaagcagtttacctatgcatgcaatgtgcatacacaaaggagaactcagtgttaactcaaaagggtgattaaaatttgggtttacacaccatcttaacaaagggtgataaagtacggggaaaaggctagactgaggaaaacaagttctggactttgagggaggtacaaatcatgggaagataactagaaatgtataataaataggggttctttagtacggaacactttcagaaatgtaaatggatagcctgcttttagacagaaaggtggagggcaggaaactaaatgccttcagcttaaaacaacacctacactaaaagtgggatattttggggtggcatgctctggtccccttctacatgcttagaaaaccaacaaaaatgaggtaccaaaagaagtaagaggatttttttttaaggcatctgatgtagtttttgaagccatgagtaacaatgagaatttttgctggtattctattagtttgcatttcagtattgtcattttccattttgctaggaagagaaaagacacaccataatcttttcagtgcactgggcttctaagaaacttaatcagaacctgacggatcatctctgaataccatagtttcagaatattaacaaaagtcataataactgtgaattatttttgcaaagtacgtatcactagaaccaagatgtttaagtagaaattttgaaacctaagagaccacatcactgtcatcttcttggtcaatacttgaaccaggcaaaaaaaaaaccaacacttcctttgaaatctcatgaaggaaagcagtgaggagtcttctacccttgaagcagcaggatgtactccacctgaacaaagaaaaaacagtcatgaagaaaaaacatgttggctaactgctatcctctcgttggcaagatgccaccttcagttggaaaagcatttaaccgaaacactcatttacaaatatctttatctgcaatccattttaatgctgtatacatctctaacttaagtggagaataacttttaaaaagaaaatgtcataaatttctcagaattaaaagtaaaacactattacaagaacatttttgtagaagaaaacaatacaaaggaggagacatggctaaatatgggggaaaaatgtttaaacacaaacttacaacttgattatagatatggagactcacacttatggaaagctgtcaagttatccacagaactctagttctgaatagagaatacaatccttttcctcttattttataactctggtgaagaaagagaccgaatagcaggcaggtgcagctaaacatgtcctggaaacacaaaggcagctcaaaaggaagatttaatttaagggtcagattttttaacatacaagaactaatgaactaccttgaagggagacttaattatgacttttcccaatactgggtgggaggggaggtaatcaaagtaattaatttttagtgctattttggtactcctactactgaaaaatttagaagtacaaatgccattccatctgctgtggtggatacaaagaggcttttcttcaagcaagaaagctttattattaaaaaagaagaagaaaaattctatgacgtttttaaaaggataaacatacgataacccaaaaagaagtatagagaaccaatgtgtaataagtaagtgttttgctctagaacttagtctgttaagctggtgaacagaatcactgaccagcaggagagaaaagccggcttgcaccctcacagcccttgctggcagtgccatccatttgtcatctgacatgtgctctctcttattttttccaaacattattaaactctcacctttaaaaacacttctggagaaaaattaacaaagatatacctctacaaaatcctgactacaatgccccacagctgttaaaaaatattagtaaatatgacttcctacagaatccaggtaagtttatgttaaaagtgtataagtggtaagactgtgggtggggttttttcccccttatttccacatttttgaatttcctaagtttaactttaagtatatattttataatcagaaataacatacgctttatcttttataatcatcatagtaacttaacagtgaagtgggatatacaatggtgatgaacagtatgagctttggtacattacttggactcaaaagatagctcctgaaattcaaattactttctatctctaattctggattccatcatgtatctcctaagattgtggtgaggttaacacaaaataacatatgcgaaagtatttttgcaaagtgcttggcaaaatgggagaacttagtaatattaactgatagctttactactatagttatgggttcgtcacccaaatataccccaaaattagcagtttagtgttagagtttttgctgctctacctggaggtcctaacagtttacattgttttcatggaaaagtttgcactaaggggaatttcaaaaacatgctggaaacaaactctgaccttattttgccaacaaccaactgtaaaacagactgagttggcacctgaatatttcttctgctctcccttctcttatgctacctcccaagcattgaaaagattatgttctctgagcactctagaaaacccattcttgagcaggctggatgtgtttatgtgcaaaaatgttcaggcagttgttatttataaaaattggaaagccctgtatattagaactcttatttagggcaaccaacagagggaggggatttccttaaagaatgatgggcatgtactcattttcatataattgtatggactttaatataaccttcattctcatgactaccaagaaactataatccaaaattcttatggtagtactacttttccaattggcaagaccacttctgcagttcctaaagcacccgacacctaaagctttaatgtatcacaaggtggaaagtggtttctgcttattcaactaaagattcttttcctacagagagctatgagactattttaccattttgtctaattcaatctacatagtagcttattaagaggatattgtcagccacagtatcacagtttcataattaacataagtacttagattacttaaaactccacgaaaactaaacaggatttctctctctgtaatctttcatcctggttggagccgtcatcatttctggcccctactaggtctcctacccctcatactttcctaatcctcaacccacaccactgcagaatcctgcttagggcccttcagtgctgcttcatttcctatggccccagtcctttgcttcgatgtgcttgtgatcactcccctataaaaatacagtgggagttatggaccataatgtctccaaaaaaagtgcacacaaactttgcatacactcacaagaatactatttacttaatgctcttaaaattccaaacataagcaacaaaactcaatctttaatttcaaaaaggaattaaaaacttcttcaggcaagtctataaatatttgctgaaggttacaagaaaaaaaaaaaagctcattttacctaaaagaaaaaaaatacattaaaagtacagacaatatgtccatttttctttaaggaatctacaaacttcagaatgataaactttcccagtcactaaacatttcattttatgggagccttcatcattaaagtatcctaggatagttattcagctaaaggccttgaaaattcaattcatcagcattttgtgtatattttagcatatacatgtgtatctacacatacacatgagtatctgcattaaggctctatccttaattagccattcagaaagccagaactgcaaaaacatgccagaaaccagaaccccatcttttacaaaaacaccaatctgtggcaaaccaccaaaaatacctagtgaacaactatcatgaaagcatgctgacccagagtggccaaatagtcacattttttttcagactatggaaaccatagagactttcatgtaaaatatctccaattttaaagcactgtcaaccacatgatcacatctacagaagtgatccagcccacatccaccagtttgcctcctgtgacattatagatcttacttatccattctgcagacagatactggtgccaaccctgggccacacactctgttacacaagcataaacaagaagtctcagtttatgtccctgaggggctcataagccagtagaggagaaaaaaatcacacagacataatgccataagcactgtggtctgcacaatgacagaggtaggcaaaggaactcctcacgcatgggggagaaggagtcagggaaatcctccctctgggggtgagatctgatatgagtcctagtaggtctaagccaaacagaaaggaaaacacagaggcgccaggctgcagcagagaaaacatggaacacaaaggtgtaaggctagggagatgagcctgggaggaatactgctgagtctaagaccccatgaggtactggaaaggggaacagctgaaccaactgaagttcagggaacagggagagactgaagacaaacataggtagcagataaaaccataataatggatcacacatcagtgcacagaacgcagcaaggctagtaaatgcattcagaattgtaatattttagtaaaatgttctctttactaaagaaatattaaatgtaaaaaatatgaaaaaataggctgggcgtggtggctcacctgagctcaggagttcaagaccagcctgggcaacatggcaaaactccatgtctaccaaaaatataaaactttagcagggcatggtggcacactcctgtagttccagctactcgagagactaaggagagaggattgtttgagcctaggaggcagaggttgtagaagccgagatcgcgccactgcactccagcccgggttaacatagtgagaccttgtctcaaaataaataaataaataaataaataaaatgaaagtcacatacaaagaagaaaattttggatcacccataatcctacactactgctatatatttattttccatctagaactctccaatgacattcttttccccaatctttattctacttatttttcctttgatcctagtttttggcatatctattataagtctactcaaactttttgtggaatgaaatggagcattaaaaaactaagttatgtctcaattttaaaagccaaatccacccttccacaaatacacaatattaacgtcaattgcttcagactttttacaccctttccatcagacaacccacaatctaggaggggctcggttgtgcacatagtacaaccgtccttaaccgcttagttgactaaaaactgtaataaaagtaaagagctgttttgggcatcaaaggacattaccaaaaaagtgaaaaggcaacctacagaatgaaaaaaaatatctgcacatcatatatctgataagggtcaagagtatgtaaagaactcttacaacccaccaacaaaaaaataaataacccaattaaataataagcaaataatttctttcttattttttttttgagacggagtttcactcgtctcccaggctggagtacaatggcgcgatctggacttactgcaacttccacctcctgggtttaagcaattctcctgcctcagccttctgagtaactgggactagtggcacctgccaccacgcctagctaactttttgtatttttagtagagacaggtttcaccatgttggctgggctgatcttgaactcctgacctcaggtgatctgcctgcctaggcctcccaaagtgctgggattacaggcctgagccactccacctggccaacaagcaaaggatttcaagtcatttctctaaagatataaaaatggccaaaaacacatgaaaagatgcttaacatcagtcattaggagaatgcaaataaaaaccatgaaataccacctcacacccatcaggacatctacaaacagaaatacagacaataagtgtaggcaaggatgtagaaaactggaacccttgtacgttgctggtgattatgtaaaatagctcagatggtcatcatgtaaaatagttctgacactgtgaaaaagtgtggtggttcctcaaaaactaaagcacaaaaattaatctatgacccagcaattatattcctaggtttatattcaaaagaaagaaaacaagaactcaaatctttgtgcaggaatgttggtatagttctattcataactaaaaggaagaaacaatccaaatgccatcaatgggtgagtaaacaaattgtggtacatatatacaatgtaatattattcagtcataaaagcaagtgaactttgacaaatgctacaacatggatggacactgaggacaaaaataaataaaaattaaaaataaaatgtacatgaacaaataatttcaagatgaagtactgatatatgctacaaagtagatgaaacttggctgggtgcagtggctcacgcctgtaatcccagaactttgggaggccaaggtggggggatcacaaggtcaggagttcgagaccagcctggacaatatagtgaaactacgtctctactaaaaatacaaaaattagccaggcatggtggtgcacgcctgtagtcccagctacttgggaggctgagactggagaatcgtttgaacccaggaggcggagcttgcggtgagccgagatcatgccactgcactctaacctaagcaacagagtgagactccgtcaaaaaaaaaaaaaaaaacaagcgggggtagatgaaccttgaaaacattatactatgtaaacaaagtcagacacaaatggtcattaaatatgttaaatttccagaataggtaaatttaatctcagccctgcacctcagatgcaattttaatggagcgcctgctggctgcagataaaatcgtatgtatcaacaaatataataaaacccaaacattcctgaatccataagtcacttaattcttttcatctttttggaagccagtaaatcaactattttcaatgtgctaagcaaaaggaaagaatcaagcatgcatcctgactttccctcacaaactcaacctgaagtatacaaacagttgatatgggaatatttatcttttctgtagaaatgaggtctcactatgttccccactctaggctcaaattcctggcctcaagtgatcctcccaccttggcctcccccaagtgctgggatgacaggcatgagataccacaccaggcaagaaagtttctctttacaaaatattccagaaatgaataaataaataaggaataataaaattacactatcaccatttgaaactactaatgaattaatgaatgtaggcaatggtcagtgggcaataacatcacaaaagacaagacaatcaggcattatatgcatgtaaggggaaaaaaaagttaggacttacttttgtcaaaaggtaatgatttttttttttttaaattaccaggtgcagtggctcaagcctgtaatcccagcactttggaaggccaacatgggcggattgcctgagctcaggaatttgaggccagccagcgtaacatggtaaaaccccatctctaccaaaatacaaaaaaattagcagggtgtggtgatgcgcacctgtaatcccagctactcgggcagctgaggcaggagaatcgcttgaacccggaaggcagaggttgcagtgagccaagatcacaccactgcactcccgcctgggcaacagagtgagactccatctcaaaaaaaaaaaaaaaaaaattggccaggcacagtggctcacacctgtaatcccagcactttgggaggccgaggtgggtggaatgcctgagctcaggagtttgaaaccagcctgggtaacacagtgaaaccccatctctactaaaatacaaaaaaattagccaggtgtggcgtcgtggacctgtaatcccagctacttgggaggctgagggaggagaatcccttgaaccagggaggcggaggttgcagtcagcaaagattgcaccactgcactccagcctggacaacagagcgagactctgtctcaaaaaaaagcaagagacatcatgaactgttggaggggcagcaaggtacattgtcagtgggtgtatatatcttgaactccttttcttatttaaaaagaaaaagaaaaaacattcaaatagaaaaacaagcaaagtaaaagaactggcagtatacaaatgaaaaaacaactaattaatataaaagggcaaagtcgcacctcatttatatccaaaaaaatgtaaattaaaatgacatctatttgttttaactgcattatccagggctcacaaaaattcaataacatgtattatgaacatatgaactggcaaaaccagttgggcgtggtggttcacacactttgggaggcgaggctggccggtaatttgaggccaggagctagagaccagcctggccaacatggtgaaaccccgtctctactaaaaatatgaaaaattaaccgggggtcatagcacatgcctgtaatccaagctacttgggaggttgagatatgaaaatcacttgaacccaggaggcagaggttacactgagctgagatcgcaccactgcactccagcctggacgacagagtaagaccctgtcttgaaaaataaactggcaaatccttcccaaagattacctgggcaacatgtttcaaaacacattttttattttttcaagacagagtcttgctctgtcacccaggctggagtgcagtggcagaatctcagctcactgcaacctctgcctcccaggttcaagcaattctgcctcagcctcctgagtagctgggactacaggtgtgcaccatcacgcccggccaatttttgtatttttggtagagacagggtttcaccatgttggccaggctggtctcaaactcctgacctcaggcgatctgcccgccttagcctcccaaagtgctgggattgcaggcgttagccaccatgcccggcccaaaacatattttgtaaatgccggctgacatagtaattggaaatctagaagttaatgttctagaaaatgaatgctcataggtgtatagcacattacatataacaaaagaaaaacctgtaaacataaatgtcgaataatgagaaattcattaagtaaattgctcaaatgtagtgaaatctcattaatcattcttacaaagtatatgtaggagaacaggaaatatgcttagaatatattcttaagcatttaaaaactcacaataaaatggtatggtgggtatctcaatttttctaataaagaaacaatttatgagctgggtgcagtggctcctgcctggaatcccagcactctgggaggctgaggcaggaagatcacttgagcacaggagttcgagaccagcctgcacaccataggggatcccacctctatttttaaaaaatagaaaacttataaaggagcctagaatgattcacaccaaaatattatcaaagccctagccactgaaagtcaagtattttttccattttatactcttctggaaatttttattttactgcaaaagacctgaattaatctaacaactgggaaaataaaatatcacacacatgccactagctaaactgactataagaattttaataatactaactctattaaaaactagtttgagatgctgggcaattcatttaagctctctggacctgtttcttaacagaaaaaaatcagaagctgaactagataagtggttttcaaactgtgaaatcatacatgtaaagtgcttaatacaagacctggcacagagtgaacactaatgcacactaacgctgtgtattactactaaccaaggacttgctgccaggcaaacatgagaattctgggcccatgactctcatttcaacctttcaaccacttggcttttatgcttcaaatattggactctggatacaatttcaattaaagaaaaggttccactgttttaaaacaacttgactagataatccctaaagtcacttataacataatatcaagctaaatattacacacgtgtgttctcattcctttggcaagtccagatatacccccaacgaacaaatattcatggtgaacaaacaataaaaatctggataagttgtatttgacatgattctaatataatgcataataaatttttgttaattctgagattctatgatggttttcctcctaaccctctttcaaagtataggtattggtcattaaaaattttctgtagttactacctgtttagtattatgaaactcccagcctttttatagaaagcaaaaaggtgtacactaaacgaaaagacatctttaggtaatttttttttttttttttttgagactgagtttcgctcttgtcacccagcctggagtgcaatggcgcgatctcggctcactgcaacctccgcctcctgggttcaagtgattctcctgcctcagcctcccaagtagctgggattacgggcacccgccatgatgcccagataatttttgtatttttagtagagactcagcctcccaaaatgctgggattacaggcgagagccaccgtgcctggccatcttgaggtaatcttaaaactgtgccttttaacttgaagaaaatacctctcaaattactgtgcattaaggcctaggaaatagcattaacttcggtagtatattcaccactcaatcaagacactctcaaggccgcttataaagcctggtatctactcacttacactactttacctccaagctaagtaagcacttcaacagcaaactagcactaacaattctaaaaaccagggagcccaccagataaactacattcctgacttgtaactctgacaatattttttccatgactttaattttacaaattagatcaaagataaacagtttatctgctgtttccatgaccatctttctaatgaggaattcctactgttctaattagaaaaggttaatgataaggttaaagataagaaactaatgcaaggacacaagagatacaaggataggacaaagttactctgacctttggattagcctcttctcactccaggatcagttacatccatgtggaggcaagcatggcctagggaagactagttcccgcccactggccatacttactaggttctatgaccttaggcaagctattctaaccctcaagacctgtttatctcatttgcaaaaaggggacaacaatatctagtgtacatgacagttatgaggcttaagtgagactgaataggaatgtcataaacatctgttccctctcccactcctttatacctgaaaatcagactctcatttgattctcttttttcctgaggggaagaagagcagccaaagcaactcccagtgttaatgtttataccttccagcagttctcaaagtgtggttcacaaaccttcagaagtctccaagatcaaacctatttccataatgattcaagacattatttgcctctttctgtgtcaacatttgcactgacgacataaaaagaatggtggattaagctgctggcatcttagcacaaatcaatgtggtggccccaagctgtactagcagtccttgcatttaactttcagttaaaaagttgccaggttcatgtaaggatgttcttgatgaagcaatgaaaaaattaatttcattaaatctcaatgttgagttgacagcgttttcatattctatgtgctaaaatgggaagtattcctgctaccaaccaaagtaaaatgcatgtctccaggaaaaacacctgtgcaatcattttatttgctttttccagcaaggcttattaacagacaagccttggttattcaaatttgggaacctgacagacatttttctcaaaagcgtatgaaatgagcttgttgctttaaagaaaatatacaagaacacaggatggggttgaatattttcttcatatatttcaacaaaaataacatatcacaacagactgaaggcagacacatatatgataatctgtcttcaattaagccagacattaaagaaattttcaaaaatgtccaacaatgtcattcttctcattagttttaaaaagtacccctttttgttgctgttgttgttgagacaggatctcattgtcatccaggctggagtgcagtcactgtagcctcaacctcccagattcaggtgatcctcccacctcagcctcacaagtagctgggactataggtgtgcaccaccactcctggctaatttttgtatttttttagtagagatggggtttcaccatgttgcccaggctgctctcgaactcctaaactcaagcaatccacccgactcagcctcagcctcataaagtgctgggattacgggcatgagccaccatgccgagccaaaagcatacattcttattttaaaatacgctattcatttttgtggttttgttttttgatacagagtctcgctctgtcacccaggcttgaatgcagtggtgtgatctcagctcactgcaaccgccgcctcctgggtacaagcgattctcctacctcagtctccaaagtagctgggattacaggcgcacgccaggtcgcccagctaatttttgtatttttagtagaggcagggtttcagcatgttggccaggctggtctcgaactcctgacctcaggtgatccgcccacctcagcctcccaaagtgctgggatgacaggcgtgagccactgcacccagcctaaaaatatgctatttgttaacatacagtaagtgtattgacaactacacgtttttaatttctgacaaagcaagtaccaattgatataaactgcattaaaaggctctttgggctcctaaataattttttagagtctgtcctaagagcaaaatgtttaagaatcagtgtttataccattaccaaattccttaatacaggctatttgggtaaacagaaatgtcactcagtactcattttatgttctttccgtcacacacttaagagcaaataacttcactgtcaatattctagcttaatcaaccttttttgaaacacgcttctcaccatcccctttgagaatatgagtaaggtaccaattctccagaaaactcttgcacactgcagaattcatgcaagttctgagtccaaggactctgtcctttggtctattccactagacactggtataaaatcctggtaatagcagcgaggtatcagtattttacatatccagtttttaaccactgtattccaaagaatagagagtcacaaatcaaatgatgacaagccgacctataaaacataatttacatgaatgagtaaaattcatgttttaaaacaaaacccaagcaatattttcaagtaaaacaagaatcacatctcagctaaaataaaaacaaatccaaaagggtgaaaattaaatctgttgcatcttttaaaactgcttaattcactcaatatttcaaaattaatttggaaatcacagctaagaaaaacatatgttcacagatctaatttctgtgaaaatgtaacacactatttttaaattctacacgttaatcaaggaatcacagtttttcatcactgcaaacgtccttttcaatatggcctgagttataatcaaaatggaataatctactaccataggttcgtttctaagaatagaagagtttaagtatacagccctccatttatggttttgtgaattttttttaacattatcaaggctaaaaattaccttcctctttgttccttctacattcttgaaagcttacttaagaaacatactggtgattaacaatttttagtttttattttcaacatccactcttaaatttaatgcacttgcggcggggggggggggggcggtggatggcagggggagaatataagcccctttaaacactttttttctagttacttttccggttaaaggaaactaaatatggcctgagaaggactccgtacttcaatatttaagtccttgtggaggatccataagctaacaggtagacaagattgaaaaacgtaactatgggtatgcgcctgtaaatacagctgagtcctggcaaattccagcagccgtactttaaccattcatacactgctgagtgttcaaactgtgttcagctaaggcaaatgctgacctgtaaccaacctgactgtttctgtacctcacttccgagttctggacatcacttccccccctttttttttttttttgtctataaatcttcttccaccacatagctgcactgcagtctctgaatctcccgtgattcttggggctgcccgactcgcgaattgttcactgctcaattaaactcctttaaatttaattcagctgaagtttttctgttaacattccaaataataacattccaaataataaaatggtctttccaccaatccactttattaaatcttcacacagttacattttctcttcaggtgcattgtctacaggttgattttgctatatatttaaggcaaataataaagcaacatctatacttttaaaaaatcagtgacacatacacacattctgtttctctcacaatcacacaaacacccacgcatatccctaacaaggtacaagaataaaccttggaagattcatattttgctcagcacctctcaccttaattcctctaatacaaaaattttaccagtttaatcatttggaagaggaaaagaggaactacatcttcaaaatggacacaatttatgtgaaacaaaatatggagaaaacttatctataaaatttcttcagtgtttttcagtttaaaaacacatcaataattaccttgagaataagttaaagtacacattttcagaaacagcaaccagtaagctcatttccacagtactcaaaaccaagaggcaaactaaatacatcttgtaaggcgacccataaaaataaaaataaaatcagtaataatttagccatttagtttcaaagttatagttataaagctaattttgcattcaagtgacaaaaccctatctaccatcaaaaaccaaactgtggccaaagaccttcatatacagcttttcctttttttaacccatttatgccgaaggttgcaaactttttttgtgaaaaatcagaccttggcaatgacctggagcaggatataaataactcccacaagcttagtgttccaataatggaacactaggcacaactgggttaatgagacaaggtcttgctctgttgcccaggctggaatggcggtgtgatcatagctcactgttgccctaaacttccaggcccatgcaatccctctgcctcagcctcctgagtaggtaggactacaggcaggtactaccacactcagctagtttttaaaatttttttgaagagacaaggtcttgctatgttgtacaggctcatctcaaactcctgaccccaagtgatcttcccacctcagcctcccaaagcgctgggattgcagatgtgagtcactgcacctggcccatatacagttcttaaaagtgaattccagataaacagatatacacatgcacagcaataacagtctgcacatgaagaccactcaatgcggaaagaacagactattcaacaaatggtgctaagacaactgggtatccacatgcagaaaaatgaggctggaccccttcctcctcgtaccttatacaaaaataaacttaaaatcgacaaacaacctacataagagctgaaatcataaaactcttagaagataacatacaggtaaatcttcatgaccttgggtatgacaacagattcttagatataacaccaaaaaagcacatacaacaaaagaaaaaactgtaaaatgaacttcaaaattaaaaacttttctgcatcaaatgacattatcaggaaaatgaaaagacaacctgcagaatggaagaaaatattaacaaatctgatagggatctagtacctggaatatatacaacaacaaaaataaactacttgattataaaatgagcgaaagattttaatagaatctctcaaataaaatatacaaaaggtcaacaagaatatgaaaagatgctcaacatcattcataaggagaatgcaaataaaaacgaggcacaacttcacacccacaaggatggctaatgataaaaagttaaaaacaacaacaacaactaacaagtactggaaaatatgtggagaaattgaaatccttgtacactgctggtgggaatataaaatggtatcttttctatgaaaactggagatttctcaaaaagttaaacatagaattaccatacaactcagcaattccactcataggtagaaacccaaaagaagtgaaaactagtacttcaaataatatgtacacccatgatcacagcagcattatccacaatagccaaaaagtgaaaacaacccaaatgtctaccaacaaatgaatggatgaacaaatcctggtgtatagatacaatgaaatactatgtagccataaaaaggaatggaatgttgggccaggcacagtggctcacagctgtaatcccaggactctgggaggccgaggcggacagatcacttgaggtcaggagttggagacccgcctggccaacatgttgtggaatcccacctctactaaaaatccaaaaattagccgggcataggggcatgtgcctggggtcctagtgactcaggaggctgaagcaggagaatcgtttgaagccaagaggtggaggctgcagtgcaccgagatcgtgacacggcacttcagcctgggcgacagagtgagacttgaatgttgatccatgctgcaatatggatgaacctcagaaacgtcatgcaaagtgaaagaagccagacacaaaaggtcatgtgttatataattgcatttacatgaaatatctagaataggtaaatcaacacagacaaaaatgcatattggctcccaggagttgggggagggggaaatagggagcagctgcttaatgggtagagtttcttactggggtgacaaaacatcttggaactagacagaagtggtggctgcacagcattgcaaatgtattaaatgccactgaactgttcacttgtaaaatggtgaatttcatattatgtgaatataacctcaattaaaaaaaaaaaaacagtttgcacagatgtcttattagctagtctatacaatctccacttcggccaaggaatgctctccacagctccatggtccccactaaaactctaaagcctccctggctcacagcctgggtgcagctggagacaaaacacaggatcaaaaatgtccagccagacacggtggctcatgcttgtaatcccagtactttgggaggcccaggtgggtggatcacttaaggccaggagttggagaccagcctggccaacatggtgaaatcctgtctctactaaaaatacaaaagtcagctgggcatggtggcgcatgcctgtaatcccagctactcgggtggctgaggcatgtgaactcaggaggtggaggctacaatgagccaagatggcgccaccacactccagcctgggcgacagagtgagactccatccaaaaagaaaaaaaaagtcctacaaaaagaaacagtaagaatatacatttacataaatattgaaattttatgctagagacaaaaatgctagagaaaagtatacactaaaacttccttaacaaaattcaaaaacaaatgaaggtaaagccttctgcaaacccaagcagtggcaaatattcaagtctgcattaccttcaccaatgttagaaaatagcaggcaacatatgacttcctcctaaatttcaaatttccaactacaaaggagaaccacatagaatctttctaaaaacacctacccatattccgtgtttgagacactgtaggcagtctattacttttgcaagggctgactcttaatgcaaataaaattataatactggcactgttaagaatgttaaaaacaaaaaagtctttcttctcagctacttgctacatactttactcagcaccaaagtgtactagatgctacatgctaacacaaaacataaaggaatagtgtttcttgccttttagagtgaatattctaagaagaacaaagtggaaataacacagtaatttccaaaaaggtatggtactacataatcaacactgtaagaataatttgaggacatgacactcacatctttcctgtagtggacccaagctaactgggtgaaaaaattcagctaaggaggcattcttccagatatgaaagaccaactcaagtatgctcaagaaaaataaatttttggaaggattcaaactatctttccttaaaaagactttggtcagactattctttgtgtgtgtgtgtgtgtgtgtgtgtgtgtgtgtgtgtgtgtgtgtgtgtggtggagtctcacattgtcgcccgggctggagtgcaatggcgctatcttggcttactgcaacctccacctcccgggttcaagcgattctcctgcttcagcttcccaagtagctgggattacaggcccccaccaccatgcccgggtaattatatatattttttttgtatttttagtagagatggggtttcactatggtggccaggctggtctcgaactcctgacctcatgatctgcccatctcagcctcccaaagtgctgggattacagacatgagccactgcgccgggccaactattccctccctcccttctttctttttttttgagatggagtctcgccctgtcgcccaggctggagtgcaatggcgcgatctcagctcactgcaacctctgcctcccaagttcaaacaattctcggcctccctaagtgctgggattacaggcgtgagccaccacacccaaccaggccagactattcttaacagaaaatctagctaatgaatgtgcaatacaaataagcaaagttggtaggcccatagaatgctgaggactgttgctgttttagtgagagtgtccatcaggcactatgcctggcactgtcaatatctgctaccatccccagcactttgggagtccgaggcgggtggatcacttgaggtcaggagtttcagaccagcctgaccaacatggcaaaaccccgtctctactaaaaatacaaaaattagccgaatgtggtggtgcacgcctgcaatcccagcttcttgggaagctgaggcagcagaattgcttgagccacggaggcggaggttgcagtgagtcaagattgcgccactgcactccagcctgggtggcagggcaagactgtctcaaaaaataaaaattaaaattaaaaaaatctgttaccattaatactcaatagtcctatttttcctattgtaaaatccaccatgctaattgcagaaggtatattagaagtcaactggagccattcattattaacaatcacttaagaggcagtttcattcaagcaagcttttataaatcccaactgtattctcccccagaaaggcagcagtcaacatccttaaacatactaacttaataatcaagtgatctaagtcttcacacaagtcaatgaagaaaacatttaacaaaatagaatcaaagaaagcattttacctcaccactaaagagcacctttgaaactagtggctatgctttcagagaagggctgttaaaatagctaggcttacaattatataaaacacatttctctagctctttaacaaggtgtcacaagcgattattacatgcctttgtgaaattaagagctggtatgtatggctaaggaaccctgttgatccctctgtaaatgtcatgcagtccacataaaggaaccaagagacagaaatgtcaagacaagttcacgtgccatcctaatgaggaactaagactagaaaccaagtcttcaaaaaaaaaaaaaaaaaatgatgtccattatttaatggcatcattttcccctagtttctcaaggcaaaaaaaaaaaaaaaaaaaagttcaactggatacagtggctcacacctgtaatctaagtactttaggaggcttaggcaggaggatcgctccagcccaggagttcaagacaacatagcgagacctcatgcctacaaaaagttaaaaaattagtcaggcacagtagcagtagtgcctacctgtagtcacagctacctgggatactgatgcagggggatcacctgagcccaggaggtcaagggtgcagtgagcctagatcgcacaactgcactccagcctaaacaagagaagaccctgtctctttggtgtatgtgcttggctgagaagccaacagggtgaagctaccatctgtgggactacgactgaaggcttcttaagtcagaatcctgcccaggcggaaaaacaaggcaatgctgaggggcctcggatagccttggctaccggtcccctgccggcgggacactgccctaccgcacacggggacacgggtctggtgcggagagccatcatcctggaaaacaaggtgtggcagtaaaaagtttaaaaagtcatccttgactttcctcttaattcataccctatcattaaatccaatcaactctacattcaaaataagtccttaatctgaccacctcatctcctctactaagaccacctggccaagccacattacaacccaccaactagactattgcaacagcatgctctctagtctcctagctttcacttttaccactctataatccattccccatatggtggccagagtgactttttaaaatttgaaagaaagctgcggaaaggcatagtacaaagaactttttcatactgctttgaagtacattatcttctccattatttatagtaatcctgagaaataactatagcaagtttactttctttttcatggatagacaaggctcagagaagtgcactgatttgcccaatattacacagcgaataattggcaagatcatgactggccttctaaatactatcaattatgccattcaagtccctctgcatgtatgccacttattaatcaccctcataaatcctaacatcctttcaatgcccagaattacagtaatgtttcaaaagaacagctagaggtacagaaacactatgattttcaacccggcctacaaatttctttcctgctaaaagcataatgcatgctctgactacaggtctaccacatggcaagtgtttttgtaaagaattaaaggtggccgggcgcggtggctcacgcctgtaatcccagcactttggcaggtggaggcaggtggatcacctgaggtcaggagttcaagaccagcctgaccaacatggtgaaacccggtctctactaaaaatacaaaaaattacccaggagtggtggtgggagcctgtaatcccagctactcaggaggctgaggcaggagaagcacttgaacccaggaggtggaggctgcataaagctgagatcgtgccactgcactccaaccaacctgggcgacaagagcaaaactccgtatcaaaaaaaaaaaaaaaaaaattcaaggtataagcaaaagagccccgataatgagcaatttagcagcatattccatgaggctgcaagctacagcatgccagctgtatttgttagaacatatggacctacaaatggcctttacatttttgttttaatggttggggaaaaaatcaatggaatatttcatgacacctaaaaattcttagttaattcaaagttctgtgtccataaacgaagtttgattggaacacaatcatgctcatttgtttatctatggtccatggctgcttccacactacaatggcagagttaagcagttacaacagaggtcacttggcctgaaaggtctaaattatttatctggtcctttacagaagaagtttgctaaccactgccaatctcttggttttgtacctctggccagcatcctgacctctctcctccctgccaagtgcaggtgaagctttcccctagcacctgatacttctcccaccactttacaccccattttgagatgaattaattgttacacatctgactccacagccagataacaagataacaagatgctgaagggtgaggcccacatgtcctggtttattactacatccccagggcctagcaatgcccatttatagtaggtgcccaatattagctgaatgaatgaaagaacacaagatacttaatacagattagcttatctaaacaactctaaaatttataggagtttttttgtttttgtttctgttttttgagacggagtctcgctctgtcacccaggctggagtgcagtggcgtgatcccggctcactgcaagctccacctcgcaggttcacgccattctcctgcctcagcctcccgagtagccgggactacaagaagccaccaccacagcaggctaatttttctatctgtagtaaaaacggggtttcagttctgacctcaagtgatcagcccaccttggcctcccaaagtgctgggattacaggcgtgagccacaatgcccagcctataggagtttcctctagaagataccaaaaatacagattatcagacttccaggggagacatacaaatgactctatccctgggctcactccaatcaaaatccccaactgcatccaaaatggatcagggcaggagggtagattgcagagtggaaggagtgataaatcaatatgcagcccaatgtattttttaaagcactttttaaaggccgggggcagtggctcacacctgtaatctcagcattttgggaagccgaggcgggtgggtcacttgaagtcaagagtttgagaccagcctggcaaacatggtgaaacctcgtgtctactaaaaatacaaaaaattagccaggtgtggtggcaggcgactgtaatcccagctattcaggaggctgaggcaggagaatcatttgcacctgggaggtagaggttgcagtgagctgcgatcaggccactgactccagcctcagtgacagagccaggctctgtctcaaaaaaaaaaaaaaaaaaaaaggccaggcgcagtggctcacacctgtaatcccagcactttgggaggccgagacgggtggatcacaaggtcaggagatcgagaccatccttgctaacacggtgaaaccccatctctactaaaaatacaaaaaaattagccgggcatagcggcaggcacctgtagtcccagctactcaggaggctgaggcaggagaatggtgtgaacctgggaggcagagcttgcagtgagccgagattgtgccactgcactccagcctgggtgacagagtgagactctgtctccaaaaaaaaaaaaaaaaaaatttaatagaaactcagccagatgcagtgacatgtacctgtaatctcagacactcaggaggctgacgtgggaggatcacctgaggccaggtgttcaaggccagcctgggcaacatagcgaaaccccatcccttaaaaaataaaataaatatttttaaataagtaaacagaataagaactgcaagttccagtctcagatgtgagataagagtttacatattactgatctatagggccagttttaaccacctcccccaaatttttttctcccacattgcctgaatctttatatatttcaccatgtcacactgcctattagtcatctaatttattctctcaccctaaaagaaagctcttttctaaaatacaaatagatctgaaaaatgaaagaagataacaaaatatcatgtactaatgtggatggataaggtagttttgagaggaagagaagagtgggtattaaaagaagatgaagacctcaaggactgagacagacctagttaagattctgaaacagaaagagcagggaaaactaagaatgctgggaaacaaacacaaaaattagcctggcatggtggtgaacgcatggaatctcagctactcgggaggctgaggtggggagaatcacttgaacctgggaggtggaggctgcagtgagccgagatcgcaccaccgcactccagcctggacgacagagtgagactccgtctcaaaaaaaaaaaaaaatagaaggctaggaaacagaacaaagagcagcagaagatgggaaagggtacagaaaatgaagtgacacccaattcagcatttttccccattttctcctgtagaaaaacagaagaaagggctcatctccgtggcttaagaacacccggcatggtggctcatgcctataatcccaggactttaggaggccgagacgggcaaattatttgaggccaagagttcgagaccagcctggccaacatggtgaaaccccgtctctactaaaaaaaaaatacaaaaattagccgggtgtggcggcacacacctctaatcccagctactcgggagactgaggcaggagaatcgcttgaacacaggaggcagaggttgcagtgaaccgagatcacgtcccggcactccaacctgggcaacagagcgagactctgtctcaaaaaaattaaaaattaaaataaaatagccaggcgcgatggctcacacctgtaatcccagcactttgggaggccacgggaggatcacaaggtcaagagattgagaccatcctggctaacacggtgaaaccccatctctactaaaaatacaaaaaaattagccaggcgtggtggcgggtgcccgtagtcccagctactcaggaggctgaggcagaatggcgtcaacccaggaggtggagcttgcagtgagccgagatcgcgccactgcactccagcctgggtgacagatcgagactctgtctcaaaaataaataaataaataaaaataaaataaaatataaaaaataaaaataaaataaaaccagtaacaacataagaattgactcctgtctccatttctattcattccatagctagaaatctttataatggttgggaaaaaaggagagcaggagtagcaaacattaacaacaggggaaataaacattcgccttaatactgacatgactcttcctagaaaacccaaggaaattaatttgaaactactagaattaatgaattcgataatttgttagattaaaagggcatccatactttacagtaagaaggattctaaaactgcacccatgccagcaacactaagattaaaaagtggtggcaagagggtcacgtgcagtggctcctgcctgtaatctaggtgctttccgaggccaaggcaggaggactgcttgaggccagaagtttgaaaccagcctaggcaatacagtgagacacctgtctctatttaaaaaaaaaagaaaaagaaaataaattagccagcatggctgtgtatgcctatagttccagctactcaagaggctgagaaaaggagggtcccttgaatccagaaatttgaagctacagtgagctgtgattctgccactgcattccaacccaagtgacaaaaggcgagactctgtgtcttaattaaaagaaaaaaaaaagaaggccgggcacgatggctcacgcctataatcccagcactttgggaggccgaggtaggtggttcacttgaggtcaggagtttgacaacagcctgaccatcatggtgaaaccccatctctaccaaaaatatttttttaaaagattagctgggtgtggtggtgcatgactgtaatcccagctacgtgggaggctgaggcaggagaatcacttgaacctcggaggcagaggttgcagtgagccaagattgtgccattgcactccagcctgggcgacagagcgagactccgtctcaaaaaaaaaaaaaaaaaaaaaaaaaaaaacaaatagttattacacaattaatctggatcatatttcacactatattcaacaaaaaagttcagatatatcaaagagttacaaataaaaaataatccataacataaactattgatcctaaaaccatatcctggctttgggagagagaaggagaaaaaataatttctgagtaaagagacgagagagatgaatagtaaacttaaaggagttctgacatacaaaacttaaacctttgcaaagttcactccttcaataactactttttaaatacatacgacatttcacacactgtgcttaggccctgatttttcagagtttgaataaagcacatatgagccctcacctcacagaactgaaatctaccggaaaacacagtaaatagcacaaaaagtgtacggaaagttgcaataaataagtactagaggaaaagacacatatctccaagggaacacgaacttaggagggaccacagatggaacggtcatgaaagtctccaaggcatgacatcaaagctgacgacagaaggaagaactcgcaccttggccaggcacagtggctcaggcctataatctcagcactttgggaagccaaggcaggtgaatcacatgagaccaggagtttgagaccagcctggccaacagggtgaagccccatttctaaaagaaaaaaagaacacatgccaaccagatgaagactggggaaagccagcagcacaaaggcccaaagcaggtaaaagaggaccaaccttagtgacaccaacaaaacaagggcgaataataaaaggcaatattctaaagcaccaagaaaaacacagcttcccacacaacaaatcatcaacaaagggaaatgtacattcctcactgccacctgaaaaaactaaacaaaacgtgaagccaaaagctgaaggggatgaagcaaaacaagtacatatatacaatcaacagaactgtaaatttggttgctctttctaaaagacaatctgaaaataatgatagaaactagcattgctcataactttggactcagattccaaataccttctatttccaaaaaaaattactcttcctaaccttaaaactaactgcacaaaagatatccacaggaggagaaaacagtgatatttaaaaaataagtgctcactttgtaggccaggcgcagtgtctcatgcctgtaatctcagcactttgtgaggtcaaggtggttggatcacctgaggtcaggagttcaagaccagactggccaacatggtgaaaccctatctgtactaaaaatacaaaacttagcaaggtgtggtggtgggtacctgttaagaccagctactaggaaggctggggcaggaagacagcttgaacctgggaggtggaggttgcagtgagcacatatcatgccaccacactccagcccgggtgacagagtgagactctatctcaaaaaaaaaaaacaacaaaaagcaagtgcttgcttcagcagcatatatactaaaattggaacaatacagaaaagattagcatggcccctgcccaaggatgactcacaaattcatgaagtgttctagtaattttttacataaaaaaataaggccgggcgtgttggctcacacctgtaattccagccctttgggaggccaaggtgggtaggtcacgaggtcaggacttggagaccagcctggccaacatggtaaaaccctatctctactaaaaatacaaaaattagctgggcgtggtggcactcgcctgtaatcccagccacttgggaggctgaggcagaagaacagcttgaacccgggtggcggaggttgcagtgagcccagatcgtgccactgcactccagcctgagcgacagagtgagactccatcaaacaaacaaacaaataaataaatagaaacaaccaaaaagcctaaaactatggatgtaaattgtgatgtatgaaatgttacattggaaattataacaatataggttggataatacccagaaatgtttattgtaacaaatattaagtaataacatttagcagtttgtgtatacaaataatatacaaaacaaagaccttcaaaaatttcttatctgaagtgacaaatttaattaacgtttagtaatcatggattgctctgctcaggattatgttcaactgtatacagtatttttaattcaaacaatacattacagaacaaagagtattttaacatttatccctcataaatgaaaactgctaatattacaaaaaatagctccatattccctgaaaagtatgtcctgagagccaatctctttcctgctttccagtagtagttactttctgctccctgctagttcattttgtacagttttatgagggagagagagacagaagagaatacacatatacatttattaacaatatttggtaatgagcttttggaaaatgtttataaacagtatcatgctttatgtaccatttaccaaacattctagcctaatgctgtaataactgatctaaataccaactaatatactatatttataccattataacatataaatatacacagatttcttccagtcatttatatcagaaaatgctatgatgtttctgagtttgtttttgttttgttttgtttttttgagacagagtttcgctcttgttgcccaggctggagtgcagtggcgcgatctcagctcactgcaacctccgccttccggtttcaagtcattctcctgcctcagcctcccaagtagctgggattaaaggcgcccacctaattttattttattttttattttttgagacagagtctcactctgttgccaggctggagtgcagtggcgcaatctcggctcaccataacctccatctactgggttcaagcaattcttctgcctcagcctcccaagtagctgggactataggcacacgccaccatgcctcgctaatgtttgtatttttagtagagatggggtttcaccacactggccagatggtctcatctcttgacctcgtgatccacccaccttggcctcccaaagtgctgggattacaggcgtgagccaccacgcccggccaatgcctggctaatttttgtatttttagtagagtcggtgtttcaccatgttggccaggctggtctcgaactccgacctcatgatccacccgccttagtctcccaaagtgctgggattacaggcatgagccactgcgcctagccctgatgtttctggtattaaaatacgtatacagtttggctgggcacggtggctcacatctgtaatcccagtactttgggaagctgaggcaggaggatcacttgaggtcaggagtccgagaccagcctgaccaacatggtgaaacccagtctctactaaaaatgcaaaaaaattagccaggtatggtggcacatgcctgtaatcccagctactcaggaggctgaggcgggagaatcacttgaactcgggaggcagaggttgcagtgagccaaaatcatgccactgcactccagccttccagcctgggatacagaccaaaaaaaaaaaaaacaaaaaaaaaattaattaacttaaagaacactacttattggctgggcgcagtagcttatgcctgtaatcccagactttgggaggccaaggcgggcagatcacttgaggtcaggagttcgatatcagtctggccaacacggtgaaaccccgtctctactacaaatacaaaaaaattagccaggtgtggtggcacatgcctgtaatcccagctaatcaggaggctgaggaaggagaatcgcttgaacccaggaggcagaggctacagtgagccgagatcgcaccaatgcactccagcctgagcaacaagagcaagactccgtctcaaaaaataaataaataacactacttattatcaaataattattaaacttctaataaaggaagacaaaaaattcccaattccatgactgattatttatagccacaagataataaagcaaacaattgcattatcattcagattttaaaagaactatgagcaaataattcaattatcaaaaatcaactcatagctttaaaatgaaccttgggctggatgtcgtggctcacatctgtaatcccagcactttgggagacagaagcaggagaactggatgagcctaggagttccagaccagcctgggaaatacagtgagacctcatttctacaaaacattttcaaaattggtcatggtgttgtctgtctctagttccaactactggagatgctgaggtgggaggctcgactgagcccaggaggtggaggttgcagtgagatggtgccactgcactccagcccgggtgacagaacaagaccatcttttaaaaaaaaaaaaaaaaaagcagccgggcgcagtggctcacatctgtaatcccagcactttgggaggctgaggcaggcaaatcacctgaggtcgggagttcaagaccaggctgaccaacatggagaaaccccgactctactaaaaaaaacaaaaaattagccaagcgtggtggcaggcacctgtaatcccagctactcaggaggctgaggcaggagaattgcttgaagctgggaggcagaggttgcggtgagccgaggtcatgccattgcattccagcctgggcaactagagcaaaactccatctaaaaaaaaaaaaactttgcttatcgtataaaaataaaatatataccaaattttcaaattaaataacatttactaaagccaaaagcacaaaatgtttatttatgaaaaaaatcaaatgttatcttatttacaatttatagtatttttcttgaacttttcttaaaaataaatttggatattgatttgttgccacctactggttaaattcatatttgaatggcatttcacatcaaatattcactacagttaatagaaaacacagagaaaaaaagtaatgttcttttctttacaacgttttactaaactactatgataaattctgctttggaaaagtctgtaaagttacctcacaaaatggtggcttgacttttgacagtatcttcactcaaatttttctttagtgtgttgggactgttttaaaataccattataatttattagaaatataaaacctttaatgaaaatactttcaagatgttatttttaaatttacaactcaaacatgtatatgtaccagtttttcagaatattggagttatatagaatttagggtattaccatctttttacagttgatttcttaggactgaaaaccaaaaaaaaagttctcattacatttgttgttatacgtcttaagtaaattttactctatagcaatctctcctctaaattcctttttcatactacacattgaggaaagagtctgttgtcttactgaactacttttaaaactacttccagattttaaaagcataacaaatttaacactctgagttcccaattctaataaatcaactgtaaaaaggcattccctacagtaactgtggaaatgtgaacatggattgagtttctgttttttgtttttttgagacagggtctcgctctgttgcccaggctggagtgcaatggtgccattttggctcactgcaacctctgactccaggttcaagcaattctcctgcctcagcctcccaagtagctgggattacaggcacccgccaccacacctagctaatatttgtaattttagtagagatggggtttcactatgttggccaggctagtctcgaactcctgacctcaagtgagccacccacctcggcctcccaaagagctgggattacaggcatgagccacccatgccttgatttttagatgacaccagaaaaattatgttaattttgttgattgtgataatgcattatgattatgtaataaatgcatgattgctgtgggctgaattgtgtccccccaaaattcgtatgttgaagccttaacccccagtgtgatatctgaaggtggggcctttggcaggtaattagggttagaggaaggcatcaatgatagtgaggctcatgaagggatttttttttttttttgagatggagtcttgctctgttgcccaggctggagtgcaatggcacaatcttagctcactgcaaactctgcttccccggttcaagcgattctcctgcctcagcttcccgagtagccagcattacaggcgcctgccaccaagcccagctaatttttttatttttagtagagacagggtttcaccatgttggccaggctggtctcaaactcctgacctcaggtgatccacccacctcagcctcccaaagtgctaggattacaggcatgagccaccaccactggcctcatgataggattatataaagagagacaccagacagcttgctccctaactctcctaagcgcgatggcacagtgagacagaaggcatctgcaagccaagaacagggccctcctggaacctgaccatgctggcagcctgatctcagactttcggcctctagcactgtgagaaagaaatgtctgttgttttaagccacccagtctatggtattttgttatggcagcccgggtcaactaagacagtgatgtatatagaaatatgtaagggagaaataatatgcaagagatataacaataatatgccaactgcttttaaatacagttgcaaaaaagaaaaaaaatggaacaaaatcttaatgattgttaaatttaggtgccaagtacttaggggtttcatatgctatcagctcagtttctaagtctgaagtttcctataattaaaaaaaactttaaaaaagaaagaatattaaaaaaaaaaaaaactttttcaatgtaactcctagaaccaaaaccctgaaaataaaatgttttaagataaagtactaatttgaaattattacaaggcaaaaataaaaggtgagtagaaactttaccatctttaaataaatttagtaaaaattgttacaagtttttttgttttgttttgttttttgtttttgagacagtctcccaggctgcagtagcatgatctccgctcactgcaacctccacatccccagctcaagcgattctcctgcctcagccttccgagcagctgggattacaggcgcaggccaccagcaccaccacggctgactgatttttttgtaattttagtggagtcggggtttcactatcttggccacactgatttcaaactcctgacctcaggtggatccacctcaggtgatccactcagcctcctaaagtcctgggattacaggcataagccactgtgccccgcagatttttaagataatatgaaagtccaacctaagggtctcaagctaaaagcactgaccttaaaggctagtattctgttgtaattaagtggcctgttcaaatcacttttatcaggggttaaattttcttaattatgaaagagaaataatttttgaatcctgttgtaaataggatgattttcattgtatatatccaataaattattgttgaaatatttcacttttttcctgtagtttggaactgtttattttgaccctttttggttataatagttctcaaattagaatcttggatttttcaaaaagataataccacctgaaaataataagttttgcttctttctaacctgtttggggtgtttttgtctgattgcactaacactactaaataccataatactacacaacaaaaagggagagcagtcaactcaatattgtccctgattttgaaaggaataataatagttatgacattaactattaaaactaattttttcaataattttgagaaagtgtctatttgtattttacaaagttttgaaaggacagatattcaagtacgcgcctttgatccattcttgcgttaattaagtcacagaaatttgttctaaagcaaagatgaataatttcatattttatgtataattctgaaacatcactgtaaactattcaaagttctatgcccaaaatacatgccctcaggaattttgaatagaggtacaaaaagccattcctcctctagttaaataatccaaactagttttggggttcttaaatctgtttatttcaatcacctcattcattccataagcacttattaattatctgtgatccagggtctatgaaccaaacatagaagaatataatgattaagagacaacttctcatcttcaaggagctcacctaattgtcttaaatattgttaacataataatgaaggaagaaacatccacctgagatatccagaagaattcagaggaaggaacagcagtcctgaacactgagtgacaatggtcaatggcatctctccaagtatgggccatgaactcctgtgatccctgagaatactactaaaacactgtttgcttttttcattgatagtgcaatagcaaaggtacgtgcctgaccaggatcctggtcctaattcatgctaaggcactagtatttctagtgccttgattgatgctaatactagtgccttggcatgaatcaaggacacgatcctggccaggagcggtggctcacgcctgtaatcctagcactctggaaggccaaggcaggcagatcacttggcagctgtttgaaaccagcctggccaacatggtgaaaccccatctctactgaaaacacaaaaattgtcctggcgcagtggcacacacctgtagtcaaagctactcggggggctgaggtgggaggatcacttgagtccaggaggcggaaactgcagtgtgccaagattatgccactgcactccagcctaggagacagagtgaaacactgtcacaaaaaaaaggaaaaaaaaaaaaaaggccaggatccgtaactataacgatagtcattatatgcttcatcatcattttttaagtgtctgtaacaaagaagtaaaaaattatttttattaatctctaacctttaagatgtatctgtttaaaattctgtgcgagaaaataggaagtacgcattatgccgtaccacaaaatacaatgactatttcaagaaaaagccaagtgggcagttgagttgtgagctaaagcagtcaattttttcatggagcaccacgaaagaacaaaagacatataaattatggttatgcaaagtaaaatatacaacattttcttttctctccttttttttttttttttttttgagacaggtcttgctctgtcacccaggctgcagtgcagtggtggtgccatcactgctcaacacagcttctatctcccaggctcaagtgatcctcccaactcagttgcccaagctcccaagtaggtgggaacactagcacacaccaccacgcccagctaagttttttggtttttgttttttggttttgaggtgggtttgtctttttgtagagactaggtttcactatgttttccatgcttatctcaaactcctgggctcgaacgatcttcctgcctcagcttcccaaaatgctgtgattacatgagtgagccactgtacaaggccacagcagattttcttaaaaaatgaagcaagactgtcaattaaaagatatggcagtatttgttgttaataacattcaagctttcaagagaatcagaatttcttaaaatttgtatctgccactaagaagcataaaaggctgcaataaagacttttctaatgagatattaatgtttttttagatattgtataatgatatgtgtcaacatttaaaagatctgcatacctcagtcagccagtattttccaagtgattaacggatgatgtcacaaaagcatgcattggggaaaaggcaatagatttatctcacgcaggatatggccagaaaaaaaagaaaaccataggcccggtgcagtggctcatgcctgtaatcccagcactttgggaggccaaggcaggcagaccacaaggtcaggagttcgagaccagcctgaccaacatggtgaaaccccatctctactaaaaacacaaaaattaaccaggcgtgatggcgcaggcctataatcccagctactcaggaggctgaggcaagagaatcactggaacctgggaggcagatgtgagccaagatcgtgccactgcactccagcctgggcgaaagggcgagactccgtctcaaaaaaaaaaaaaaaaaaaaaaaagggggaatgtggcaggacgcatacctcatgcctgtaatcccagcacttcgagaggccaaggcagctggatcgcttgaggccaggagtttgggaccagcctggtcagcatagcacaaccccatctctactaaaaatacaaaaattagtcaggcatggtggtgcacacctgtagtcccagctacttgggaagctgaggcacaagaatccttaagctcaggaggcagaggttgcagtgagccaagatggcatcactgcattccagtctaggcaacaaagcaattctgtctcaaaaataaaaaaacaggggacgggagtggtggctcacgcctgtaatccagcactttgggaggctgaggtgggtgatcacctgataccaggagttcgaaaccagcctggccaacatggtaaaacccatctctactaaaaatacaaaaagttagccaggtgtggtggcccgcgcctgtaatcccagctactcggaacgctgagacaggagaatcgctggaacctggtagacagaggttgtagtgagccgagatcgtgccactgcactccagcctggctgccagagcgagactctgtctcaaataaataaataagggctgggcagggtgactcatgcctgtaatcccagcacttggggaggccaaggtgggcggatcagctgaggtcgggagatcgagaccatcctagctaacacagtgaaaccccatctctactaaaaatacaaaaaattagctgggcatggtggcacatgcctgtgaaaccccgtctccactaaaaatacaaaaaatgagccaggcatggtggcacatgcctgtaatcccagctactcgaaaggccaaggcaggagaatctcttgaacccgggaagcagaggttgcggtgagccgagatcgcaccactgcactccagcctgggcgacaagagcaaaactccgtctcaaattaataataataataatattaataataataattaaataaaataaaaatataaatgggaaatgtgatttttgtagaatctgaaacattcctaggactgtccagcttattagcgttaaaattactgctatgtcagagaagcctacaacatcaaatatagccatataaaaatttcctcaaaaagagttgcctaggccaggcacagtggctcacacctgacacaagaaaaggatctttcctaacatgctgtttgcctagctccctggtctcacctcccaacactctccacaaagacattaaactcaacacataccaaattacttccagaatccaccttgttctcgctctcctccatgcccccgtatatacgctgcttttctctcactgaaaaagttacatgctctccctaactttgtcattctcctcccacacagccccacatacccaaactatggatttgacctggatagggaaaaacagataagcttcaaataaacaagaagaggaaaggagggacaataaaatggaatatataaaagtctagaatgggaaaaggtgaaacagagccaaaaagaggcaaaggaataaactgctgagctagtacccaaatacaaatgacataaaaaatgtgctaagggcctgaaaaatttatttctaaacccaaacctactcccaagaggccctgcaggtaggatgtgttcacaagttaaataaaagtttgcagataagtggtaagagatggtaaagaaggtggacagaaggcttcaaggaggacttgaaagtcctgaatgtctgaatggcaaacatttgtaaaatgtgtcactattggcaggagcagtggtttgcacctgaaaacccagcaattagggaggcaaaggtgggatgattgcttgagtccaagaatttaagaccagcctgggcaaccttaatgaaaccccatctttacaaaaaatacaaaaactagccaggtatgatggcacgtgcctgtagtcccagctatacaggaagctgaggtggggggatcacttgagcccaggaggttgaggctacagtaagccaaggtttcaccaatgtactccagcctgggcaatagagcgagaccctgactcaaaaaaaacaacaacaaaagtcaccattattaagataaacagtactttagcagtaatggagtctttgacataggacaaggtgaaggccaggaaatctgcagacatctgtgtgttcaggtgtccaatcctccaccagaatataggctccattagcaaagaacccttgttcatacatcctttaatttcctacatacgttttctaactaacagtgcatttccattttagcactttgtgtttcaatattctgttcaattatgattacaaatgaattataagtccccatttttcataaatctttatctcttagtttacaatgtcatatcttttttattttttatttttttggagatggagttttgctcttgtcgcccaggctggagtgcaatggtgccatcttggctcactgaaacctctgcctcctgggttcaagcgattctcctgcctcagcctcccaagtagctgggattacaggcatgcgccaccacacccggctaatttttgtattattaatagagacgggggtttcatcatgttggccaggctggtctcgaactcctgacctcaggtgatccacccgactcagcctcccaaagtgctgggattataggtgcgagcgaccacgcctggcctacaatgtcatatcattctattttttcaaaagcattctccccagaggttagcaaatgctttctgcaaaaaggaaaatggtgaaccttacaaaaccataaggctttgtaagcaatatggtctctctcaaaaacactccaactctgccactgtggcacaaaggcacacagacaatatgtaaacaaaatgaatatgcttgtgtttcaaaaaaactttatttatggacatagaattttttttttctttgaagattatagctcagtgcagccttgaactcctgggctcaagtgatcctcccacctcagcctcccaagtagctaggaccccaggtgtatgcagccacaccttttttttttttttttttttttttttggtagagataggatatcactatattgaccagggtgttctcaaattcctggtttcaagtgatcctcttgcctcagtctcccaaagagtacctgggctatgcactgaaatctgaatttcctgtaatgtcacaaaatcttctgaattttttcaatcatttaaaaaacataaaagctatcttacaagccatacaaacacacatgacaggctatatctggccagcaatccacagtttgcagacccctgctctacactctaacttaaagatttgactatacaacccttccactattccatatttccaaagtaccacaattaactttatttgcaagtctttctggcctctgggaaatgaacaattaggcattcttctgatttaaagccattcaggttcacccacactcacacttaaaaaaaaaaaaaaggccaggagtagtcactaacacctgtaatcccaacactttggaggccgaagtgggtggatcaccagaggtcaggagttcaagaccagcctggccaacatggtgaaaccctgtctctactaaaaacacaaaaattagctgggggtgatggcagcagcctgtaatcccagccactcaggaggctgaggcagaagaatcacttgaaaccaggaggcggaggttacagtgagccaagatcgcaccattgcactccagcctaggcaacaagagggacactccatcaaggacaggagaggaggggagagggcaggggaaggcaagggaggagaggagaggggaggggaggggaggggaagggaggaaaggaaacttgcttatctagtttctgatttaaaacactgaaggaaggaaagggggattttaagtagcagtgtaaatgacacaaagaacagtaacaactgttctattgatgtcaaatgtcaagagtccattatgatgaatctcaattctcagtctcaacttctctcccgtagattgaaaaactaaaatctaaacagtagcttttgagtttgatgagataccctaaagtcattctcacattttaaagaaatgccaaaaactaaacaaatgaataatatgaccaagcatatcgcaagaaacgaaaaaaaattcattataaggaaaacacattatatgtgctatgtaacaattgtaagttattacagggaataacatgaaagacaactgaaacagcttatctttcaaaggatgaaaacttctcaaactcgttcatctatatattcattcatatttattttacacatgaacatgtcaatgtgtttggaatacaagtagggcaagaaattggtgtccaaaacagacatggtctgtgagctcttgggcctatgttgttctacatctgctctttccattatcatagccatcagccccatgtagctatttaaatttaaattagagttaaataaaattaaaaaccggttcctcagtcacactagtcacacttcacatggccaagggccagctttcagctatgatactggacatcacagatacagaatgtttccataatcacagaaagttctgttcggtagcaaaggtttaaaacgttacatacttccctctctctgctgactagacattaagatgaaacttaacttctttcttttaaaaaagagtgcaaaattttactgctgtcttttagggaagtaccaggtgacagtctttctacaggtgtactttatatcaaagctgtaaaaacttctaaggttttctaatccagcaaaataatcaccaaatgcctttaccaaggttttaaagttttttaaaaaattcctggaggtaagtatttcatcatcagtaactattccaatttactaattggcttcaaaccattctcaactgcattcacaactgcagtatttcctttcctagaaagtgaaggattctgcacttaactgattatcacataactctctatgatgcagaaaacagctcctgcttgtcacctctgcatggtgactggaacacagagggtactcaaacaactgttatatgaaggtcaataaactgtaagtctccagcactgtcaaaagcaacacaaggccaggtgcagtggctcatgcctataatcccagcactttaggagggcaaggcgggcggatcacgaggtcaggagttcaagaccagcctggccaatatggtgaaaccctgtctctactaaaaacacaaaaattagccaggcatggtggtgtgcgcctgtagtcccagctactcggaaggctgaggcagaagaactgattgaaccccagcaggcagaggaggttgcagtgagccaagatcgcaccactgcactctagcctgggtgacagcgcaagactccatctcaaaaaaaacaagcaacaacaacaaacccacaaaagccacattccatttcacaactctagttactgatggagcttccagtctttgctgcttctcatttgttaaaaaaaaaaaaaaaaaactttattcactgcatgatttaagcagcaccaaactgcttgggtatcggttttctgggtccctgaaaatcaaggacttactaaacagtaaaaattctacatgaagaaataaaatattgcacactgcccgggaaccataaaattaatataaattaatttatcttttacttggctatgagatagactggctttttttttttttaagattaaggtttcattctgtcacccaggctgaagtgcagtgggcatgatcatggctcactgaaacctccacctctgggctcaagcaatcctcccacctctactcagccttctaagtagctgggactacagacatgtgccaccgcgcccggctaattatttaatttagtagagacagggtcttgctatgttgcccaggctggtcttaaactcctggactcaagcaatcctccggcttcagtctcccaaagtgctgggattacaggccaccatgcctggctaattttttctttaatttttgtagagacaggtctcactagcccaagctggtctcaaattcctggactcaagtgatcctcccacctcaccctctcaaagtgctgggatcacaggagtgagccaccatattgaccacagactggcttataaatatgtgtaactacagtgagatattcagccgaagaatgagggggagggggaggaggaggaagaattatggctgggcatgacggcccatgcctatactcccagcactttgggagactgaggcgggaggatcgcttgagtccaggagtttgagacttgcctgggcagcctggcaagacccccatctctgcaaaaaaattttaaaaattagccaggcatggtggcacaaacttgtggtcccagctacttggaaagctgaagcaggagaattgcttgaacccaggaggcagaggttgcagtgagctgagatggcaccactacactccagcctgggtgacagggcgagactccgtctcaaaaaaaaaaaaaaagaaagaaaagcggtagcttgcacaattaattctaaattacattaacaaagacatctcaaatgtctcaactactcatgaaagacagctgtatcaaaattgcacatttccttgaaaacagaaatcaaaatgttttcaaattagtccataccagtgacatataccattaatattaatgagaatatggctgcttggcaaactttttttttttttttttttttttttgagatggagtttcgctcttgttccccaggctggagtgcaatggcgcgatctcactgcaacctccgcctcccgggttcaagcgattctcatgcctcagcctcctcagtagctgggattacaggcatgggccaccacgcccggccaattctgtattgttaatagaaacggggtttctccatgttggtcagactggtctggaactcctgacatcaggtgatccacccacctcgacttcccaaagtgctgggattacaggtgtgagtcaccgcgcacagcagtcaaacttaataagccactatttggtataaaatgcctttgaacttttttctttctttttttttttttttttgagatgcagtctcgctctgttgcccaggctggagtgcaatggcatgatcacggctcactgcaacctccacctcatggttcaagcgattctcccgcctcagcttcctgagtagctggcattacaggcacccgccatcatgccggactaatttttgtattttagtagagatgagatttcaccatgttggccaggctggtgttcaactactgacctcaggtgatccaactgcctcggcctcccaaagtgctggaattacaggcgtgagccaccatgcccagctgcatttgaactattttctaaccaaactagttctgcccaatcagatgatacactttaaaaaaaaaaatttatctaaagaaagttatcattcatgccagcactgaaaacagaaaataaaaaataaaaaatgaatatatcagagcagccgggcgcagtggctcacgccgtaatcccagcactttgggaggccaaggcgggcagatcacctgaggttaggggttcgagaccagcctggccaacatggtgaaaccccatctctactaaaaatacaaaaattagccgggcgtggtggcgctttcctgtaatcctagctacttggaaggcagaggcaggagaatcacttgaactcggaggcggaggttgcagtgagcctagtttgcatcactgcactccagcctgggcaacagagtgagatttttgtagaaagagagaaagaaagagggggaggggaggggaggggaggggatggaggggaggaagaaatcagagcttgtcaagaacctacgaaagaattaagggggccaagcatggtggctcacgcctgtaatcccagcactttgggaggccaaggtaggcggatcactggaggttgggagttcaagaccagcccgaccaacatggagaagccccatctctactaaaaatacaaaattaactgggcatggtggcgcatgcctgtaatcccagctactcaggaggctgaggcaggaaaatcgctggaacctgggaggcggaggttgcagtgagccgagatcacaccattgcactccagcctgggcaacaagagtgaaactccatctcaaaaaaaaaaaaaaaagaattaggaaaagagagtaataacatatagtagcattaaagtacaaccacaccttaatatcctatgtaatcagagattcttcacaaatatccatgtgaaagtcctagggtcaaggactggctaagcccaaaaaaccagagataactgaacagacacagcaggaagaaaagagtaaatagcaaagttactatttattgaacggtgcctgtctttttttttgagctggagtctcgctctgtcgccaggctggtgtgcagtgccgtgatctcagctcaccgcaacctccacctcccaggttcaagcgattctcctgcctcagcctcctgcatagctgggattacaggcacatgccaccacacctggctaatttttgtattcttagtagagatggggtttcgccatgttggccaggatgatctcaatctcctgaacttgtgatccacctgcctcagcctcccaaagtgctgggattacaggcgtgagccactgtgcctggccaaacagtgcctgtcttaatacagcaggcattatgctaaatatatcacctgaatttttacttaatcctcacaataaccctgtagttgctataattttttttttttttttttggagacaagagtctctctctgtcacccagactggagtacagtggctcaatctcagctcactgcaacctccgcctcccctgttttaggtaattctccagcctcagccacccgagtagctgggattataggcacatgccaccaagcctggctaatttttgtatttttagtagagacagggtttcaccatgttggccaggatgttctcgatctcctgaactcgcatccacccaccttggcctcccaaagcgctaggattacaggcatgagccaccgcgcctggccgaacagtgcctatcttgatacagctggcattatgctaaatatatcagctgaatttttacttgatcctcacaataaccctgtggttgctacaattttttttcttttttttttttttttgagacggaatctctgtcacccaggctggagtgcagtggctcaatctgagctcaccgcaacctccgcctcccccgtttcaagtaattctcctgcctcagcctcccaggtagctagaactacaggcatacgccaacacacccagctaatttttgtattagtagagacggggtttctccatattggccaggctggtctccaactcctgacctccccaccttggcctcccaaagtgctatagttgctataattaatcccattttacaaatgagaaaactgaggcacacagatagcttaaacatgttcagattacatggctattaagccattacacagcaggattagggtaagaagccacgtctgccagccaaccctatactacattaaagtttacagagcctatcttacgcgctttatctatttgctaccaccctgtgatatgatttgaatgtttatcccatctgaaactcacgttaaaacttaatccccaatgtgggtattatgaggcaggtctttaagaggtgactgtgtcatgacggttctgccctcatgaatggaacctattcatggattaatgagttaacgaattttaacggattatcctgggagtgcgactggtggctttataagaggaagagacctgagctagcacactcagccccctaaccatgtgatactctaggccaccttgggactctgcagagtccccaccagcaagaaggtcctcattagatgcaccccttgaccttggccttcccagcatgcagaactgaaagaaataaattccttttctttataaattacccagtcttaaccaggcccacccctggttaaggatgggcaacaggctcacccctgtaatcccagcactctgggaggctgaggagggcgaatcacctgaggtcaggagtttgagaccaccctaggtgacagagttacactccgtctcaaaaataataataataataataaatcaccggccgggcgcagtagctcacacctgtaatcccagcactttgggtggccgaggcaggaggatcacctgaggtcaggagtttaagaccagccttgccaaaatggtgaaaccccatctccactaaaaatacaaaaaattagctgggtgtggtggccggcacctataatcccagctactcgggaggctgaggcagcaaaatcgcttgaacccggggggcggaggctgcagtgagccaagattgtgccattgcactccagcctgggagacaagaacaagactccatctcaaaaaaaaaaaaaaagaagaagaagaagaagaagaaataaataacccagtctcagaaattcagttactgcaacagtaaacagactaagacacccttataatccactgtaaagcaggctgtgcagtttgatgatccccagtctcagaaattcagttactgcaacagtaaacagactaagacacccttataatccactgtaaagcaggctgtgcagtttgatgatcctattttcctagagaaaataagagattcaggaaggatgaatcattccctccctatggagcaagcagcagagctgggtctagaatccccgtcttttaactcttcaccactgtttctcctcctcaatatgcttagctagtgtggtggtttcaaaaatatgttcacaaattacttaatttgcatctcttcaaagggcagaacctgaactctcccttgagtgtgggctgtacccagtaactcccttctaacaaacgtggcagaagtggcagtgtgaggtcttctaagggtgtgttataaaaatgtaaccgcagcttcctccttgctccctcttgatgaagccagctgacatgttgtgagaacattcaagaagaggtccacagagcaacaggcaaggcctcctgccaacagcctggaagcagatcctccagcctcagccaagccttcaaaatgactgcaaccctgagccagaaccaccccactcaactgcttccaaattcttaacccacagaaactaagatgataaatgttgcattaaaccactatgcttcacagtaacttgttatgtggtaataaatagctaatacaactaggggctgggtgtggtggctcacgccagtaatcccagcactttgggaggccaaggtgggcagattacttgaggtcagggtatcgagaccagcctggccaacatagtgaaacccagtctcttactaaaaatacaaaaattagctggctgtggtggcgcacgcctgtaatcccagctactcgggaggctgaggcaggagaattgcttgaacccaggagatggaggttgcatgagccaagattgcaccagtgcactccagcctgggtgacagagcgagactctatctcaaaagaaaaaaaaaaaagctcttggctagtcatcagaattacatgatccctcccttaatttcacacagtaaatgccagtacctctattggttaacattctattccaccttgtgtcactgctagttgtttacctgcctatctctgagactaagtcataaatcccttattatctaaggttcaattttctcatcagtaaaatgaaagggttagattaagtaattgctaaggaactcccaactccaaagttccataaggatgactcttaattgaaaaaagtaagatagcacagttgtaagcttcgacttggtagttttaaatctcagctctacaacctatcagctctaaacaatgggcctgctgctgaacatttctgtgcctcagttcctcatctgtaaaatgagaataatagtgctgttagaattcttccaggtaatggttttgtttttttgtgtttttttttgaaacagtctccctctgtcacccaggctggaatgcagtggtgcaatcatggctcactgcagccttgacctcctgggctcaagcaatcctcccatctcagcctcccaagtagctgggattacaggagcgtgccatccagcccagtttgttgttgttgttgttgttgttgttgttgttgttgttgtttggtggagacagggttttgtcacgttgctcaggctggtctcaaactcctgagctcaaatgatccgccttctttggcctcccaaagtgatgggattacagactgccttcaagcaaattcatcaggcccatgttcctgaatgccccaaggtgagcagtaaggaacagaaaaacactttccttctccagaaaatcccactcctgagctgataggaggggatctcagaaagaatcatcacaaaagacaggacaaactaaagaagctggcagacttttttaattcttcccagtacaaactggaactagacatgcagagagccttcctaaaggcaacgcccaaatcccacgtgaggccaaacttctccccagggagactgagagccaatgttcttatcataacactcctccccacagtgcacccacagacaaggaagcctgagcagttgtggctgtcacacaacagatgcagcgttcaggccagaaccttccaggaccttcctctttgctggcccaacagctgctgcatctgcctggccttcgaggagcagccagtatgtatgtggctgtgtggagcaagaatgtgccaaaataagcaaccaagtcaatcagagatgggtttggggctaagttgacatggtaacaggaccagtcacaggtctccccatgtatggtgggaccacagagccctatgtcctccattcattcttctctgggcagtttctgtccaggacagctatggggcaaattccaccttatccttaagactcaccacctgggtgtgcgtggctcttgcccggcagctcatccagctcatccaccctgtactcagagatgcttttttcctcctgcacaggctgtgggtcctttcccctaacgaatcactccaggtagtagcccacagtcctggccacaaaggccacagggtatgtaacttaagtagcataggtaagcattacgatccaaagcacaagccacacatcatcaggcagcctggcacaatttactgggaatccactcatgcatagcaatgcaagagatcacaccctgttttatgcaacagttgggtaccacaaataatctgcagcacagcccatactcctctgtccagccctggtctctacctgctggctgggaacagacattgctactcctagcagcccacatggcctcctgttgttttttaataacaactacagtcagatatataactcacatgtacaattcacccaattaaagtgcacaacttaatgacttcagtatattcacagagctgtacaaccattaccaaaatcaattttacagtatttttatcaccccaaaaagaaacacatacccatcaacaggcacgccccatatttccccctccccaccagctctaggtaaccataaatctactttctgtctctatgagtttgcttattccagatatttgatataaattaaatcatattaataagtggtctttcatgactgacttctttgatccagtataatgttttcaagatatatccatgttgtagcatgtaacagtacttcattatttttactgctgaataatattccattgtaaggatatgctacattttgtttattcatcaactgacatctgagttgtttccatctggctgtgatcaacaatgttgctctttcagttttaagtaacagaaaatacagcagggcacagtggctaacgcctataatcctagcactttgggaggccacagcaggaggagtgctagagaccaggagttcaagactagcctgcgcaacacggcaagacctcatctctacgaaaaaaaaaaaatttttttttcattagcaagcaaggcacagtggctcacgcctgtaatcccaacactttggcaaacagaggcagaaggatcatttaagctcaggagtttgaaaccagcctgggcaacattacaagaccacatctcaactgaaaataaaaatttttaaaaaattagccaggcatggtggagcacacctgtggtcccagctactcagaaggctgtggtgggaggactgcttaagcctgggaggtcaaggctgcagtaagccatgataatgtcactgtgttctaacctgggtgagagaacctgtctccaagaaaaaaaagtgatagaaaatccaaatcaaccctgcttaaacaaataactaaacgtcaagcaggcagcctttgcataagacacagcctgagttagggtttaaatatcaccatcagggccaagcacggtgcctcacgcctgttacctcagcactttgggaggctgaggcaagcagatcccttgaggtcaggagttttgagaccagcctggcccacatggtgaaaccccgtctctacaaaaaatacaaaaattagccaggcgtggtggcatctgccagtagtccagctacttgggaggctgaggcaggagaatcacctgaaactggaaggcagaagtttcagtgagctgagaccatgccaccgcactccagcctggatgacacagtgagactctaaaataaataaattaaattaaataaataaatatcaccatcaggattgagtttctaactcttggcaaggctcagttctctgttcattttcaggatctgcatggtgacaaaatggcttcaatacctctatttcacatcctctccattgaagcttataggagaaagcaagagcctctcccaaatcctcatgcaaaggccctaagattagctctgggtgggctctccaactgaaaagtggaaggcactaagtaaaataggccgtgctccatcctggagcatgaaggaaactagagagaaacccaaacaatgtgaaccaaaaatggacaagagataatccctatacaaaaactgaggcccatttcgactaggataaatggaatctgggcagctgaaaaaatttttaagcccagtttagagtgttgtgacaattaaacctgataaatgcatattaaagtatgtagcagaatgcccaatacacaataaatacttaataaatgttactcactatattagctattttttgtagctaatatagtgagtaatttagataaacccatgaaatttgatagtttggggcaaaaaaagacaatttcacacagttcaacatcatacatactcagcttaaaattaaggcaagtacaacctgtatttgctttttcatagtgaaatgtaagtctgcatctctattagatatattaaatacccaaaagaaggaacagttatttccaaaattttcaaaaccttgggttaaaaatgcaagtatctcttctttaacagagatttctctggtcctgtggaagatacatgatagaggcaaaatatgagaaatgaaagaccctgagacagctagtactcccaaagcatctgctaccctaacaacactatggtaaaggccttatgtgtatccaccttctcctttatcagctaaagctcccaactaagactattaaatcttttcatagtaaaccatcacttgatttttttaggtaaacactaattttttttttttttttgagacggagtctcgctctgtcgcccaggctggagtgcagtggtgcgatctcggcctcactgcaagctccgcctcccaggttcatgccattctcctgcctcagcctcccgggtagctgggactacaggcgcccaccaccacgcctggctaattttttgtattttgtttagtagagatggggtttcactgtgttagccaggatggtctcgatctcctgaccttgtgatccgcctgcctcggcctcccaaagtgctgcgattacaggcgtgagccactgcgcccagccaaataacactaattttttaaaaaactgctggagtcctccattcctttcatcatgtcttagtctcctccctgtccctttattttagtttgaaattacaaacctaaatagagatgacctgctataaacaataaatatctcttcactatttctagatctgatgtaataccagccgagattggtggatcacctgaggtcaggagttcaggaccagcctagccaacatggtgaaaccccatctctactaaaaatacaaaaaatagccgggtgcggtggtgtgcgcttgttaccccagctactcgggaggctgaggcaagagaattgcttgaacccaggaggcggaggttacagtgagccaagatcacaccattgcactccagcctgggcaacaagagcaagactccgtctcaaaaaacaaaaaaaacaataacaaaacaaaacaaaaaaaagattcaaagataaatgaggctttggagaaatgggaactatcaaatctctggtaaataagatagcctttgcccatacaggggaagcacaactgatccttgaacaacgcagggattagggaagccacccccatctctgcacagtcaaaaatccacatacaggccaggcacagtggctcacgcctataatcccagcactttgggaggctgaggtgggtggatcacaaaggtcaagagatcaagaccatcctgaccaacatggtaaaaccctgtctctagtaaaaatacaaaaattagttgggcgtgctggcatgttcctggagtcccagctactcaagaggctgaggcaggagaatcgcttgaacccgggaggcgaaggttgcagtgagacgagatcacgccactgcactccagcctgggcaacagagcgagactccgtctcaaaaaaaaaaaaaaaaaaaaaacaccccacgtacaacttctgactccccaaaaaccagaagccttatcaataacataaacagtagataacacacattttgtatgttatatgtattatacacaatattcctacaataaaacaagataaacaaaagaaaactttattaagaaaatcataaggggccatgcatggtggctcacacctataatcccagcactttggaaggctgaagcaagtggatcacttgagctcaggagttcaaaaccagcctggacaacatgacgaaactcagtctctattaaaaacacaaaaattagccgggcatggtggttcttgcctgccgtgtcagttacttggggatctgaggtgggaggatcacctgagcccgggaggcaaaggttgcagtaggacgaggtcatgccactgcactctagcctgggcaacagaacaagagaccctgtctcaaaaaagaaaagaaagaaaaaatcataaggaagagaaaatatatttactatttgtcttagtctatttttgctgctaaagaaggaatatctaagcctgggtaatttattaatataaagaaaagagatgtatgtggctcatggttttgcaggctgtacaacaagcatggcaccagcacctaatttcagtgagggtctcaggctgcttccacccatgctggaagaaaggggtgctaagaacacagagagagagagagagagagaaagcaagagtggaggtggaggtgcctcttttcaacaaccagttctctggaaactaagagtgagaagcaagaatgacacctcaagccattcaagagggatccaccccctacaatccaaacaccaggccccaccaccaacactggggtatcaaatttcaacatgaggcttggagaggtcaaacaaaccatatccaaaccacagctttttttttttttttttttttttttggagacaaaggctcgctctatcacccaggctggagtgcaatggcgcgatcttggctcactgcaacctctgcctcccgggttcaagcaattcacctgcctcagcctcccaagtagctgggattgcaagcgcatgccaccatgtccagctaattttttttatttttagtagagatggggtttcactgtgttagtgaggatggcctcgaagtcctgaccttgtgatctgccctccttggcctcccaaagtgacaagattacaggcatgagccactgtgccaggcccacagcactatttattaagtggatcatcataaaggtctccatgcttatcaacttcacagtaaaaaagacgtcaaaagcagtcttcaataatcagaacgcctctgcttaattgtctaacgtcaatttgttttatggcactgctgctgctatgtcatcttcctcatcgtctggcagtggtatggaagcactcatttccatcaagtcatctgataattcctgtggtgtgatgtctactggctcttgaatttctcacaatccacatctggaaaccgttcatccttccaacccccaccttttttgccatatctacaatctgtttcatgatttccttgactataaatcttgtgatcaattttagaataagtgcgatgtggtgctgagaagaatgtatattccgttgatttggggtggagaattttgtagatatctattaggtccgcttggtgcagagctgagttcaagtcctggatatcctcgttaaccttctgtctcgttgatctgtctaatattgacagtggggtgttaaagtctcccattattattgtgtgggaatctaagtctctttgtaggtctctaaggacttgctttatgaatctggatgttcctgtattgggtgcatacagatttaggatagttagctcttcttgttgaattgatccctttaccattatgtaatggccttctttgtctctcttttgttctttgctggtttaaagtctgttttatcagagactaggatctcgacccctgcttttctctgctttccatttgtttggtacatcttcctccatccctttattttgagactatgtgtgtctctgaaggtaagatgggtctcctgaatacagcacactgataggtcttgactctctatccaatttgccagtctgtgtcttttaattgggacatttagcccatttacatttaaggttaatactgtgtgaatctgatcctgtcattatgatgttagctggttattttgcccattagttgatgcagtttcctcatagcatcgatggtctttacaattttttttgcagtggctagtaccagcttttcctttccatatttagtgcttccttcaggagctcttgtaaggcaggcctggtggtgacaaaatctctcaacatttgcttgtcagtaaaggattttatttctccttcacttatgaagcttagtttggctggatatgaaattctgggttaaaaattcttttaagaatgctgaatactggcccccactgtcttctgacttgtagggtttctgccgagagatccgccgttagtctgatgggcttccctttgtgggtaacccgacaggccttcatgctaaaaactctcaataaattcggtattgacagaacgtatctcaaaatagtaagagctatttatgacaaacccacagccaatatcatactgaatgggcaaaaactggaagcattccctttgaaaactggcacaagacaaggatgtcctctctcaccactcgaatattcaacacgttgctggaagttctggccagggcaatcaggcaagagaaagaaataaagggtattcaattaggaaaagaggaagtcaaattgtccctgtttgcagatgacatgattgtctatttagaaaaccccatcatctcagcccaaaatctccttaagctgataagcaacttcagcaaagtctcagtcaatgtacaaaaatcacaagcattcttatacacctatataccaataacacacagagagccaaatcatgagtgaactcccattcacaattgctacaaagagaatacaatacctaggaatccaacttacaagggatgtgaaggacctcttcaaggagaactacaaaccactgctcaatgaaataaaagaggacacaaacaaatggaagaacattccatgctcatggataggaagaatcaatatcgtgaaaatggccatacagcccaaggtaatttatagattcaatgccatccccatcaagctaccaattactttcttcacagaattggaaaaaactactttaaagttcatacggaaccaaaaaagagcacgcactgccaagacaatcctaagcaaaaagaataaaactggaggcatcatgctacctgacttcagactatactacaaggctacagtaacaaaaacagcatggtactggtaccaaaacagatatatagatcaatggaacagaacagaggcctcagaaataccaccgcacatctacaaccatctgatctttgacaaacctgacaaaaacaagcaatggggaaagcattccccatttaataaatggtgctgggaaaactggctagctatatgtagaaaactgaaactggatctcttccttacaccttatacaaaaattaattcaagatggatttaagacttaaatgttagacctaaaaccataaaaaccctaggaagaaaacctaggcaataccattcaggacataggcatgggcaaggacttcatgactaaaacaccgaaagcgcctggcaacaaaagccaaattgaaaaacaggatctaattaaactaaagagcttctgcacagcaaaagaaactaccatcagagtgaacacgcactacagaatgggagaaaatttttacaatctacctatctgacaaagggctaatatccagaatctacaaagaacttaaacaaatttaccagaaaaaaaatcaaacaaccccatcaaaaagtgggcgaaggatatgaacagacacttctcaaaagaagacatttatgcagccaacagacacatgaaaaaatgttcatcatcactggccatcagagaaatgcaaatcaaaaccacaatgagataccatctcacaccagttagaatggcgatcattaaaaagtcaggaaatggccgggcgcggtggctcacgcctgtagtcccagcactttgagaggccaaggcgggtggatcacaaggttgggagatggagaccatcctggctaacttggtgaatggcctgaacccaggaggcagagcttgtagtgagctgagatcacgccactgcactccagcctgggcgacagagcaagactctgtctcaaaaaaaaaaaaaaaaaaagtcaggaaacaacaggtgctggagaggatgtggagaaataggaacacttttaaactgttggtgggactgtaaactagttcaaccatgtggaagacagtgtggtgatttctcaaggatctagaaatagaaataccatttcacccagccatcccattaacgggtatatacccaaaggattataaatcatgctgctataaagacacatgtacatgtatgtttactgtggcactattcacaatagcaaagacttggaaccaacccaaatgtccatcagtgatagactggattaagaaaatgtggcacatatacaccacggaatactatgcagccataaaaaagaatgagttcctttgtagggacatggatgaagctggaaaccatcattctaagcaaactatcgcatggacagaaaaccaaacactgcatgttctcactcataggaactgaacaatgagaacacttggacacaggatggggaacatcacacaccggggcctgtcgtggggtggggggagaggggagggatagcattaggagatatacttaatgtaaatgatgagttaacgggtgcagcacaccaacatggcacatgtatacatatgtaataaagctgcacgttgtgcacatgtaccctagaacttaaagtataataaaaaataaataaaaataaataaaaaataaaagaaactaccatcagagtaaacaacctacagaatgggagaaaatttctgcaatctacccatctgacaaagggctaatatccagaatctacaaagaacttaaacaaatttacaagaaaaaatcaaacaaccccatcaaaaagagggcaaaggatatgaacagacacttctcaaaagaagacatttatgcaaccaacagacacatgaaaaaatgctcatcatcactggccatcagagaaatgcaaatcaaaaccacaatgagataccatctcacaccaattagaatggcaatcattaaaaagtcaggaaacaacacgtgctggagaggatgtggagaaataggaacacttttacacggttggtgggagtgtaaattagttcaacccttgtggaaggcagtgtggtgaatcctcaaggatctagaactagaaataccatttgacccagccatctcattactgggtatatacccaaaggattataaatcatgctactaggcttactacacatgcacatgtatgtttattattgcggcactattcacaatagcaaagacttggaaccaacccaaatgtccatcaatgatagagtggattaagaaaatgtggcacatatacaccatggaatactatgcagccataaaaaaggatgagttcatgtgctttgcagggacatgaatgaatctggaaaccatcattctcagcaaactatcacaaggacagaaaaccaaacaccgcatgttctcactcgtaggtgggagccggacaatgagaacacatggacacagggcggggaacatcacacactggggcctgtcgtggggtggggggctgggagagggatagcattaggagaaatacctaatgtaaatgacaagttgatgggtgcagcaaaccaacatggcacatgtatacatatgtaacaaacctgcatgctgtgcacatgtaccctagaacttaaagtataattaaaaaataataaaataatttttaataaaaatcctttgaagtcatgcacatctggacagtcttctccagcaggaatttgtttcaagcctgatggttttcattgctttttctgtaacaacaatggtatcttcagtggtacaacccagacattcatgatggtctctctattgagttctcttctgctgcactgaaaagcctttccatagcataccgtgtgtaacgtttttttttttttgagaaggagtctcgcactgtcaccctggctggagtgcggtgccatgatcttggctcactgcaaccgccacctcccagattcaagcgcttctcctgcctcagcctcccaagtagctgggattacaggtacccgccatcatgcctagctaattttttttgtatttttagtagagacggggtttcactatgttggccaggctggtctcaaactcctgatctcgtgatccgcctgcctcggcctcccaaagtgctggggttacaggggagagccaccgcgcctggccgagtcttaaaggtccttaaggctccctgatgtagaagctaaattagagacattgtgtttgggggcaagtaaactacttccacaccttctgtgctgaacccctggggttctggatggtcaggggcattgtccaaaatcaaaagaactttaaaaggcaatctctcactggctaggtatttcctgactccagggacaaagcatcaatggaatcaatccaaaaaagggttctcattgtccaggacttcttgtacaaccaaaggactggcagccagtatttctcttatcccttcaaggttcaaggttagcagctttacagacaagggcagtcctgatcataaacctgactacatttgcacaaaagagtagagttagcccatcccttcctgccttaaatcctggtgcttacttcttttccttacaaattggattaatgtcctctatggcaatttttttccagaatggggcacttccatctaatggggcacttccatctggcatttagggccaggcacagtggctcacgcctgtaatcccaacagtttggaaggctgaggcgggtggatcacctgagatcaggagctggagaccagcccggccaatattgtgaaacccgatctctactaaaaatacaaaaaattagccaggtgtggtggcgggtgcctgtaatccaagctactcaggaggctgaggcaggagaatcgcttgaacccaggaggcggagattgcagtgagccgagattgcaccattgcatttccagcctgggcaacaagagcgaaattctgtctcaaaaaaaaaaaaaaaaaaaaaattatatatatatatatatttaggccaggtgcaatggctctcacatctgtaatcccaacactctgggaggtcaaggcaggagaatcgaagacgagcctgggcaacacagggagactgagtctccacaaaatgatttaaaaattagctgggcgtggtggcgtgtacctgcagtctcagctactcgggggactgagatgggaggatcatgtgagcttagtaggtcagggctggagtgagtcatcatgccacttcactccggcctgggagaacaaaactctatcttttaatttaaaaaaacaaaaaacagaaactattcaggcagatagcctttctcctcaatgattttatttcttccttttttttttttagacggagtctcgctttgttgacaggctggagtgcatggcgcgatctcggctcactgcaaccgctgcctccagggttcaagtgattctcctgcctcagcctcccaagtagctgcgactacaggcgcacgctaccacgcccagctaatctttgtatttttagtagagacagggtttcatgatgttggacaggatagtcttgatctcttgaccttgtgatccgcccacctcggcctcccaaagtgctgggatttcaggcatgagccaccgcacccggcctaatgattttcttaatggtgtctgggaactcatacgctgccacttggtggcttctcctgctatctcctcatttcttaaggcaaacctctaaaattatcaaaccatcttttgctggaattaaattctatagctttagatccttcctcttttgctttacagttgtcatacagtgactttgctttttctctaattgtattagcatctacaggtatgccttttttttttttttctttttgagacggagtgtcaccctgtcgcacaggctggaatgcagtggcatgatcttgactcactgcaacctctgcctcccggcctcaagcaattcttctacctcagcctcccaagcagatgggactacaggcgtgcaccaccacaaccagctaatttttgtatttttagtagaggcagagtttcaccatattgggccaggctgatctcaaactcctgacctcgtgatccgcccgcctcagcctcccaaagtgctgggattacaggcgtgagccaccaggcccagccaggtatgcctttcttattgcaatcctgcacccacataaaagctgcattttcaatacaagataaaagaatatttcacaagaagtgtgagattttcatgcatgctggtatagctgcaacaatggcttcatgaatttcctttcctttttttcactatagtcatgtatgctgaattcatttatctttaaatggcaggcaaacatagaatgcactcattctaagatgcatatcaagcaatttgactttttcttgtaacatcatgacatttctctccttcctgggagcacttccagtatcactagtgtcactccgtgagtcccatggtgttattcaaagtttacagacttgcactaaacatagtgaaatatatgtaagaaaaatatgagatcacctttttttttgtttttttttttgtttgtttgtttgttttaggatagtctcgaactcctgagctcaaatgctcctcccacctgggtgtcccaaagtgctggtattacaggtatgagccaccacacctggcagagatcactttttaccaagatacgcaatttactggagacaagctacccacatggagataactggcatcacagggctttgttttgttttgtttttgagacaggttccggctctgtcacccaggctggagtgcactggcatgatattggctcaccgcaacctcggcctcctggggtcaagcaatcctcccgcctcagcctcctgagtagctgggactataggcacgcaccactacacccagttaatttttgtattttttatagagacggggtctcaccgtgttgcccaggctggtctccaactccttggctcaagcaatccacccacctcagcctcccaaagagctgggattactggcatgagtgaccacacctggccagttacagggcatcacagggatacttccaacacttgagctcactgcaaaagcaacaggaggtagctacaaagttattacagcagtatggcatatactacagttaattccatgcagttatgatttaacactgcacctttatgtttgcacttctcttgactgcaaatagtgccgtgtacagtctgtacacacacattttgtgtacatttcatgttggtaaatgataaaacaggctagcatctacaaatattttaagcattcatgacatacctttttaatgtttttaaatatttctagggtacatagttcaagttttttcaaactgcagaaaatctccaaaaaatttaccaatatatttattgaaaaaaatttccacaggacaaacacatgttgttgatagccaaactgtatacgcttttcagtaatgggatttaaaacttaaggagagtacagttacaaagcttagaatcatctaaagtgtacatttaactgatcacaaagaagaggcagtgggcatcagtggagccaaggaaaagaggaaattatttctattactggtcatgcctacagggtgttagttactataaagaatatttaaagacaaccttgtagctactgaaaaataaaataaaaaaagtttttaaagctaaagtaaaaaacatggccttattgcttttttagaaaaactgttttcctgtattctaagattttctatataaagcatcttccatcccactctcatagatgcacatgataaaaccgtgcaggtccatgtgacctgttaagggtctcttcagagaaaaaaaatttttactttttacttttcctcccagcaaaggaaggagttaaaagtaaggttcttacaataatctctctttgaggactagaaactattttctgtatcagtcccagaagggcttgtcatcctgcagcttaatggtagtacaaaagaccactgaatcagcatccagggctctaatccagcattctaaactggctaaggcactaaaaagataagtgactttcatcaagagccacgctctgctggccacggcggctcaagcctgtaatcccagcacttaaggaggccagggttggtggatcacttgaggtaaggagttcaagaccagcctgccaacatgatgaaaccccgtctctactaaaaatacaaaaaattagccaggcatggtggcgcatgcctgtaatcccatctattcaggaggctgaagcatgagaatcgcttgaacccgggaggcagaggtaggagtgagctgagatcgtgccactgcactccaacctaggtgacaaagcgaaactctatctcaaaaaaaaaaaaaaaaaaaaagactcaggctccttcagtccttcatttttccctcagtgaaaacatggaatggtttagggcaatggacttcaaactgtgttcttcaaagctgccttggggagcaccccaatggacaaggggaaggccaggcggcaaggaccaagctctcacctgccaattctctcagagtagagccaccttttccgctttatacataatagagttctacacaagatttattttattattattattattattattattattattattattcgagatagagtctcactctgttgcccaggctgcagtgaaatggcacaatctcagctcactgccacctccacctgctgggttcaagcaattctcctgcctcagcctcccgagtagctgagattacaggagcatgcaaccaggcccagctaattttttgtatttttactacagacagggcttcatcacgctggccaggctggtatcgaactcctgacctcaagtgattcacccaccttggcctctcaaagtgttgagaatacaggcatgagccactgtgcccggcctacacaagattttatttcacaaagcattctgctactacaaagtaaggctgaaaaacattgatccaggtgctctgtaaagtccaggccactccacacattttcagacccacagctatacacgatgtatttcatctgtgaaagatgtagtcaattttacattaattctgcaattaacattcagtaacatcttattttaggataaaatacatcatgcccaatccccccaaaaaactatcaataggatattctagaaataaaaataatcaacaggataagattccccataaaagtgactgaaggccgggcacagtggctcacccctgtaatcccagtactttgggaagatgaagcaggcggatcgcctgaggtcaggagttcgagaccagcctgaccaacacggagaaaccccgtctctactaaaaatacaaaattagccaggcgtggtggcgcatgcctgtaatcccagctactcaggaggctgaggcaggagaatcgcttgaacccgggaagcagaggttgcagtgagccaagatcacgtcattgcactccagcctgggcaacaagagcaagactccatctcaaacaacaacaacaacaacaacaaaagtgaccaaagtagctagctggcatcaaacacagtggcaacctttgtaccctggatgttagaagtaatgacagcacctggtgaccaaatgaagcacccagccacaaaagtaggactgccaagtgccaggaatttcttttaagtaaattatccatcttatctctactacatctcaatgaaacttcggcttcctggggatgtttattcctagcttacagtctttccttaccctttctcccaccctatctactaaacctgcccaacacacacagtccatccagagacacatctaaatttcaggagtttgggggatacaggtacccacactatatgttcacaaagttgaatgacagttgtatgttacaacatacccaagtttaatgcattcaatcatgtcatctagatgctccttcttattcctatccttttaggctccatattctaagactgatttgaaaattataatgccgaaaaatatttacattaataatgtttcaaagagatgcctgaaacaatgcactctggaactgacaagccaatttttttaattaattttttttctttctttttttttttttttttgagacagactctcgctctgcaccccaggctggagtgcagtggcaccatctcggctcactgcaacctctgcctcccaggttcaaatgattctcatgccttaccctcccaagtagctgggactataggcgtgcaccatcaagcctgactaattttttgtattttagtagagacagggttttaccatgttgcccaggctggtcttgaactcctgacctcaggcaatccacccgcttaggcctctgaaagtgctaggattacaggcatgatctactgcgcccggccggattattaattttaaacttactagcaaagctttaactagaaagatgtctatgtggagcgtaattcaaacatcagtaacaaaacatggacatatacattttgtaggatttatctagtgaggctaagaattcaacataaagtattatatatgcccaaatgtaagtcaaggtattttctcaaacagtatccctcaaaaaagtagtttcgatcaggcatggtggctcacgtctgtaatcccagcactctgggagcccaaggtgaatggatcacttgaggccaggagttcaagaccagcctggccaacatggcaaaaccccatctctacgaaaaatacaaaaatcaaccaggcatggtggcatgtgcctgtaatcccagctactcgggaacatggtgaaaaaaaaaaatcaagttagtcattaaattctgacagtaataaatgtaatttgcagaaaataaatttttaaaactgtcccactgttttgcaaacaggtagtttacaaaaataaaaaatatccagtgtcagtatcatatatgaattcaagaaatactgtatcagtagggcatggtggctcacgtctgtaatcccagcactctgggaggttagggtgggaagatcacatgagaccaggagtttgagaccagcctgggcaacagtgagaccccatctctacaaaaaaaaaaaaaaaaaacactagtcaggtatggtaggtagtgcatgcctgtagtcccagctacttgggggcctgaggtgggaggatcactagagtccaggaggtcaaggctgcagagtgagaccctgtctcaaaaaaagaaaaagaaatgctataatgctaactgtttagactgtgggaaatatgatgttctctctctctaccatctccacagctttgctgtaaatttacagttctaaaaacataattaaaaaatatgttccctgggccgggcacagtggctcacacttataattccagcactttgggaggcccaggcaggcagatcacgaggtcaggagatcgagaccattctggctatcacggtgaaaccccacctctactaaaaatacaaaaaaattagccaggcgtggtggcgggcgcctgtagtcccagttactcaggaggctgaggcaggagaatggcatgaacccggaaggcggaggccgcagtgagccgagatagcgccactgcactccagcctgggtgacagagcaagactccaactcataaaaaaaaaaaaaaaaaaaaaaaaaagttctctagaaaaccatttaactgattcaaaaagcacttataatgataatagtcattgctgttgcaaatctgaaatgtctacataaaacagcttcataaaacaagagtggaaaagcagtatttctaaattaatgtaaaattttatttgtgaattgaaaaatatttgtaactaacttaagaaattaaatatcataagtagacatttgactatttcatgtatatccataaagtttacatgctcaaattgtcataaaatttaatcttctcactggggaatgaggaaacttagaattagggctgccttatactgagctatataaagcataatacaaactatgaaaggttcctttggagacatacacaacaaccaaataaagcaccccaacccaaacaaaggaaagaaaaaactctctgagcactaactattcacacaagttgtactatagcaccagaagattccatcaagttgctctaccttcacctttggttggtggtcatgcgcctagaattaaaaaagcctataagcttaagaatctggcaactccaggtaatgattttttttaatattgccttatttgaatatatgtaataatttttcctctttgcaaacagaatacaagacaatattaaaaatctgtgagtacgactgggcatggtggctcacacctataatcccagcaccttgagaggccaaggccggtggatcacctgaggtcaggagttcgagaccagcctggcaaacgtggtgaaaccctgtctctactaaaaatacaaaaattagctgggcatggtgtcatgtgcctgtaatcccagctacttgggccactgaggcaggagaatcacttgaacccaggaggcggaggttgcagtgagccaagatagcgccattgctctctagcctcagcgacaagagtggaactccatctcaaaaaaaatctgtgggtcctattggacctgtaatacaaacagagcaagacaaaactctctctaatccttagttccaacatagataatactacccacctataccaactaatgaaataatgataaattatttataaactgtcaagatcagaaaaaagatactaatgctaatgatatctgaaggccatcaacgataaacaaacgtaataaatttttctcaaatctcattctccttagacttctctccctcaaccggtttatcctttaactttccttcctttactttgccacaaaaaaaaaaaattttttttcttttccttttttttttttttttgaaacaaagtctcactctgttgcccaggatggagtgcagcggcatgatcttggctcacttcgacctccacctcccagattcaagtgattctcatgcctcagcctccctatgaactgggattacaggcgtgcaccaccacatccagctgatttttgtatttttaatagacatggggtttcgtcatgttggccaggctggtctcgaactcctggcctcaagtgatccgctcgcttcggcctcccaaagtgctgggattacagatgtgggccaccgcgcctggctcacaaaagacattttctaaatttcagaccaagccctcttctctccaccatcctctttcctgcagtaagctgaccttactgtcgtaagtgctttaaatgtctccttgaagtcccagcttcccacctgcccatcagctccctgtaccatacttccttttcggttctagtcactttcaacttggttatgcctaaaacaaagtctccctcatctccaaacaatttctcccgactttctttcttttttgagatggagtcttgctctgtcgcccacgctggagtgcagtggcatgatcttggctccctgcaacgtctacctcttgtgttcaattgattctcctgtctcagcctcccaagtagctgggattatggcacatgccaccacgcccagctaatttttatatttttagtagagacggggtttcaccatgttggccaggctggtctcaaactcctcacctcaagtgatctgcccaccttggcctcccaaagtgctgggattacaggcatgagccaccgcgcccagccagtttctgccaactttcttattcttcattaagtataacagtctaagtcaaaaaaacctttaattttgtcattttgtattgcttttctcttcatgtcccatagttaattagtcctactcctgctgattcttctttaaaagagcttttccaaaatttaagagccttaaaaaggttcaatgtctttgacctaatatttccatttgcaggattccacctagtctaagaaaatctgaaatgcatacaaagatattcactgaagtaataccatgccagaaaactggaaacatctgtctagcaatagggaaatatttaagcaaataaaacaaattagaatgttagtcattaataattagttatgaagtttttaaagacatgaaaaatatacatatatttttttgagtcagagtctcattcggtcgcccaggttggagtgcaatggcgccatctctggcttaatacaacctccacctcccgggttcaagcagttctcctgcctcgcctacggaggagctgggaagggattacaggcgcccgccaccacgcccagctatttttgtgtttttagtagagacagggttgcaccatattggctaggctggtctcaaactcctgacctcgtgatccacccgcctcggcctcccaaactgctggaattacaggcttgagccactgcacccagccagcccatgaaaaatatttataacaaaatgtaaaataaggaaagcaggatacaaaatcatatataagagatgataatgtaagtaacaaaaacacaggaagagaaaaaggccagaaggaaatataacaaaatattagcaacatcctatctgtgcatatcatgctggctggtgagaatatgagtcatttttgttttttgtctttttatactcctataatttctagatatggcatataatatttttaaaacctggaaaaaatttatgtttaaaaaaatgtgttgctaattcaagactcttcaaggtctccctaagtaaactacaaattcaatattaacccaacccaatagcaaaacaatactgagatagggacttgaaaatatcatcttaatgaaaaaatatgcaagaatggcccccaaaaatataaaatcaagtgtaacaagtgggtatgggggtataagagagcccttgcatttccaaaaactgaaatgtagtcaggccaagcacactggctcacacctgtaatcccaacactttggggagccaaggtgggaagacagcttgaagccaggagtttaagactaacctgggcagcaaagcaatacccatctctattttaaaaagaaaagaaaatgtattcaaaatcacagcgatcaaggtaacctggaactagagcaaggacagagaagtcaacacactcaagtacaggtggaaatacaattgagttagcacaactagataagctatttagaaataaataagcaagcaacaaaagcctaacaaccacaaaacggccaacctttactgaatatttaccacaggtccacaatccttgggaccagatgtttcgctattcaagttttttgggttttccaaaggtaatatggcacccatatcatgtattatgcaatattccagaacggtatggagaagctcaccataggtattttaaaacatgcaacttatagctgggcacagtagggcaaacacctgtagtcccagctactcagaaggctaaagcaggatcacttgagcccagcagtttgagtccagcttgggcaacgtaatgagaattcatttcttttttttttttttttttttttttttttgagacagagtctctgtctgccacccaggctggagtgcagtgtcgtgatctcagctcaatgcaagctccgccttcccaggttcacaccattctcctgcctcagcctcccgtgcagctgggactacaggcgcccgccaccacacccagcaaattttttgtattttgtttagtagagacagggtttcaccatgttagccaggatggtctctatctcctgaccttgtgatccgcccgccttggcctcccaaagtgctgggattacaggcacaaatcaccacgcccggccaaaaattcatttcttaaaacacacacacacacaaacacacacccctacggcattcttcatctcagagcaaagagttgtagtccgtctaccctcaccccatcccatccctatccattgaaaacctgtgctataatcccactacttcctgacaactcaggatttttgctccaaataccccttttcttgcccatattttcaacctctaactttctactagctccttgccatcctttttttcttttttttttttggtgaggggagggtatagagtctcactctgttgcccaggcttgaatgcagtggcacgatctggctcactgcaacctccacctctcaggttcaagcaattctcctcctcagcctccataatagctgggattacaggcgtgcaccaccactcccggctaatttttgtatttttagtagagatggggtttcgccatgttggccaggctggtctcgaactcctgacctcaggagatccacccacctcggcctaccaaagtgctaggattacagtagtgagccaccacgcccgcccccccaccccccttttttttttaataaaaagcaccttttctcctttacacacacacacacacacacacacacactaaaaagcttattcaataactaatcttaagaaaaacaaacaaaacaaaaaggaccctgctctatcttcctattcacttttacagctgcaaggttgcttttattttaaaacactgtgctaagatagttccagctatagtctctaatgattttctaactgccaaaagcaaaggccaagattaaggctcatctcacttgaattttatctgcagactaacactgctgaccacgcccttcttgaaatgctgtattcccttggtttctgtaagacaactttctcctgggtctcccatctctctggctcctcctttaccaaccctacctgtagccttctcttcacatgttaatgcaccttcattcagccagttccctaccatcagctatacctgacaactcccaatatatatcaccctcaacagagctcttcccagtgctctagctataaacactgaccaaacagctcttaaaggaatttatatagagacctcaaaaaggctggccaggctgggcgcggtggctcatgcctataatcccagcactttggggggcggaggagggtggatcacctgaggccaggagttcaggaccagcctggccaacatggtgaaaccccatctcaactgaaaaaaaaaaatacaaaaattagccagccgtggtagtggcactgtaatcccagctactcaggaggctgaggtgggagaattgcttgaacttgggaggcagatgctgcagtgagaactgagatcgcgccaccgcactccagcctgagcaacagagcaagaccccgtatcaaaaaaaagaagaaaaaaagagaaaagcctggccaaagtcaccattaatttttccgaaacacattctgcattccctattgcaaaaaatggcaacaccacccataaatttagctaattcagaaacatggaattaatcctagaaccctcccactctcctctcacattaaactggacactaagtctagtggattctggccccttaatatacatcagtctcctgaagcctcatgcaatagcctcccaatggagcccctggcctctaagcaactccccacacaatagctaaaggaatctttctaaaaacctgagtgtgtaccccttaacagctccccagtccttcgtttgacttcctcagagccctatttattgcttaccacaccctgcactccagccctactaacctgcttgacattccaagactacacgccattttaaaccccacatgttgacaccaactgcagtgtttcttcggcatggaaggtccttgccctgcccccttattttacttggagaattactggttcttccagaaccagtttagaatgccctcctgatttccagtttgcttttagattacaaaatgatatccataatgattagaaagatacataacttatacatacatccgaaaaagaagtcatctgaaaatctacaaatttttataaatcagtaagaaaaacttacgacacaatattttttttaaagggtagggggcaaaagacttaaaaaggcgcttcacaaaacaggaaactcaaatgaccaagaaacatatgaaaagatgttggctgggcctggtggctcacgcctgtaatcccagcactttgggaggccgaggtgggcagatcacgaagtcaagagatcaagaccatcctggccaacatggtgaaaccccatctctaccaaaaatacaaaaattagctgggcacggtggcacacacctgtagtcccagctactcaggaggctgaggcaggagaattgcttgtactcaggtggtggaggttgcagtgagccgagatcatgccactgcaatccagtctggcaacagagaaagactccgtctcaaaaaaaaaaaaaaaatgatgtttaacatcattactcaggaaaatgcaattgaaaaccataatgaaatatcaatacacacccataataggtaaaatttattacaatgacactgccaagtgtgggcaaaaatgtgaagcaaacttaagtgtctttacacttgtgggagagtaaagtagttcaatcaaaactacatctttgagcctgggcaacatagggagatcccatctctacaaaaaattttaaaatcagctgggcatggtggtgctcacatgtagtcccagctactcagcagcctgaggcaggaggatcatttgaggccaggaatttgaggtggcagtgagctatgattgtgccactgtcagccaacaaagcaagacccagtctctaaaaaaaaatatatatatatatataaagtcagccctctgaaactgtggactctgcatccataggttcaaccaatcatgaatcaaaaacaatcaaaagtaaataaataataacaaaataaaaactacaaattaaaaaaacaccatgtaacaaccattgacatggtatttacattgtatatatattattagtaatccagagataatttaaaatatacaggaggatgtgtgaaggttacaagggacttgagtatcctcagactttgttatttgagggtgtcccagaaccaatcctccaagcgtactgagggatgactgtatattctatatgatttcatttatatgaaattcaagaacagacaaaactaatcaataatgatagatatcaaaaaagttgttgctcctaggtggtagagtatagactcgggagaggcatgagaaaacttatggagcattgaaggggttttatatactgatctacatggtcgttacaggggtataaataaatgtaaaaaaaatcatcaaactgtacaattaagacgaatgcactgggccaggcgtggtggctcacgcctgtaatcccagcactttgggaagccgaggcgggcagatcacaaggtcaggagatcgagaccagcccggccaacatggtgaaacctcgtctctactaaaaatacaaaaattagctggggagtggtggcacgagcctgtactcccagctactcaggaggctgaggcaggagaatggcttgaatcggggaagcggaggttgcagtgagctgagatagcgccactgcacaccagcctagcgaaagagcaagactccgtctcaaaaaaatatgagtgcactgccaggcatggtggtaggcacctgcagtcccagctacttgggaggcttaggtggggtatcacccaaacccaagagggtgaaagcggcctaggcaacaaagcaagatcctatctctaaaaaagaaaattaaaattaaaaatgatgttttatccttaagagggagtttcactgcgtcgcccaggctggcactaagtggtgcaatctcagctcaaagcaacctctatctcccgtgttcaagcaattctcccacctcggactctggaatagctgggactacaggcatgtgccaccactcccagctaatttctgtatttttagtagagacggggtttcatcatgttggccaggctggtctcaaactcctgacctctagtgatcctcactgatctttaaaagatcaatgcactttacatacatgcatatacatgtatgctaggactcaatttttgaaaaatgaacaaaaccatgcacaagtaaaagaataacacaccaaaacaattagataccctaaattaacatgctaaaattttttttttttttttttttgagatggagtctcgctctgtcgcccaggctggagtgcagtggcgccatctcagctcactgcaagctctgcctcccgggttcaagcaattctcccgcctcaccctcctgcatagctgggattataggcacatgccaccacgcctggctaatttttgtatttttagaagagacggggtttcgccatgttggtcaggatggtcttgatctcctgaccttgtgatctgcccacctcggcctcccaaagcgctgggattacaggcgtaagctaccacgcccagctgctaaaaaatttttaaattaaaaataattagtggagccacagctgacacttgcttcttaaatcttctgtattatactgaattctgtactgaattttttaccatgaccatattacttttattactttaaaaaaaaaaaaaaaaaaaaaaaaagctgggccaggggcagtagctcatgactgtaatcccagcattttggaaggctgaggcaggcagatcacttgaggcttaggccaggagttcctgaccaggctctactaaaaatacaaagaaaataagctgggcatggtggcgcatgcctgtaatcccagctacttgggaggctgaggcatgaggagcgcctgaacccaggaggcagaggttacactgagccaagatcatgccactgcattcctgtctgggtgacagagcaagactgcctcaagaaaaaaaaaaaaagttatttcattaaaatgacaatattaaaatgaaatctggccaggcgcagtggctcaagcctgtaatcccaacgctttgtgaggccaaggcaggtagatcatgacgtcaggagcttgagaccagcctggccaatatggcgaaaccctgtctcagtgagccaagaccaggccactgcagtccagcctgggcaacagagcaagactccatctcgaaaaaacaaaacaaaacaaaacaaaaacaaaaaaactaagcactactgtacctaaatcttacagttctcatcacactgtcctgcaatggtcttttcacaaagcaatctcttctactttaattatcttactcttctagcatccaacacacaccctggcactagctatctgcagcactaggtatttgcttcgtgtccatttactgtattctactgtagaggtagtaagcaaaaatgtttgttgaataaacaaatgtgtaaaaaaataagaaatgaaaattaggtaatccatgagaagtattccaaagtcatgggcttatgagcttgaatttatactacagggaagtataaattcaagggttgaggcttactgaataaggatataaacttgtatcattacattccaaaactgtctcaccaagctgggcacggtggctcacgcctgtaatcccaacactttgggaggctaaggcaggcagatcatttgaggccaggagttcgtaaccagcctgaccaagatggtgaaaccccatctctactaaaaatacaaaaattagccaggcgtggtggcacatgcctgtagtcccagctacttgggaggctgagccaggagaatcgcttgaacctgggaggtggcaggtgcagtgagccatgattgcgccagtgcactccagcctgggcgacagagcaagatgccatctcaaaaaaaaaagtagaagcaaagtatacccagatatcctttagcctgtgaataaactgttaatccacacaatggaatacttgttaccaataaaaaggaaagcacagccaggcacggtggctcatgcctataatcccagcactttgggatgccaaggcgggtggatcacctgaggtcaggagctcgagaccagcctgaccaaagtggagaaaccccgtctctacttaaaatacaaaattagcctggcatggtggcacatgcctgtaatcccagctactcaggaggctaagtcaggagaatcgcttaaacccaggaagcggaggttacggtgagccaagatcgtgccactgcactccagcctgggcaacaagagcaaaactccatctcaaaaaaaaaaaaaaaaaaaaaaaaaaggaatgctctgctcacacaggcaacaacatggatgaatctcaagggcattacgctgcatgaaaaaaggcgaatcacaaaaggtgacatactgtataattccatttatataacattctcaaagtggcaacattaagtgatagagaacagatcagtgtttcccaagcttagatttgaagagagagtgactgttctttgtggtaatgaaacagtttggcatcctgactgtggtgattattctaatctacacaagtgacacaatttgttagaactacacagagagtgcatgtaaaactgataaaatccaagtaaaatctttcttgaattaataacattgtctcaatgtcaatttattggtttcaacaatgttctatggttaagatatcaacgtcagggaagttgaataaagagtacacaaagaactctgtaccacttttgcaaggtcttgtgagtctgaaattatttcaaaagtaaaaattttttttttttttttttttttttttttggagacagagtctcgctctatcgcccaggctggagtgcagtggcacaatctcggttcactgcaagctccgcctcctgggttcacgccattctcccgcctcagcctcccaactagctgggactataggtgcccgccaccatgcccggctaattttttgtatttttttttttagtagagacggggtttcaccgtagccaggatggtctcgatctcctgacctcgtgatctgcccacctcagcctcccaaagtgctgggattataggcatgagccaccgcacccggcctcaaaattaaatgttttaataaaaattttacaagaacaaaaaacaaaacagaatttttttttttttttaattgagacggagtgtcgctctgtcacccaggctggagtgcagcggcatgatctcggctcaccacaacctccgtctcccaggttcaagcaattcttctgcctcagcctcccgagtagctggaactgcaggagcacactaccatgccaggcaatttttgtatttttagtagagacggggtttcaccctattggccaggctggtctcgaactattgacctcgtgatccgcccacctcatcctcccaaagtgctgggattacaggcatgagccaccacgcctggccagaaatagaaaaattttaaggaacaatggataaatggataaaatgtggcatattgacacaactattcaacaatataaaggaattaagtactaatacgtgccataacatggatgaaccttgaaaacattgttctaaggaaaccagacaaagccacatactgtatattccatttacatgaaatgttcagaataagcagattcatagagacttagaatgtaaattagttgttgccaacgcagggggaaggggaatggagaataactgggaaataaatatggagtttctttctggggaagtgaaaatgttatagaattagataacggctgcacaatttaatgaatagactaaaaatctgtaaatggcctactttaaaaggtaaattttatggtatgtgaactatatcccaataaaagttatgaaaaaaataaatgaaagagatattttaaaaattgtacctccatataaacatactataaggcaaaaatttatcccaagctatgtgatgtagctaattcctaagatttgtgactaaacagcactacagtccttccgttctgcctgttactcacaaagcagcacaattaataataagcaaactaaactcacaggacaatctaacaggattaaaattttgacccactaaataatcttaatcttattcctgacaactacaatttccagtgtaccataaaagtagcctctaggaactggctcaattcataaaagctcacagatttgaaatgaactaaaattaattaaaagcctgcttgtatatacaaaagtagataatgacaaaagtaaatcatattataccaagccagacccacagtcacataattcaagtttgccagtcatcatattaatagtttaaaattatacctattactccttttcctcctctggaaaattaatcaaaaagcaaaaaccgtgcttcaagagacctgaattctgatccaaacgaagctattgtgggcttaacctgtcagagctgtctgtaaaattcggggtaccctgaaaatactagtctcctggagattcttttaccacttctcaggtgccactcctcacacactcaacgtcacccggtttcccatgcactactgcaggccacttctgtttccactactacccccatccccacaatctattctccacatagcaacctttttttttttttgagacggagtctggctctgtcgcccaggctggagtgcagtggcgcaatctcggctcactgcaagctccgcctcccgggttcacgccattctcctgcctcagcctcccgagtagctgggactacaggcgcccacacgcccagctaattttttatatttttagtagggacggggtttcaccgtgttagccaggatggtctcgatctcctgacctcgtgatccgcccgcctcggcctcccaaagtgctgggattacaggcgtgagccaccgcgcccggcatttttttttttttttttttttttttttgagatggagtctcgctctgtcgcccaagctggagtgcagtggcacaatcccggctcactgcaagctccgccttccaggttcacgccattctctcgcctcagcctcccgagtagctgagactacaggcgcccgccaccatgccgggctaattttgtttttgtatttttagtagagacggggtgttagccaggatggtcttgatctcctgacctcgtgatccgcccgcctcggcctcccaaagtgctgggattacaggcgtgagccaccgcgcccggacagcagccctctttttaaacaggaatcagaacctgtcccttccacatgtaagcctccaatggcctacgagggtagacacgctctgactcctgcctcccatcaacctctctgggccactcaggccactcttacttttgggtttctcgaatacttccagcccattcctccccagggcctctgccacactggatctcctcctcattctcgatcctgcccaaatgccatttctcagagagtggactctggtcccgggctgccttgattcaacagctgggcatgttacttacttttcctgtgtccctgtttcacctgtaaaatgtccgtaataacggtgcctacctcttagggttgtcacaaggtatatgtaaaacaatcgacagagtgactggcacagtgttcaaatgtcatctattattattacttaacatgtcccatcttcattttcttcctatcccttagccctatctgaaattatcttgtcaccctctttgtggttttccccaaacctcccaaggttagctttgcaaggagctttgtcttgttcaaaactctatcaccggccgggcttggtggctcacgcctgtaatcccagcactttaggaggccgaggcgggcgaatcacgaggtcaggagatcgacaccatcctggctaacacggtgaaaccccacctctactaaaaatacaaaatattagccgggcgtggtggcgggcgcctgtagtcccagctactcaggaggctgaggcaggagaatggcgtgaattcgggaggcggagcttgcagtgagccgagatcgcgccactgccctccagcctgggcaacagagcaagactcggtctcaaaaaaaaaaaaaaaacaacctctaacaccatctccgaagacagacatgtaaatacctattgaagacatgaataaataaataacatcaaacagttcttttaaataatatcttgattcaggtcgggcacggtggctcacacctgtaatcccagctgtgtgggaggccgaggccggtgaatcacctgaagtcaggagttgtagaccagcccggccaacatggtgaaaccccgtctctactaaaaaatacaaaaaaaatagctaggcttggtggcgggtgcctgtaatcccagctactcaggaggctgaggcaggagaatcccttgaacctgggaggcggaggttgcagtgagccaagattgggccattgcactccagcctgagcgacaagagcgaaactctgcctcaaaaaaattattaaataaaattatgacttgattcaaagagttaagtgaaaaatggcaatgcctcaatcagttatataattgggctggtcccgttaccttacagactagagccagttcgtttcatcattagctggtgtgttattttccccctcaaattctatcacatatacacaatacacagtgggagaaactggcagattaatctgtgagaggaaaagctgagtactgtggctattcactaagtcttcatcaacataccacataaatccaaactgcggcccaccaaaaaggccctcgaccattaggaaaatcatactctaatatatgcaaatacaagacacatattgacttaattagaactgtttttccacatgtacgtaaaggtaacatgcacatatacgtgtctatttgtatatacatgcacacatagccatctccgacactggggtcatactttttccacttgtttttatgtttctgagtataacagactacgtggaattaaatcaatgctttgaattaagagctgtgattaaaacacagtacttattcagaatcctaaacattacagttctccttaccactgggtaaacttccatggttcaccaaaggaaatctcaaatttaaggttgtaattcacttgaaagctagcactaatttttttaaaagcaaccaaaactaccaaaaatccagtccattttaacatcttatgaattcaatatccaatttttaccgaccaattagttcttcaactctttaggaagtgctttccccttactctaatggttttttcttttttttttttttttaaggtatttttaagtcactatccacattttgtgaaactgaaggaccaaggccaacgagaaggggaaaaaagtgagcgtgctgcgacgtacccctcaaaggaaacaaccaaaaatgtttctggattttattaaagataatgctggattctcgttccccacagtaccaaagatgccacacagagtattcttgctcaaaagagcgaagcaattaatctagaggaagagataacgatgtcgaacgctggtaaatcaaaaaaattaggagagaggagtggaaaaggagaagacgcggcggcgctgtgcggtctcggagcagctctccaggaaagggttcttgggcagcggcccccctgctcgggtgagcggccaggctggaggtggccgccacgggcgcgttttccactccgaccggctcccgcgcacacgcccaccgccctgcgcagcccgcgaccccggcgcccgcagcgcacccaagtcacgctcaacccgagcggaaagtttcgaatccaaacccgagagccgaaacgcacaggtctcggggctgaactcgcgccaggaacacgcccgaggcaaaccacttgacaaccagcttaggttctcagcagaaaggccgacaggcgggggccggggaggaaggggaggcgagacacacgccctcccgcacactcggcccctccgcctcctcggcccgcggctcaggtgggagcaacgcagccgctgcactcccgcagcgggcgggccggagcccagcggcagacgccggggccccttccggaaagggccgcgacccccgggccagctcgcgggcaagggacgggtgcgcacgccctgcccggcgcctttccgccggcctcccgcccgccggccggtggcgacccggggcgggaggtcgcggggtcgaggctccgtgatgctagggaaccggccgcggcccgcgcgcccctcccccgccgccgcccctccccccgggccgcccgccgggggcaggagccgagcgccagcgtcccgggggaccagcccgcccgccggcccggggacccggacaactttcccctgcgcggccgcgggcgcccccgacggggcgggggtggggaacggggacaggcgcagcgtggactcactttttcggatgtttctctcttttcggcctccgctttcgggcctgaatggccagcactggggaagagaagacacacattaacggtcgggccgcccgcccgggctggccgcgtggcggggagagggcgcgccgcgggccactcacctttccgggagctcattccgacgcggcggaagcggggcggggggcttcgcgacggcgacgcgggcgccgagacgagctgggctgcagcctccactcgctccgcc

SEQ ID NO: 1385 - DNA, 110869 bp, Homo sapiens
attgctaagccatccttcagacagagagggagcggctgcaagaggtaatgaggtatgtttgtgaaccttgtattcttttacggttacagatgtgtgtctacaagtgtgtgtgaatttgagttgatctcttttagtcaaaatgcccttgttggccgggtgcagtggctcacacttgtaatcccagcactttgggaggccgaggcgggtggatcacgagatcaggagatcgagaccatggtgaaaccccatctctactaaaaaaatacaaaaaattagccgggcatggtggcgggcgcctgtagtcccagctactcggagaggctaaggcaggagaatggcgtgaacctgggaggtagagcttgcagtgagccgagatcacgccactgcactccagcctgggtcgtagagcgatactccgtctcaaaaaaaaaaaaaaagcccttgttaatttgttaaacacaaagataaacaacaccaataataaatcaaaaattatgcacatgcatacacatggaacaaaattctcatttatctttttttcttagtgtgtgtatatttttctgaactaaggctggatctataagcctgattgtagtgaaacctgtgtgtttgtgtgtgtttctgtgtgaggtgtgatgaattatttaatacttaggttgaggtagcaggcagaaattctttcagattctggaaatgaagtgagagaaatgaataaaaggagttagaatttgggagtgagattagagcattttccctctgaaaggatttggagttgtgattgagaaaatgtaactgaagaaccaattataatcagaaaattgagaaatatatcactatgcttatgggtttggtgcctctgttgattaaatacagaataattttaggggatagtctgaggatgtgtgtaaaatattgggatgcatttatgagttggtgtgcattggtgggtaggagaggtttcctgtggaatgtgggaggaggtcataaagagaaaggtagggtatctgtcctggcagtcatgtgtggagtagaatgggagtgctcgtgggaagaggagaaggtgataaattgttgttggcccttaaacttaaaaacttaaaataaaatacttaaaataaacttaaaataaaacttaaaataaaacttaaaaaaagttggatccttactagttgccagtctagctagacacacgcaggcatttcttttctgactggttacagaggtgggaagggagagttactcttggggaaagagagagaaattgagactaatccccatgggtctccctgaaaaaggataccactaggttcttcatgcaggatctgatcagtggctttgctgggcgaggaagacctcccaatgtccaaactgtctacagtctgtgtcctggtgtgggacagtaagtgtatgtctgtaggtgtgcaaagagggggtgagatggagggggtctttggtttgttgtgctggtaggtccctgtgctaccagggaccaaatgaagtgggacactaaatttaagacagcttgttgctatttcagtcacactctcacaagatgccaatgattattttttattatcaggcattccctcacaaatacattttaatgagctaataaaattactataaaaattgttctataagcatggaatggaactagaaaagaaattttccatttaaaatttgttcaggtggcagctgtggaatgtgatgagaaatataagcctttgcacaccctgttgctgggctcaaggaggagttagctgtctcctagagatgatccttttgcagttcagatggggaaactgagacccagaggggttaagtggatttttccaaggtcatacagctggctagggtcagagctgactcttaaatctctcaccttgggtgtgaccagacttggaagaaaaaagccattcattagctaccttatcccttcccattcaccaagcagctgggaaaggatggcccaacctactaatatcgcccagcatttttgatgaatagctatggctcactggggtcctctttgcaagttgttcttagtctatctatccacaatgaatcctcttttccactagatctcatgtcttgtgttagcaaaggattttaaaagaatggcttagacctccatatacacatcaaacgctggctataatgccggaaagaggacaaatatccagtttttccaaattaatttagatagccattttaataatttgggcccccatgtggtttgtctactttgcctaaagaactataatggtaccaggacaatgagctttgacaattattcatatactaaataattcaagaagaaaaaaattctattgcttttgcgtaatgtatatatagtaataattctttttttaaattttactttaagttctggaatacatgtgcagaatgtgcaggttcgttacatgggtatacatgcgccatggtggtttgctgcacctgtcaacccatcatctaggttttaagccccacatgcattaggtatttgtcataattctctccctcccctagcccgccatcccctgacaggccctaatgtgtgatgttcccctccccatgtccatgtgttctcattgttcaacttccacttatgagtgaaaacatgtagtgtttggttttctgttcctgtgttagtttgctgagaatgatggcttccagtttcatccatgtccctgcaaaggacatgaactcatccttttttatgactgcatagtatttcatggtgtatatgtgccacattttgtttattcagtctatcattgatgggcatttgggttggttccaagtctttgctattgtaaatagtgctgcagtaaacatacgtgtgcgtgtgtctttatagtagaatgatttataatccttcgggtacataccctgtaatgggattgctgggtcaaatggtatttctagttctagatccttaaggaattgccacgctgtcttccacaatgcttgaactaatttacactcccaacagtgtaaaagcgttcatatgtatatagtaataattcttatatttcagtaagattattttctgaccaacctaattaaaattgccacccttaccccaacattcctcatttaccccccactttttctccatatacttacacagtataacccagtgtatatttatttattttgtttattgtctcttttttctattcatgggaacataagtctcatgacggcagggatttttatctgttttgttcattgttgtgtagtcagtttttgaaagaatgcttggcacattgtaggaacttaataaataattcatgaatgaataaataaactgcaagcagatttctttcttccagagatgtagtttagataatgatgaatgatcttggcaaatgaggcacatcagtagcttcttctaggtctcccagataatttaaaacgtgctatgggccataaacttaatgtgtttttatttgataaaactataatctcacagaaagcccaagctggtgtacactgtggggcattatagcatagaatacagagtgatggttaaaagccatggctgtggagtccaaagggcaggtgttcaaattgtggctttgctccttatcagctgtatgatgacatcaggcagtttatttgacgtttctgaagcttagttttttcatctgaaagtgaggatagtagccatgattaacttgcagtcgttataaaaatggcatgtgacaaattatggaaacctcttaggatatctgctcaatcactgttaaccattattatcattagcattaaaattgcatagttatatatttgtcctataaaaaaatagtcaaagattaaggacagattgccaagtagcagttttttaaaaaacatttttaaaagcccttaaccctatttaaattatttccttttttatttgcgtcttgccatttttcctgatcttagtttttcttcaattgcatttctaattgagataggaagcttcaccatcaagagttctataatgcaggaagtaaggtcaatcagataatgctggagttttttttaaggtttaaggaaatctttctcttgtatagctagaaaatagatattattgttccatagagcaagtaaccatatttgaaaatatggagcaaaaggactattaataaacagcaaacatgtttttaaaaatatgctaatgatattttattaaaaagtcatatttacctatgcatattggttatctattgcagggtaacaaattaccttacaattttgtagtttaaaacaacaaacatttattatctcccaatttatgtaggtcagaaatatgggggtgagttagccgagtggtgctgatttagggtctctcatgaatccagccaatatgtcagccaggactgtagtcatgtgaaggcttgaataggggtagaggcttgctttcaagggacctcactcagatggctcttagcagaagacctcagttctttgctagaaatttccatagtcctgcttgaatgttatgatggcatggtaactggtttcttcaggaaatgatccaagagaaagagcaaggaggaagctgtaatgcctagtcttggaagttagatgccatcccttctccacatcctatctgttgaaagtgagtcactaagtccagctcatcctcagagggtgaggtggtggggactcgccctacctcttgaagagaggagtatcaaataatttgttaaattaaaaacacctgccgtgtgatgattttaaataacattgaattatattttacttcacgtatttactgattgctgtctctatggatatttacacttttttgctattacgtgtaatactgtgatgaaaaacctttatttgtatatacattgattcccaagtgtgtaagtgtatttaagggatgaatttctataaatgcaattgctgggtaatgggcatgagtaattttaatagtttttaccaagtcttcattgagcatagggtgtttatagtttgaccagcagtcggtgggtgtttcttcatagtgtctaacatagtgtgttaataaacacttggaaaaaaattaaatatttttataaaaagcaatctcacatcttacaactattagcatctaccaaagaggaggcatggtcacttggatagacattctaactcctcttcttatcagtgaacataagattactctttgctttattagttaatttaattataccaggcatgagagattattaatctttatggaatttaacaagcaagtttaattttataggatttcttatgaagctctttggaatgtgagatagtggtgacagtcatggtaagaaagactagaattggagtaatttattctagaaaacacaaggcaatccttgctgtagagaaaggttgctttcacagctccatttccttttgcatagtaagagggcattacgttgactaacagcagtttcttatcagtgtatgagaagtaagtcctcttattcaaccaatccttggataaatgactaaggatggctgcttcctactgaagagaatgtgggaggaaacattgattgggtggagaatgagaccgcaaggaaatatcaaacaattcctaaattagggagtcatgaattaagacctcacaggagaagaagggtgatgttctttttgagtaaagagagtatgatttacaaggcagcctgggaaagcaagcattggtgggttggtggagaaagtaggccttgtataggcaagactgtagctatggctcctcttcctggctttctgcacctatgtcccaggcaatgcatgagtcatccaacacacggggccataaagcacttaatgaaggtcataccagagcaagccaaccaggacagcaatcagcattgttcatcagctgctccaccagaacaccaagtcgggtgtggtgacacactcagggaaagtgggactgacatattttgtaggaacattctgtttcttacccaggacccattacctgtcttctctttggtaaataatgagacctgtgctttatgacttagaatatttttatttgatttccacaataagaaggtggcaatagataataataacaaaagaaattgtagtttcattttacagataagaaaattgagactcaagagtattacataaattgtttcagctaccacagcaaaaaatggtatggttgggaatcaagctcagggattctcatgctctatttagcaccaccttctcttctgagaagaacttggggatagaataaaaaaataagacactaatgaaatgtttagcacatgtgtcttttgtgaaagggagaaatagagtagtgtgagatttctgtgactcacttgaaaatgacttttaaaaactaatatagaagccaacatcaccctgataccaaagacaaagacacaacaaaagaataaaactacagaccaatatcccttattaacatagattcaaaaattcttgacaaaatactaacaaactgaatccaacagcatgtggaaaagataataacaccatgattagtgagttttattacagatatgcaaggatgattcaacatgcacaattccataaatgtgattcatcacacaaacagaattaaaaacaaaacccatatgatcatatcaatagatgcacaaaaagtatttgataaaatccagcattccttcataaaaaaaaacccttaaaaaccttggcgtagggagaccatacctcaaaataatgaaagccatatatgaaaaacccatagccaaaatcatactgaacagggaaaagttcagtacgattgaaagcattccccctaaatggagaaaagacaaggatgcccattgtcaccactcatattcaatatagtactgggagtcctagctgcagcagtcaggcaatagaagaaaataacaggcatccaaactggaaaaaaggaagtcaaattacctctgttcactgatggtataatcttatacctaggaaactctaaacccttcaaaagactcctagatttaataaatgacttcagtaaagtttcaggacacaaaattaatgtacaaaaattagtagcatttccatacaccagtaacaatcaggctgagaaccaaatcaagaactcaatcccatttacaataaaataaaataaaatacctagtaatacatttgaccaaggaggtcaaggatctctacagacaactataaaacactgatgaaagaaattgtagatgacacaaattggaaaacatcccatgttcaaggattggaggaatcagtatcatcaaaatgaccatactgcccaaagcaatctacagattcagtgcaattgttatcaaattaccaatattattcttcacaggtttagaaaaaacaatcctaaaattcatatggaaccctgaaagagtgtaagtagcccaagtaatccaaagcaaaaagaataaagctggaggtatcacattacctgacttcaaattactctaaaagactatagtaatgcaaacagcacagtactggtatagaaatagacatataaatcggtagaaaagaatagagaactcagaaacatagccaaatacctacaatcaactgattcttgacaaaaatatgcactggtgaaaggactccctattcaataaatggtactgggaaaactgggatgtcatatgcagaagaatgaaatctctcaccatgtacaaaaattaactcaagatggatttaaggcttaaatgtaagacctgaaactataaaattactagaagaaaaatctaggaaacactctctggacattggcctaggcaaagaatttatgaccaagtcctcaaaagaaaccacaacagaaacaaaatcagacaaaaggggacttaattaaactaaaaagcttctgcacagtaaaaaaataaaatagagtaaacagacaaccaacagaatgggttaaaatatttgcaaacagtgtatctgacaaagggctaagatccagaatctataaggaactcaacaggaaaaaaaacacataaccccattaaaaagtgggcaaaggacatgaacaggtatttttccaaaaaaaaggcatacaagtggccaaaaaacatgaaaaaatgctcaacatcactaatcatcagagaaatgcaaattaaaaccacaaatgagatgatatcttacactggtcagaatggctattattgaaaagtcaaaaaacaacacatattggggaggatgcagaaaaaaggaaatgctgatacagttttagtgaggatgtaaattagtacaatctctatagaaaatggtatggagatttctcaaggaactaaaattagaactacccttcaatccagcaattccactactgagtatctacacataaaaaaataaattgttttatcaagaagacacctgcaattgtatttttattgcagcagtgttcacaatagtaaagtcatgaaatcaatccaagtgttcatcaacagatgattggattaaaaatgtagtgtacctatatgccatggaatactactcatccataaaaaacaatgaaatcatattttttagcaacatggatagacctggaggctattttttctgcgtgaaatgacccagaaacagaaagtaaaaaactgcatgttctcacttatacacgagagataaacagtgagtatatatggacatacagagtcatagacactagagactccaaaaggagaaagggttaggggggaggtgaaatactacctattgggtacaatgtacactatttgggtgattggtacactaaaagcccagtcttcaccactatgcatatacatccatgtaacataattgcatttgtactcctaaatctataaaaattaaaatcagtacaaaatatttttaaaaagtgaaaaaaatgctggtaggaatatcatagatcttctagttcaatttatttcctttgtaaatgagaaaactgagaatgagaaagcttaagtaaattttccaaggtagtctagctggttattttcagaatgaagattgcaaaaaagagaattaactagatttaaagtctcctggaagatgctatatcatctatgtaccattcttgctaaaaaatcaaacttaaatctgataaaaactctaaagctaataattaatttacaggaactataagggtagagaaacatgttagcatgcatagagatgtaatcaacaaaattcagattgcaggaaaaatctacagaacaaattctgtttattaaaaaatacataacagatataaaccaattacaagagataaatcttacttgcatcctcaggagagcagaacaaattataaaagtttatcagacaatgaaagaaattttaaaattcactagatatttgatgacagtaaattattataaacatatattaggtatgataatattttgccttttgcaaaatttcttatcttttaaagaaacatactatttttagattaaaagacatgagacctgagatttgtttcaaagtaattcaggggtagggagaaaagtggaccagaataaggacagaatgaattggccatgagctgataattttttaatttagataatggatgcttgggaggcttgttatagtattcattgcatacatttgagcttttccattaaaaatcttactagttatatagtaaatcaaattcaaatctaaaattgttttctcttacattttagagatggcaagaaagaagctgaaaaaatttactactttggagattgtgctcagtgttcttctgcttgtgttgtttatcatcagtattgttctaattgtgcttttagccaaagagtcactgaaatcaacaggtaagaagtaactctggggctctctccatatgttgtttttattagagcaaaccttcaacaatgtcaggaaagtaatgctttcatgctcatgtgtgtatgtgtttgttgcgggggctgttatatgtgtgtgttctatgtgttttggacagctcagtagatattcattgtaggtttaagttctgatactttgatttatcaattaatgcattgcagaattccataattgactttttaaaaatatttgccaaatttccttaaataagtctaattctgctaagaatgataattaacaatacccttatgtgaaaggcaagcgagtatatgagagacttcaagcagtttgtggaaaaatagaaatatagaaataaaaagaaagctagaaagataaaaataaaaaaaactttatttctcagtgtaaactccatcaagttcaagacacttttgtaaaagatgataccagccatttagtccatccataagaactgagggtcctgggaatttaacctttgtaatgcagtcttttttacattattaactgaaaaaaatgaatgccctttatagatttttttttaagattaggaaactaaaagaagtcaaaaggagccaaataggaaccataaggtggatttcccatcaaaactcttgcaaaattgcccttgtttgatgatgaaattagcaggagctttgtggtggtggagaaggactctccgtgaagctttcccgggcatttttctgctaaagctttggcaaactttctcaaagcactctcatgatgagcagatgttactgctctttggccctccagaaagtcaacaaggaaaatgccttgagtatcccaaaaaaccgttatgtgacctttgctcttgactggtctgcttttgctgtgactgggccactttcccctcttgggagccattgctttgtgctttgtcttaaggctcatactggtaaagccatgttccatcacctgctacaactcttggaagaaatatttcagaatcttgatccccacttgtttaaaatttctgtttaaggttctgctcttgtttgcagctgatgtgggtgcaacaattttggtacccgtagagcagaaagtgtgctcaactttcatttttcagtcagaactatataagctgaaccaattgagacatctgtggttttgactattgtttctggtgttatttgtcagtcctcttcattagggcatgaaaaaattaatttttatcttcacaaatggatgtggatggtctgctgctgtgcgcttcatcttcaatattgtattggcccttcttaaaataagttattcctttgtaaactgctgatttctttggggcattgtccccataaactttttgtgagtatcagtgatttcaccatttttccacccaagcttcaccgtgagtttgatgtttgttcttgtttcaattttagcagaatttatgttgctctgataggtgctcttttcaaattgatgtcttatctttcctagtgcctcaagctaagtcctgttcagacatgttgtaacaatctactttgagtttattttagtaccaaaaatatttgaaatttatacatagttttttcataatacatatttttcatggactttctgaagaccctcatctaatcaaactttttttgtttattgaatttttatatcctcaaaaggagctggattatgctgaattatccatggtttcttatctgattcatctaggatcaacttcctaggagaaccaggcaatcaagtgttaacctgtggcttctctgcccctcctaccccatcccttgttacaacaatatctactttttgtagaaaaaagtcccaaagattgctcaactcttaaaattatgtgattctaaagatgtaactaaaaccattatgcagacattggcacaatttgaatttgaaacccccaatgaaaagaaaaccaatcaaaagacactgttttgtcttaatgtcattattaatttattgcagaataccttcaagaaagctcacctccttattttaggatacaataaaaataccttttctaatttactgatttttaaatctgaattcaaagttcactagcccttaggtaagtcctagctgtcagtttttagagtggtggcctccctttacatcttttgtcatataggactttgtatttacagaagaatggcattgctcagaagcattctttgacttggggattggctgttgactgagcaagcaaagctgaggttactataattaggatgacacttgtactgcacatgttctgtgtgcccttgctgctggggttggaagtaaagaatcagatcagaggtcttcagactttactgtaaaggaccagatagtaaatattttagattttgtgggccatacagactctgccataatgacttaattttgccctagtagcacaaagcagctaaaaacaaacgagtttgtaatgtgtataatatgtaatgtgcatgtgtgtaatgttccagtaatactttgtttgtaaaacaggctttgacttaatttggcctgaaggccatagttactgacccctagactaaaggaagggtggtccccaccttcatgagcttctagtctaaaggcggagtccttgctcttatacatactatcttgtaggggagggagttgggagtagaaggagatgatatagagatacacaaaggtaaatacagtcagcaggaacaaagtgacattttataaagtgaatgcataaattttgaggtcatcagagtgaagcctactcagtagtggagttaattggaggtgttgagaactattgaatgtctgtgaaattaaatttgtctaatggtctttttatgtttgcttttggtatagccccagatcctgggacaactggtaccccagatcctgggacaactggtaccccagatcctggaacaactggtaccacacatgctaggacaacgggtcccccagatcctggaacaactggtaccactcctgtttctgctgaatgtccagtggtaaatgaattggaacgaattaattgcatccctgaccagccgccaacaaaggtttgagttatgaattttgtttccattttagaatttatgcaacttgatagtttatttttttttgttgttttgttttggttttctttattagtgactctcaagagaggtgtttatgttgcagccattagtggctcaggcaaattaacctgtgtccatgcttgtatgacagtgcagcttcaggaaaggaagacctggaaaattcccttgggttgccagattcagcaaataaaagtgcggttgcccagccaaattcaaatttcagaaaaacaatgaataagcttttagtataagtgtgtcccgtgaaagattttgggcttacttactaaaaacgtatttgtcttttatatggcaacactacatgattactagttctttctgactctgttcatgccctgtatgtctctcctcctttcagaatttccaaagctcatctagaatctgcagtaaaaattcacaaaacattatttaaaataagggcaaagtttcaagagctctgttttggaaggaagaaggtaatgaataccagattaaagacagtgcagacatctgggcatttaccttagcccagtgtttctagattatcggctgaagtccacctgattatgatgattataaagtacttgcccacaccctatgtttgatgtgccaaatttacagaaagttgatgcacatgcatttactttccctgtcatattgtgcaagttactcaatagctcaattgagctgtactcaatagctcactcaagctgtactcaatagctcactcattacttggaagctcacctagattatcacattctcagtatgtcacactactgcaacactccatcttgtcactgggtattggtgcacttcagatacagccatagtaatgtttctttggtgctttattgtaagatcttttgataaatactgtggtatcaagattgaagttcaataaatgaactttggcttttctacatgtcatatctaactgaattactccacggccttggcgtttattaattggcattctccttttttgctcagccagagagaaatactggcactttcaatgattcattttcttgtagaagatacatcttagaacttttgttgtatgttttctgaatcctgagagcggtatgctgatccagattgttgttgagagctgaggctatggataatgatgtgtttgtatggtgttcacattaaagggaatgtagctgaaagaggatggtgggaagaagttatgaacacaacagataggctaggcagaatgttctggtgtcgaaaccattgctatataattttatcattcttatcatctgtcctccaagattatatgtaaaagaactaaaagaataactttctctgcagatgattcttggttgtaaataccattgtttgattctcccagttatgagagggaatccttttccagtacaggaggaagtactgtatcaagccaccctgacaccctgagtactcttgggagactcttctttggagagaatggactctaggagtccccttcatggatcttagaaaaaaagatcactcgattatctaactctagttcggatctttagttctgggcttgaagctggttggagggcatcttcactgaattccttcctatcatatcagctgaactcgttacctcctcaccaaatctgcttttccttctcagctaccagatttctgctagtagttctattaagcttctagttcttgagacagaaacagcagaacttctgcttggctcatcccttctatccctttggccagtattccatgtattttaaaatattttccttaacaataatttccagaagaggcatttcatttccattcttgcagccatccctagatcatcatttcctcatgcttgggttgctccaggtgccccttggcatcccttctgaattccatttctcctatccattccgttacatgtgggattagaatttctcttttttacatccaacttttgttattatttctacccaacttcagtacatatagtggtttattactgtacgttgagccaagttcaaacactgtcttctatcatctaagaccctacctctgtgcctctataggttcacttaggctatacttctatgcagattttaaagacaactgtctacacttattccaaacctttgaattctaaaatcctttccactttcttgatgaagtcttttatccccaattccagaacgcagagttgaaagatcccattgatggcagggagcaggaatatttcatcaaattccagatatccagcttaggaaagaaatgatagttaatacttttaaatcctttgatttttcagggctataaagcactgtgtaaacatgggagggcaggttacgtgcttaaagataaacccgcatgccctaagtaaatgttgcagagtaattaagctgagagaaattcacagttgatttccaaggataacaataacataagtggtaatctcaataatttgagaggttaccatatttcttaaacagaagctttgtcatcttttacagcgaacacacttggtaattgtctatgtattactcatttatttggcttatgatatccttttccaaattccagtttattatcaatatgttggggatcatgttttatgatatagcagcaagggtattgcattttgccaagatcattgtgagtcttcacctttaaattactctgtgtttacacaacatcagttaatagccattatatggtgctaggaagagcagtgagcccagataaaaacttaaagtcttaaaagacttaagtttatgtttggcaccttgaaatgataatgtagccattggtcaagtgaaaggatgtaaggggagccaggttattgagttactcagtcctggctttgcttctggaaagctctttgacttgatcagtaagtcacattttcttataaactgtgaaatccttctaagtaaaatgagacagtatgtgttcagctaaacatactcattaaacgttcgattaaatgactattgaacactatactaacctcaaaatattttagaatagtgatctctaaggttctggcaaatgtttctctgaatattcaccacagtctgatttgggggactagaaagactggattatgggaatggcagaggtggcaactttgttttaaaaagtctttgctgttagacttcactttgaggttaaatgaagtggccagcctaacaagctaaatttcaaaacctgactcaagatgcacatattataaaatagcctacatttaagatatttcacagagtcgagactaattttattcattcgttagttcaaacttgctgcacataaaaacagctagagaacattttgatgaatagagggtgatttgaaattcctttatcatcaagtgctttcaacttctaaaattcctgctctatttgaagatgggatactttgtctcattctactcattttcttcatgtggagactttctggttccaccttttttgttcacaacatcaggttcttttgtgctgctataacataatgcccaagactgagtaatttatcaaacacagaaatttacttatcatagttatggatggagactagaaagaacaagaccaaggtgctggcatcttgtgaggaccttcttgctgcatcctcacatggcagcacgtagacagcaagagacagcccactgtctcctttataagggcacctaattccctttgtctgggaggaggcttcatggcctaatcacctcttaaaggccccactgttaatactaacatactggcaacacgtgaattttggagggggcacattccagccaaagcaccagtctaactgaaattgctctaagtcttctattttcttagacttctgttttcttagggcaagcttctccatttgtctactgaattacaaactatccaaacttagtggtttgcagcaacaattgttttattatatgtagtgattttgtaagtcagagattctgccagggtttggctgaatggttctgttccacatagcatttactgggattacatgatatggtggtatttagttggtggctgatcttgtctggaggtttcaagatgactttactcacatacctggtaccttggtgaaaatggtggtaagactgactgcaccctcttcccctccatgtagtcacggagtctctcttggtactctctccagcagggtagctgaacttcttacatggtggctcagtgctgcaagagacagaggcaaaagcttccagttctcttaaataccacacctaaaccagcatagtatcacttttgatgcattttgttgatcagatcagtctcagggcggcccagcttcaacaggaacagcgacagactccacctcttgacacaaagtgtgttaagagaacttgatggccattttaaacaactgcagaggaatgcttattttttttttcagagtagcataaaggctgctgttaatggtgaaggctgtggtgacctggacaatacagatcagagcaggatggggtggcacaggttagaggagtcagcactgggaatagggtgggtggcagagttgagtgactgaggtctaatgcgaattgtgaggagctcctcctgttccctccagtggcaggaaatggttgatgccactgactcactcaagctgactctgcctcagtctgggatcatgtccttttaaccagcttgcatttgtccttgcaactttgccctctttctttcctgaatgctgtagttgctgaagttttgattttctttttttttaaatcttagatctgctgtttcctaatgccctaatggtttatgcatttcaaggcgcctgtaatcttatcagtaaattattttcaccccatattgtggaaagacatagggaattactttcgagaaagtttctagttgataattgatttcacctttagaataggcttttgagaatagggtggcaatttctcttttttatacaaaaatatgtgagaaagtatttttaaaactaaaaggcccacatgcttactacagaaaatgtgttaggagagaaagtctgtgacagattcctttaggttttttctggttcttctctctacccattacactggtcagcccacaagcacctggggcttctctgttttcctgtaacagtaggaatcatggattatcatttagtggttttcattttactactttctgtttgcttctctttttctctatttcctaggctctgtcccagaaattctgatttaattcttaaggagtggatcccaggcctgcttatttttgtaatttgccaggtgatccaaatgtgcagctaagattaataaccattggtctagagcagcagttttccaacattgttctgtattagcatcacgtagagagctaataaaatccttagcactccagcttcagtgaaggaggataaggcctgagcttttatacttttcctgaattttccaggtgattctgacagggaccatagtttgagaatatagtaaaatgtgtttgacacaatgtgcaaagttgtacatttttcagcagttctgtaggtcgttatgttggaagggactttggcaaaatatggaatgttttcagtctctgtttttatattgttaggcatgattattatagtcttcttggtaatccagtatatgaaagcttgaaaaataatgacacgtttgggacttgataaaagatagggagttgagaaaataggcagttctatattattttctattatttattttcacaatggttttgattttttctatatagcgttaacttctttgaaataattattcataaatatttaagatatacaaaaatatataaccattatccagcttaagaaataaaatattatcagcagagatgaagtcccccacgcatatcccttctgtattattaccttttcctccatcctctttagaagtaaccacacttttgaaattgatatttaccatgcattcctttcaacctttactacctctatatatacttgtaaataatagatatatacagcctataaacaaaatgcatttttgtttatgcgcttaacattgtgagatttaactatgttgatagatatctctagttcatttattttgctataaaactggtacacaattgtataaaattatgtcaattttatggcaaaaataaatcaaaatcattctacagtaaaaaaagtttttcttcaatatattgaagttacatcagtcccattctgaatatttttgtaagtttttttttacttgcatctgtgtgattttagatatatatcttaagtttactagacattatcaaattgatctccaaagtggctgtgccgatttaccatctcactgtcattttctgtatcttctttggaattgacagtcttttaaagttttgccatttgaggattataaaatagtgttctgttgtggtttcagtgctaatttttctgaatactaatattggtgaacatctctcatttagttcttttctgtgaatttttctgtcttgcccgattttatattgagatgtttatcttcttgatgtgtacagtcttcccgtttgttcattcatgtgattctggattcttattcttatcatatatgttgcaaatatttactgttaagaggctttgctcatctattttatactgtcttgatgaacaaaagttttacattttaatagagtcaagcctatcaacaattgtgacttatgttttgataactatgtattcccatattacattgtatctcaaaaacaattccaggaagactaaaagcctaaaggcaaaaaacaaaaagttatagatttaagaagagaaaaaaagaatctaatataataataattgagttattcattctattttttctataaattttcttgaatttctaccgagacaatattttgtctggaagtaatggatgatttggcttcattgttttcagtcttgtacatttttctttcttgtcctcttgaattgttagaacctccaatatatttttaaattataagcaatcatagtgatggatcacttaggtttttttttctgattttaaaaggaatccttttaatatgttaccatttagtaagatacttgttgtacagttttggtggatatccatgatcaaactaaggaagttgcttttcattccaagtttgctaaaaattttattatgatagctgatgaattcaaatgattatatggtatactttttaaaatgagttttttttaatgaatcacacaagtagattttctattattaaaggatctccttatttctggaggaaacaccacttggttattattcgtttaatatgtactgatttctgttattaatcctttgtgtgctttttcttttaggcttttgcatttatgttcatggataagactcggctgtagttatcctttatgtttcatgtttgcttttgacataaagtactttctttgtttcttcccttctctctcttttaagtgttaagaagcattgggaattggaggaggagaggattggggtagagcagagcttgattgactcttaagcagtgtcttcagtatctggcttgtctctatctctgaattctattcactactcctcttcgtgttggcgaaagagcctgtatagctattatataaaaagtaacatatctttccatcctttatgtacattatccatcaattactctgggtgttcttaaaatattctgttatgtactatctcccttaattttaccttgtgattctttaaacttttcttgtatatattttgagtctttattattaggtatatatccagttttagctgtaatatcttgaaactttaatcatcatgtactgactctatgtctctctaataatgaatttttacttaaagtctatttgcctgatattagtatggcttttattttattttattgttttgagatggagtgccactctgtcacccaggctggagtgcagtggcacaatctcggctcgctgcaacctctgcctcctgggttcaagtgagtctcctgcttcagcctcctgagtagctgggactacagccatgaaccaccacagccagctaatttttgtatttttagtagagacggggtttcaccatgttggccaggctggtctcaaactcctgacctcgagtgatctgcctgcctcccaaagtgctgggattacaggcgagagccactgcacccagctggcattctttttacatatttgttttcccctttactttcagggcttttgtgagctttagtttaggatgtgtaaactataagaaacatttagttggacttacttctttaaatgtaatctgactatctttgtcttttaaatatttaaaccatgtgatagttgacatgacacattctttctaaggtctcattttgtgccttctcttcatcctgtttatgtgctagtccccacccctactccttcataaacatgtcttttttcttaattttttggatcgaggatttccacactccccacaactctaacaattttccttcagtactgttttggtagttacacattctatattattttggcagtttctcttaaatttttaattctcatatccaacttaaaggggcattttgtgtcctgggcctaattctttttgtgtgccctaattctattcatgccatcattttctgtagtttctttctaaatctattttcctaggttttacatagtttgctttgtcttattatgtgggtcttgcaccatgtctcttcccacttcttgcaatggctcagctctactgtagaagctggcatttttgagttggccaacaaagactgtttgcattccttgctcttttggccactctgatctttgtcctttccagtttaatggaaaaattattaaactctgggctgtatacaaaaaccatcatgcttaacacccttttcaacacttttttttctttttatgctgaggtttcctctgagtgggttttacaagaacaaagacaaaaccgtggattgaggttgagttcacagtgacacctgatcttacggcagtataaaccacatatggacatcgttgtttatccctcatattggctattagtgtaaaaaatagcatttaattaaatttcattatttgtataactaagcaaaacatttttctgaccatttgcaaggctgtattctcctgaaaatgtgcttagagatactcaacccagagtatagaaaaaaaagaaatggatagtaagagaaccaagttttgttcttgccttctcaatagctgagtaacctttggcaggtcactttacctcggagaagctttaccaccatgggccaaaggtaattcatctgtaaaatgatctggtaggatgtattagttatctattgctgtgtaataaattattccaaaatttaatggcctaatatgacaaatattttctcacagcttctgtagtcagacatctgaccttggcttagctaggtgcctctggctcagtgtctcttggaaggctgcagtcaaagtgtcttccaggactatgggatgatcgttttcaagctcactcatgcaattgttggtaggattcagctcttcaggtgttgttggattgagagcctcagttcattgctggctgctagctggagacctccctcagttccttaccatgtgagcccctccacagtgtgacaacttgcctctcccagaatgaggactccaacagagaaggtgaaagagagcaagcaagacagaaacttcaatctttctgtgatctaatcttgaaagcagcgtctcattgttttctcttgtttctattacttgcaaatcacttgattcagcatgcactcaagaggagagagttctttgtccttttttgtatttaacttggttgcttctcccaaattagttggtgtgagaaagaaactatcttcattttggcttctacttgattcagtcattaattatgttagaaggcacacacctttcttaagtaagaatctatttgggtgtcaagaaagactactttctgcctctggaggagttgagagactgtaaacatgtcatatatctcacatatgtataatccatataaatgtaaggcatatatttaaaagtcaaaacaacattagtttgatttgaaagcttcagaatacagatgattgcaaagtcttattttcatttttaaaagtcaaagccgatataaatgaagctccatttgtaattttggattactggtgatatagctatattattgtttagactatttaaatatatttatgagtttttttttttgtgataaaagttatagaatgcattttgcttcccatactgttacataagaaggacactggtcagaaaaattggttgtgggtagaaactctgccattgcttggtatatggcacaatttatctaaatgtcagtttccttatttgtaaaatgaaattattcataccagagtctcaaattagatgtttcgtgctttataaatgatcatgttctacaactaaatggagcttctttgactaacctcttgtttcaggccacatgtgaccaacgtggctgttgctggaatccccagggagctgtaagtgttccctggtgctactattccaagaatcatagctaccatgtagagggcaaccttgtcaacacaaatgcaggtaagccagagtctgccatgatgcaggaggtccagaccctctggaggttgactctgtatcccccaggggcagcctgcagagttctgctctgtggggccatataaccacatgtgacagaaggtgggcattgctcttaatcgaggactagaatctatgtgggcaccaaggaaaaattattctctgccttgggagttgagagaccatgtcctctttccaacttccccatttatggaccttcatgactgcaataatcattgatcatttttgttttcaagtttatcccttttaaagtgggggatttgaaattggtaacctctcagactacttccaactgtaattttatgttatttttatgaaatggaagtaattccaattttataaacatgttatgaaagttactagtcaatataagtgttcatggagtgaatagcccctcttcttcctcctactctaaaatgcaaagcataggccaggcacagtggctcatgcctgtaatcacagcactttgggaggccgaggtggatagatcacctgagctcaggagtttgagactagcttggccaacatggcgaaaccccatctctactaaaaatataaaaattagccaggtgtagtggcatgtgcctgtagtcccagctactcaggaggctgagccaggagaatcgcctgaacccaggaggcagaggttgcagtgagctgagattgtgccacttcgctccagcctgggtgacagagcgagactccgtctcaaaaaaaaaaaaaaaaatgcagagtataatgatgacaatgatgaccattctaggggatagcagaaggtgacactttagggaggctctcggtataaaggaggaggcatgttcccctttcagatgctcttggcctgatggactgttgcaatgaggtctcaactctcacctggtttaccatttaattagggagatggcatcaatggatataatcacctgtaatgcaatatgaaaataactgagaaggaattatgtatatgtatgtcaggtctgagaatgtaaagggtatctaattaataccgaatgactgatgggcctgtggaatgagtgttaggcttattgggggaggttttcaatcagattttgtagaagagagacatagatttttataaaatgtaatgatgatatctagctccagaatctgccatagatagtatgtgcgtatgatggggtatatatctgtcttttcccttcttttgagaaataaagatttttcatcaatccctttgacatgtatcctaatatatatatatatatattttttttttttttttgagaaggagcctcactctgtcatgcaggctggagctgtggtgcgatctcagctcactgcaacctccacctctggggttgaagcaattctcctgcctacaaagtagctgggattacaggcatgcaccaccatacccggctaatttttgtatttttagtagagatggggtttcaccacgttggtcaggctggtctcgaattcctgaccttgtgatccacctgccttggcctcccaaagtgctgggattacaggtgtgaaccactgcacccagccccgtgtatcataatttttatgtagctattatttgagaatttgcagagtcaactatgaaaaccttttttttctcctatgttaggattcacagcccggttgaaaaatctgccttcttcaccagtgtttggaagcaatgttgacaatgttcttctcacagcagaatatcagacatctaatcgtttccactttaaggttgtaatttgtttatttttttttaagtttttttgagagacttttattccctatcggatgagtgcagttactacaaaatagaaaattttgctactggatgtatttttctatattgctattattaattagcacctgtatgttaaagacatatacagaatagcttcctttactgtaataacttcctgaatatgtattacagtttactagtgagtttggctttcattcatttactctagataacatgtggaatatggtaggaagataaaataaggaagtatcacagctttcaatccatctctgcagatgtgctctgtatgtctctacctaaagactaacttatgcccaaaggtgaaccatttgagtttggtaacataatgagtacatctacctaagatatgaggtcagtttgatcagtgcctgattccagtatcctaagtagggatattgggaagctctgacaagtttttattttggctttccttctatttctatctctgcacagttgactgaccaaaccaataacaggtttgaagtgccccacgaacacgtgcagtccttcagtggaaatgctgctgcttctttgacctaccaagttgaaatctccagacagccatttagcatcaaagtgaccagaagaagcaacaatcgtgttttgtaagttttggaaacctatctaaggatcagagtaggaaggttacagggaggtctgtaagcatgaagaagggggtgtttcaacaatattcctgaaggttgtgggcccattattggtgaccagaacctttaccttctaaagtatacatttttttctggctttctttctctttcctctgtttgcacaatcatttttttctctttatttttccctttatttccctccgtctataatatataaccagctgtccaccagtaaatatttactgaacatctcctatcgtaagtatagtgttctggtcatgtagtaggctgtctggtctgggagactaatgcaagaaatttgcacatggtccctttcttcaaggagtccttatctcttgttttccatagaaaaatgtcacaggagggcaaatgggactgaatgaatgggggctattgagtcactgagatataaaggacgcttttctaagcacttacgttctctccaccctgcttgctcacccatccttgtgttctccacctgtgtctaggtttgactcgagcattgggcccctactgtttgctgaccagttcttgcagctctccactcgactgcctagcactaacgtgtatggcctgggagagcatgtgcaccagcagtatcggcatgatatgaattggaagacctggcccatatttaacagagacacaactcccaatggagtaagctttcaaatgggcccctttccactgaatatcatagtctcattcttaaaggtcacctctagtattacagtgtagtgtttaagagttagagtctagagtgagactacctggctttgaattctagtcttgctattcaccagttacgtggttctgggtgttacctacctctctgtcttcagtttcttatctataaaatggaagtaatatctcaatagggttgtggtgaggatgaaatgaacagatacatgtaatgtatctagaagaatggctgccagaaagaaggtactcaataaatgccaactccttcatattttcctaaccagatatggagaagatattattaatatctgtactctcaacaacagttgattgtgatctccatatttttaggttcacctttaatcactgactcaccaggtttatcatcacaataggataaagtctcagctaaaacaatcattttttgtataaagaatgattgtggtagtgaaagaatagacagagttttgttgttattgttttattttatttccactttgttttgactgctaaaatttgaagtaacattgttttctggatttggcaatactctgttgttcagggcctttctttttcttttcttcttctctctttgtttgagatggggtctcactgtcacccaggctgaagtacagtggcacaaccatgactcactttagcctcaacctctctgggctcaggtaaccctcgtacctcagtgtctggagtagctgagactaaaggtgcgtgtcaccatgcctggccaaatttttgtattttttttgtagagactgtgtttcgccatgttgttcaggctgatctcaaactcctggactcaagcaatcctctggccttggtctcccgtaagtgctgggattacaaatgtgagccactgtgcccagctgggctttcttgactaagcagaattaatggatggaagaaaggagattacagcaataatttattagtcatatatatatatatatacacacacacacacatacatgtttgtgtatatatatctatttagccatagagtctagaaaatataataatttcttgttagaaaaaaccaaggcccagcgaagccaaattaatagctcaaggcaaaagggtttgtaagaacaagaatggcctgaacccgggaggtggaccttgcaatgagccgagatcgcgccactgcactccagcctgggtgacagagcgagactctgtctcaaaaaaaaagaggttgtaagaacagaggaagaatctaatccctactctgtgtaatttttaagcccaggctctgtactgtacatatgcctatcagaaaagcagaaaagctgttaagtcagagcagcttacctaggaatagttggtgacagttgtttcattaaggagcctcagatccttgcttctcaaagtgtgtatgtggcaggggaaccaccctctgagagaggtgggctttcagtcccttcttccatctattgaattaaaatctgcatttagggctgggagcagtggctcacgtctgtaatcccaacagtttgggaggccaaggcgtgtggatcatttgaggtcaggagttcaagatcaacctggtgaaaccctgtctctactaaaaatacaaaaaattagctgggcatggtggtggcgggtgcctgtagtcccagctacttgggaggctgaggcaggagaatggcatgaacccaggaggcagagcttgcagtgaaccgagattgagccgctgcactccagcctgggtgacagagtgagactccatctcaaaaaaataaaataaaataaaaaccgaaacaaaaattagccaggcggtagtggcacacgcctgtaatcctagctactcaggaggctgaggcaggagaattgcttgagcctgggaggtggaggttaccgtgagccaagatcacactactgcactccagtctgggcgacagagtgagaccctgtctggaaaaaaaaaaaaaaaaatctgcatttaactaaaatgcccatgtagtttgcagatacaccaaattttgagaaacacttttccagagcaatagttatcaaatgtgactacatgttgaagttacctggggaagttaaaaaataacagccatgtctgcttctacctctagggattctgttttaattggtctggggtgcagtctaggttgagaactcctgttctggagtctcaaagacaagcctagactagagctccatctagttacctgattcatattaaagcatattgatggagcttttgctgatgaggttaagtcaggttaagacaggcctctttgagagggcagtttttctgaattacattttaaaaattcctatcctcttaccttctaaaaaatatcacagccttcacattccttctagatgaatgataatagctggctcattctgtaagaaaacatgagttcacttggttaacatcaactagatatagaccccatcttttaaaaatgtgtctttatgaccctgaatgtcctgtcaattagttgcatgattaagactgatttcctaaaccaaccccacagtgtgatgctgagacttcttagttgtaaattttggtttttaattctctttctgcagaacggaactaatttgtatggtgcgcagacattcttcttgtgccttgaagatgctagtggattgtcctttggggtgtttctgatgaacagcaatgccatgggtaaaggaatattcatggaaaaaacaagcacaagagtgattttcagtccctttcttacagcactatgataaaaggaatggatccctttaagagtgactgagccatagtgtagggagggccttatagattctctaattgtgctatccctacttcattacctattgatccatggtagccatgagtaggggattttctccaacttatgattttcctgaatctggtggcctctgttggaatattttctattatcaagttaaggagctcacccttccctataatttactctgagatagtttccaccaatgtgttcttctccgtcttcagccctgtagtcagtagatcccagtggcaatgaattgccataggggaagagaagatgtatcagaatctcccaggattgatggtgggcatagggtattgatccataccttttcttaattgagagtcatcgattcaatcagtgctcctcaaagtgtggtccctgaatgggtcacagactgtttcaggtctatagtaagatgagtatagaaatggcgagtaagcaatgctgtagcctccacacgcacacatgaacctttttctagtaattaattttcatattattttatgaaaatatcagcttgcagtgaaatggaaattaaacaaaataaagatctgattctccaccacagatatccgagaagcactctaaatgatctaacatgattctaggacatctaagagatgaatctaagacgattctaatagaatcttagatggtcctaaggtacttaaaataccaaataacctaagaatagactgagataatataatagaaagactgtacagttttagataggtgaaaggaaccagaaaataagatgagtcagacttagtgggaaaggccacaagatcctagatactctgtatgagttgttcctatgaccaaagagtacattgcaatatttcttgaggcattttattcctagatacgaatcaaggtaatgacacaacttttaagaatggtgattggcacatagaagggttttgaatttatgatacaatttctgactttttttttttagtttggcttttgtttgaggtgagattcactgaggttagttacctccatgtctagttgaattatattctcacaataatgacggggtatgtggtgggacatgttctgtggttatgaaagtcagagaggagaaacttttcctctaacctcttagggttaattcttgggaggctgcaaattaaactggcaaaaaggtagattagcaatagaaaagacagaatttatttacacatacaatgcacatacacacagcaattctcagtgatgagtaactcaaagcagagattagaacttggggcttctataccatcttaattaataggtgaaagggaatggggaaagacacttaggagagaacaaatgacattttggaaagataaatgggcccttaggagagtaggtgggaggatgtgatagtcttgtaacactgtttatctgggaatggtgcctgttgtctcagagaagactagaggtactccttggagcagatttatgacaattgctttttattgagttcttttgggaggctctgattttagcacatcagggatttcagtaacttaaatgcctttggtccaaaataatttttttatgtcacagtggcttattctggaccccttcataagcctggctgctttttccccagaacctggggcctggcacaagacactaagacactccagtcagtattattaaaatctgtcacagaaaaaatgccttggctgccatgtgctgtgagggtggacttggatggtcagggttttcacttggtattcaaaatgtgaggcactagggtcaccttgttaatgttcacatggttagtgatcctgtgttattttaaaacttgtagttactattcaagaatcaattctgatttttattttcttcatttttaacctttcaagaggttgtccttcagcctgcgccagccatcacttaccgcaccattgggggcattctcgacttctatgtgttcttgggaaacactccagagcaagttgttcaagaatatctagaggtaaacttaggatgtcaagattatgactcaggaaatcctaaacagcaaatattttaaaaaagtaaaattcatgtgcaagtgtgacccacaaaatctgctgttacaaatttgagatattaaagaacagatttcatatatgcaatggaaacttgctgtatagcatttttatgttataagaaggtgagagaatataaaggtgccccaaacatggccctaccctcaaacatttatgaaggggctggaaaaatagactaacattctaacattaatgaatcagtgcattgggaaatggactatgtttggtgctctgaaagcaatgcttcgaaaaatttttattaaaaacagagtatttgctaattttcacttcacatatttctttcagctcattgggcggccagcccttccctcctactgggcgcttggatttcacctcagtcgttacgaatatggaaccttagacaacatgagggaagtcgtggagagaaatcgcgcagcacagctcccttatgtaagcaaggttttcaacagttctccaaaagtaaagaaattcccttgaagaaaaagaaaaactgtttatattttctctccctgagtttaattgatttatttatttggtaatgaaaggagttttagatattcagaatactagacatttttttttttgttggaccagtaattttttcaaggaaccattgttctttatagtatgaaatagattgggagaccataattatgtgttgggaggcaatctgtttttgtctctatttttcttattatgtattttattagtaaactttttttgtgcttactgtattgactacattttacaggtgtttttatttgagttttcaaggcatttgtctctttagcttgaattgtagcattttaatgcttctcagtatggattttcttgccttacacatgttcttggtttgctttgactcaaaagtgtcatggcagggacttaccataaaagttgtatcatattttcagaaattcctctaagattctggcataagatttcatgtctaaattcttaggttcttaggtttagtgtcaggtcaagaatgatgcagatccccaggctccctacctatgttttaacagatattttaaagaggaattgaggaagtggagtagttctagaccccatgaatttagttcaaactaattatattgctagaacaaccatgagccatctgggttagcatcattttttttcacagatagtaaattgaggctgtcaggggaaatactatgaccaagaccacataggtaattgatgacagaacaaatactgcatgtgactacatggatgtgaaaaataatacaagtttcaggtccatgtgtttttacattgatattttgattactattaaattgggaataagcaaaatttgcctttctctttagagtggtcattttgccattgaagctgagcttcagtagacattttgtaatttgacggaaagatagtccataaatatgatgtgtaaaagaaagtgcttaatggaattgagattcaaaaagcctaggaacactgaggagatgggggaagcagaaagtcagggcagataaagacgtttgggtggatgaattcactctcaatttggctgcgagtcccactactcattctccagcatgacgtgtctttatgcatgtgggggtgggttgggggagggataacagaaaaagtggtaaaagcaggactgagccaaaggacaattaacacagccaccataataatgagtgctacaacgtggtgaactctcgtggcaggcagtgtgctacatgccttctttagttatctcagcaactccattttactattagaattccattggctgggcacagtggctcacacttgtaatcccagcacttgggaagccaaggcaggcagatcacgaggtcaggagttcgagaccagcctggccaacacagtgaaaccccgtctctactaaaaatacaacaacaacaaaaaaattagctgggcatggtggcaggtgcctgtaatcccagctattcgggaagctgagacatgagaatcacttgaaccctggaggtggaggttgcagtgagctgagatcgtgccactgtattccagcctgggcaacagagctagactcagtcttgagggaaaaaaaaggactccatttaagattagaaatcccatttaatattagaaaactaggggaactagttttcaagcccagatctctaacatcatagaggtcatctctttttttatgccattttccttacttatagatagacatttcctttttaagtgatccaggaaatgaaagaattggactgttactgctgcctagtggtgtgagatgtgagagggagtgtttagacagggaattgaacactattacctgagttcagtatacatgtcaaaatctgtcacatttaagtgaatgaaaggatatagtatggacatgtaataaaacatttttgtactttgaatggctaagtttgaatgtacctatgatattggatactattgggagtgaaatttaacaagagatgcaaagggaaaagctcagtagtcttctagaataatcctcttctctcccccactctattccattggagacaaacctaggttgtagagaagggtacattttattctgggcttcactgtttatacaggtaaaattgggatagcataaacaacaaagatgtggggtagaagcgaagtaacaaaataaaatgtggggtagtaaaatgagggagatgtgggagagagacagtctcttcccttctttatcttgtgaatagggtgaaatttaggtcatttcttaggtggatatgtctgattgtcttaggggtttgtcataattggtgttgcttgcttgattggtttttaatgccagagtgccaggcaaggattggatgatgcagttaacctgatggcagggagggggccaagccctagggaaccaaccagtcgtgtgtttttgaaatcaacattggaaaagaagtactcagatgccaggaactgattaagaactctatttagagcccagaacagagttgtttatcctgaataataacagtgaaaatttgatttcattttactatggaaattcctaggtgctaattgtggactttgtatattctttcaggatgttcagcatgctgatattgattatatggatgagagaagggacttcacttatgattcagtggattttaaaggcttccctgaatttgtcaacgagttacacaataatggacagaagcttgtcatcattgtggtatgtactgccctctttccaccaaattaggtatttgctcctccgtatcatacacccatctctcctgctttctcccccagttcccagtctcctttcagtgcctccggtttccagctagtttgttcattgtattcttcctatttttaggatccagccatctccaacaactcttcctcaagtaaaccctatggcccatatgacaggggttcagatatgaagatatgggtgaatagttcagatggagtgactccactcattggggaggtaacttaatgggaaggctggaggctggtggaggggctgcataggggtgtttgaatgtgtctgtgtgtgtgtgtgtgtgtgtgcatgtaattgttttattgtacattttcagtatatttatatatgctggggataaattctcctctgccctttcatgcccaagtgcaagccggccatcgtagctttttgattcccttcacagccaagtaagtccctttaaacaacagctcacacactgagtgtccactttctcacctcccacacactctgcagctgactgtggtctccttccttcccccctcacttccctgataccgctctggcaaaaagcacccgttactttctcactggtaagtccagcggaactgtttcatacctcttcttactcaattttcctgcattatttgacaagtgtacccacttctttctcaaatgtttgtttgtccttgttttttcaggaaggtgttatctgcttgttcacttctaaggcctctgatgaccttttcagagtatagtgtctgggggaaattggataggaaagaaagagagaaaagtaaatgatgttagaatccacagcttatagtggactagctgaaatttacacaatgctcttcccccatttactattcccagaattaagaacaaagaagtgtagagagttaaagatgactaagttagacaatgcctttatccacgaatttattcattaaggacttaaacatttttttaaatgcatatttcttcgagtgaccctggcatttattttaagtattgtgagcaccgcaccttcttaactaaaaaggatatgttcctgggtacctcggttgctgtgatcatattaggaatttctttgcaaagtactttcctttagtctatatttgtttaatttactcttaccagtgtttttctttttctcctgaaggtctggcctggacaaactgtgtttcctgattataccaatcccaactgtgctgtttggtggacaaaggaatttgagctttttcacaatcaagtagagtttgatggaatctggattgtgagttgtttacacttggattattaggtgacaaatattcaaattgtgtatatctgtatctgtatctttgagtcacagagcatagggagaggaggaggagaagaaaggaagtataacaatcactctcaatattcactctcttactatttaaataatcttgctaaaacacatagcttagaataaaaatcaaaatgttagagctgaaaggaaactcagaattttttttcccaagtctagctctttttttttttttttttttttacgaaggaatgagctgaagtcagaataggtcatgtactccttacattgttgcaaagtatacaaattgttcaattgctagttgaagactcttccttttggacatgttgaacaaattgatcagagccaaagtactcaggtgcatgaacaaactatgcctgtggtaaagaaaaatgtctcatatgatgtcagatgaaagaaagtaacctaactgagggttagcaaaatttagggagctccagagttgaaactttttctttttctaagagaactgtagaaaattcaaacaatacagagagttaaaaagataaaagcaaaaatcctcttaaattatagcaactaaagacatttattatcgatacgttggaatgcatctttctagacctttatgtgctctctctctccttttctctccacatatatgtttatatgtatttatatgtatatgtatttacagttatatttcgatatatggaaaaatgtataagttgaaacatgtcatcatataaattgaaacttttttcacctgatatgtttgggaattgttcattttcagcgattatagacatattatttgaagagaggttaagaaccttcttcatgaagccttcagtgggtagacaagacaagaacacctactctattccatttatacaaatacccctttaaaatatctggaataatttatctgattaattaaaaaaagacaccatcacgacatcataagataacatgttactttttcttaatagtttttgctctttgtcttgtaggatatgaatgaagtctccaactttgttgatggttcggtctcaggatgttccacaaacaacctaaataatcccccattcactcccagtaagtcttggtggtcagcagattaaagtagccatatgtatttcatattataaattcataaggacagatctgaaaaatctggcaagggaatttgttcataattgtgcatagaaaaagaaatatgtgggtaatatataaggaaaactaggaaggaaaataaaaacacactatgctttcctaaaacatgcacaaattcaaaaggggcaatctagtacttctacttatactcaaagctatttctagggaagatctagagaggataaagtgtagaggccagaggctagtggtaagtttatgtcattctcaggtatgcacccacaggccagggtttaccagagagacaccaggtaaccagccttggtcatcaggtaagggttatgtctgatgtgtccacagtgtgaagaactgagttacaggatgaaaagacagaactcatgacctgggaggtcaaagtcagtgaacgtgatgatactcagctttgattgaactttggacaacactatctctcagggtgtggccttggcatcatagcatcggccatagtttgaagaatgctagaggttcaaggacagattatatcttgattgagaaaggaaaaaactgctaagatgataataacttatgaaggcttcaatatggtgggaagacaggaaattggggcaggaaggttagaatcaaatgctgaggggcttggatgagaggctaaacagttcatattttactcttttggtgttagaagctacttatcttttagtaatagagaagcatggtagtcagatgattttggaaatatgaacctgacattaatatatagtgtgaactagaaatagatacataggaggtaaataagacatgacgaagctactgcaatagttaagatccacagataatgtggatctcaaacagagtggtgcaatgggagcagagaggaatagatgaatacaggagagactggaaatcattctctacaatatatgatcaggggagagaaggagtcagaaattaatttacactttcattcagtatttccattcttggaccacttaacttagctcagtttggagaattcagattgaacctcaggcctgaatgaatcttcttacttccaagtgtctgcctctaatcacgtgagagctccagtgggaggatgtgtgtgggtcagcagaattcatttatatatcagagaaactactccaagtggatagcattctaatagtaagggagcagtgtgactgtttacaggatgcccacaaaagtgcctgcccagggggctgtcatttcggattgtgatagtcaaggagcagaaaatgtgcaacttaggctctcactgattgatcctgcttttgtttcaggaatcctggatgggtacctgttctgcaagactctctgtatggatgcagtgcagcactggggcaagcagtatgacattcacaatctgtatggctactccatggcggtcgccacagcagagtaaggccactatggctatgacctgctaattattgaatataaagaatatatatatgtttttaattcttggagattatggggctaatgcataaaatttcttaagacaaaacaaagcaaaacaaaacatttaatgatacagaatgctcccaacagggactctaattgtaccgaaagagagttggaagagaatgggttattcacttttaatgtcttttgtattgttgctgtatccccttggctgagacaagctaagatcccacattgactccttaaatctctctcccttgcagagctgccaagactgtgttccctaataagagaagcttcattctgacccgttctacctttgcgggctctggcaagtttgcagcacattggttaggagacaacactgccacctgggatgacctgagatggtccatccctggcgtgcttgagttcaacctttttggcatcccaatggtgagctgctacctcaagctctcttatgaacctgaattcccaggcaacctcattctagaaagttttcaaaccacaaagctcccctctcctgcctgccatggctggggatttaatatcttgagagcatgtgcttcatccacatcagcagggctttgataccatgacattctttcctgtactgccttatgaagacagaacgtgcaactttgatatgtgctggaatatatctttctattaaagtgtaacatactttatacagaaaagtgtatgtatccttaagaacacagctgatgaatttcaccacctgaacacatctgtgtatctagtaccaagatgaagaactataacattgccagcaccctacagtctttggcattttttagttaaatccaacatatttatgaattgaactcctagagtgttcaaggtcttgagcagagtaggcatggtgagagggaaggaaagcataaatatagtaaagatgtaccttctctttgccccaagggtttacagtttagtaagaggagacagatgtgtaaacaaataattgtgacaaactagggtaaaaagaccaacagggacgtatgagttaaatgttatgggagatcccgagaaagggatttatctgacaaaattatgagggacaaaaggaatcaaggcagggagtcaaggacacttcatggaaaagatgacatttgagattaaccttgaaaagtgagtattttttcatctgactaatcaggggggaagttcattttaacactgagaaataaaaatgagcacaaacagtataagggggattatttgatgtatctataaggattggtgtgtgggactggaatgagaaatgatgctaaaaagatgggttggaaccaggttttaaagatctaaaaggttgaacagcaaggaagtcccggagattttttaataggtgagtgacatggtcagacttaggctttagaaaaataatgctgatagtggtgaggtcaaaataataatatcagcagtattactaggtactatgcatccaaaagctctttatgtaaagtgtattacttttattacctcattcatttacgaaatacctgtgtagtaatttagtactcactgacaaaatgaggaaattgaggcacagaagggttaggtaacttactcaaagtcatccagcattcaagagtggacacaggctatgaccaaattttgaccaccctcctagccttctcggtaggaggtttaagcaaggttcagttgggaggtccctggtggaaagcaaaggagggtggttagaaggaagtgaggtatacctgttgtctgtgtgtccttccaggtgggtcctgacatatgtggctttgctttggacacccctgaggagctctgtaggcggtggatgcagttgggtgcattttatccgttttctagaaatcacaatggccaaggctacaaggtaaggctcctaggacatagagtcagaataaatttggcatacattaggactagatctgtctgcatccttgccaagagatctgctgaaccaacctcttacctggtcttcacttactctaatttgcactatcatgtgcaattaaccagaatctgtgctgtatcatcgaaatgcccaacggcctcagcctgttatttactgttgcattcaaggaaatggtgtgtctgtaaaggtctttcatcaaacttctgtacgctttatctacattgtttgcttttaaataagaagcaaacaaggaaatacttcaaaattatttaaattgcagcctcccaagagaggaatcttaaagaatgaggaaggcaggttgaatcgaaaactcaaggagagacacttggtactactcagaagcgaggtttgcaaccttggcctctgtcattcaggagggaaattcttggttgtaatgaatgaggtctggaattctgcaggtgcttctgctatcctgcagccaaaccacaactgcaaactcctatttcctcccaggaccaggatcctgcctcctttggagctgactccctgctgttgaattcctccaggcactaccttaacatccgctatactctattgccctacctatacaccctcttcttccgtgctcacagccgaggggacacggtggccaggccccttttgcatgagtaagttcacctaacctccttaaattttattaatgcatctggaatgacattgactatatcatcaaatatcagagtgaaaactgaaacaattcaggcagttattcatatctatctgtatctatatctgtaatctagctatctatattcattaatctatctatctatctatctaactggaatacctagttggtatttgtaagcatcgcctgttcccttttggtgagagaattagactaaaagtcatgggactacaggtcttttctttgttctgccattcactaactctgtatcttagacaaatcattttttccttagtttcttcagtcttaattcaaaggatttgaaatcttgactgtgatggtctcatctgtaatgcactataatgccagaactatgttcaagctgtaggaatgagcctataatacaaatacaaatgaggatattataaaggatttgtagaatttcagaattcttatttctcaggcaatgaacatctctaatttaattctaaaacaaggcacttaagagcattttcttgtcaaaatacagtcaactcccttatgtgggtgacatatgaggccctcaggcacgtatcaggctattatatattcattattttgggaagtttttgtctgctcatgaaatttcttgttaaaaggcagatattctgaaagagaaaaaagtaaaatgttaaattatctgatattttgtatgatcagatccagtttcttgatagtcagctgaagttatgaaatgtattgattatttaagtttttaattttaaatttttgttggtacatagtagttgcatatatttatggggtatatgagatgttttgatataagtgtgcgatgtgaaataagaacattatgggaatgaggtatccatcccctcgagcatttatcctttgagttataaagaatccaagcacactctttaagttacttttaaatgtacgattaagttattattgactatagtcaccctattttgctatcaaaaggtaggttttattcattctttctaactatttttttttgtatctgttaaccatcttgacctccctcccagcccctcactacccttcccagcctctggtaaccgtccttctactctctgtgtccataagttcttggcttttagatcccacaaataggtgaaaacatgtgatgtttgtctttatatgcctgacttatttcatgtaacgtaatgatctccagttccatccgtgttgatgcgaatgtccggatctcaacttactttttttaaaaaggagggctatggaaaatagaattacagcctgggacctgcctagcatacatactggaatagaaacatctgtttatcctgagggaagaataggagacatgagctggggaaggggaatctgtctaggggtgcagaggggcttgagtaggtgtcacagaataatttggggggtttgcctgggcagacggcctgcatgctttcaacaggttgtgtgtgagtagagctgctacaaatctcattggcagtggctcaaatctcagtgaactgtctctctggttttcaggttctacgaggacaacagcacttgggatgtgcaccaacagttcttatgggggcccggcctcctcatcactccagttctggatgaagtaagtgttcccacagagatacactagagatctctgcatctgtatctgctgccctgcaaactcctctctgcttcttattccaaactcacttctgacatctgtgactgagtcagccttgaagagagtgtgctaggttttgagaagctagacatctggtaactacacatttttctttctagaatttcttttttctcttgatcaagttcccaaccagtttagaagcatctactggaaactctagagttacaagttatgttaggttgttcttgcattgctatacagaaattcctgacactgagtgatttacaaagaaaagagatttcattggctcacagttctgaaagctttacaagaagcatgatgctggtatctgtgcagcttctagggaggcctcaggaagcttacagtcatggaggaaggtgaagaggagcagcgatgtcatatagcaaaagcaggaacaagacggggtggggggagttgccacacacttttttttttttttttttttgagatggagtctcactctgtcacccaggctggagtgcagtggcacaatcccagctcactgcaacctccaactcctgggttcacatgattctcctgcctcagcctcctgagtagctggggttacaggcacctgccaccaagctcggctaattttgtattttttgtagagacggggtttcatgttagccaggctggtctcaaactgctgacctcagatgatccacctgcctcagcctccaaagtgctgagattacaggtgtgagtcaccgcgcttggccgccacacacttttaaacaaccaaatcttacaagaattcactcactatcaccaggacagaaccaagggaatggtgtaaaccattcatgagaaatctgccctcatcatccagtcagctccctccaggccccacctccaacactggggattacatttcaacatgagatttgggcagacaaacatccaaactatatcaagagtggtcctatttgttgttggattctcatagcagatcctgacttgctccatgacgtagaaacaggatggagcagtgacccaacactcactctaaagtcaggctgatcgggatgtgattgttgtctctgccactttgagcctgtgtgatcaggggtgactattgtgctggcttctcatctgcagaggggtaatactactactactaaaaataatggtacccaccatttgggaatgttgggaaaattaaatgaggtaatcatgtaaagctggaatgtttgtcaccacacatgttttattattattttatgattattattattcctaatgtggctacgtttgggatttctctctgggttgccaagttacagtttctattatttgtattagaggagaagcagaagaaaggcataatagcagggcattcctgccctctctgtgtatgattaagaaattccctagagaataaaaagaaatccattttatttccctcaggggacactacatttttttaatttcagggtgcagagaaagtgatggcatatgtgcctgatgctgtctggtatgactacgagactgtaagtagctttgacttttcttctactccttaagactgtagctgcagctgcatagacaagctacctttctggagagagaaacatccatctacatgctgaggagtagtttttagtgttttctgtaatttcatagcagaacctgggtaaagttaacctaaaccgttaacatcagtcatgatgaaatgtgaaaaaataccttcatatactttatttagcaataagataggctgacatagtatctcataaattaatattggaggaactgatggacaatgtgagcttggtcaggaatcagactatctgtttaaaactatcagtttatataatatatcaaatagcctcagcatggcataaattttttcacaaacccccaactggtagcagaacatgttattcttgatttttttccttctgttgtttgattgcctggctagaccataattcagctaattggaaaagggagagagctgtgtatcaccaggcatgtagataatcagtgaagggcaatatgctgtcatgccaatgtgtttgatttatctgcatgcatcaggggagccaagtgagatggaggaagcaaaaagtcgagatggaacttcctggagacaaaattggacttcaccttcgaggaggctacatcttccccacacagcagccaaatacaaccactctggccaggtatagcatggctggagtgtcctttcagaattcatgtccttgcttaaaccctttgaatttcttttcgaaacacactaacagccaggtggtcagcctctttggtttggccacgactgttgcagttttagcaccaaaagtctcttcccttgggaggcttttcaattctgggcaaaccaggtcagttgatccctctgtctgccttggccacactgcatccatgtttctttacccttgactcacttgttctcatttctagagaaccttgactctcctccctcctagaatttcaacttcctatttcttttctcccactaagatttctttcttgtgattcaaaaattaccttatgcaaacctcaaatctccaagtcactgaattttcctttatatgtaattgattccaaaaaaatagattccatctgtactaaagaggtgcacatttatatcttcatggctttgagagtattagcctacttgtctttaatagaccaggagctctttggaagccagaaacctgtcttttcttttgaacctctcttactgctttaattttccaagttgtagactttttatgatactaatggaaaatatccctgaatccaatgccagttggcttcctttttctaactgttcaccttcaagctgttctgcacactgataccaaattaatttttccaaaatgaaaatctcaactggttgctcccaggcttgaagtccaaagtctttcattaatagggtattcaaaaccaatcacaacctggtttcacgttactttaacaactctatctcctgccacaccttcatgtacatacagaccagtcatgccaaaagctttctctttcccagacatacgtatgtattttacaacatttgggcttttgcacttatcctttccaacattctttgcctggtgtattcttaatgatccaaatgaaactttacatttcagcagcaagaaatctttccttaatcttccagcagaggaagcactgccactttcaagtttctggtcattttatatatatattatatatatacgtataatatataatatatatattatatatatacgtataatatataatatatatattatatatatacatatatataatatatatatattatatatatataatataatatatatatattatatatataatataatatatatatattatattatatacatataatatataatatatatacatataatatataacatacaatatataacatataatatatacatataatatataatatataatatatatacatataatatataacatataatatatatacatataatatataatatataacatattatatatacatataatatataacatattatatatacatataatatataacatatattatatatacatataatatataacatatattatatatacatataatatataacatatattatatatacatataatatataacatatattatatatacatataatatataacatatattatatatacatataatatataacatatattatatatacatataatatataacatatattatatatacatataatatataacatataatatataatataacatataatatataatatataatatatattatatacatatatataatatataatatatattatatatacatattatatatataatatatattatatatacatattatatataatatataatatatattatatatacatattatatataatatataatatatattatatatacatattatatataatatataatatatattatatatacatattatatataatatataatatatattatgtataatattatatataatatattacatatattatatatacatataatatctgaatataatatatatattatatatacatatatctaaatataatatatatacatataatatctaaatataatatctaaatataatatctatattatatatacatataatatctaaatataatatctacattatatatacatataatatctaaatataatatctatattatatatacatataatatctaaatataatatatatattatatatacatataatatctaaatataatatatatattatatatacatataatatctaaatataatatatataaaatataaacataatatctaaatataatatctatattatatatacatataatatctaaatataatatatatattatatatacatataatatctaaatataatatatatattatatatacatataatatctaaatataatatctatattatatatacatataatatctaaatataatatatatattatatatacatataatatctaaatataatatatatattatatatacatataatatctaaatataatatatatattatatatacatataatatctaaatataatatatatattatatatacatataatatctaaatataatatctatattatatatacatataatatctaaatataatatctatattatatatacatataatatctaaatataatatctatattatatatacatataatatctaaatataatatatatattatatatacatataatatctaaatataatatatatattatatatacatataatatctaaatataatatgaattatatagatatatctaaatatatatattatatatacatatgatatctaaatatataatatatacatataatatctaatatataatacatatattatatatacatatactatctaatatataatacatatattatatatacatatactatctaatatataatacatatattatatatcatgtaatatgtaatatataatatatacattatatacacatacgacatataatatatacattatatacacatacgacatataatatatacattatatacacatacgacgtataatatatacattatatacacatacgacgtataatatatacattatatacacatacgacgtataatatatacattatatacacatacgacgtataatatatacattatatacacatacgacgtttaatatatacattatatacacatacgacgtataatatatacattatatacacatacgacgtataatatatacattatatacacatacgacgtataatatatacattatatacacatacgacgtataatacattatatacacatacgacgtataatatatacattatatacacatacgacgtataatatgtacattatatacacatacgacgtataatatatacattatatacacatacgacatataatatataatatatacattatatacacatacgacatataatatatacattatatacacatacgacatataatatatacattatatacacatacgacatataatatatactatatataatatacacatacgatatataatatataatatatatataatatacacatacgatatatgatatataatgaatattatatacacatacgatatatgatatataatgaatattatatacacatacgatatatataatgaatattatatacacatacgatatatgatatataatgtatattatatacacttacgatatatgatatataatgtatattatacacttacgatatatgatatataatgtatattatatacacgtgtaatatatgatatataatgtatattatatacacgtgtaatatatgatatataatgtatattatatacacgtgtaatatatgatatataatgtatattatatacacgtgtaatatatgatgtataatgaatattatatacacgtgtaatatatgatgtataatgaatattatatacacgtgtaatatatgatatataatgtatattatatacacgtgtaatatatgatatataatgtatattatatacacgtgtaatatatgatatataatgtatattacatacacgtgtaatatatgatatataatgtatattacatacacgtgtaatatatgatatataatgtatattatatacacgtgtaatatatgatatataatgtatattatatacacgtgtaatatatgatatataatgtatattatatacacgtgtaatatatgatatataatatgtatattgtatacacgtgtaatatatgatatataatatgtatattatatatacgtgtaatatatgatatataatatgtatattatatatacgtgcaatatatgatatataatatgtatattatatatcatatatgtgatatataatatatatattatataacatatatgatatataatatatattatataacatatatgtatataatatatattatatatcatataatatatgatatataatatatattatatatacctataatatatgatatataatatatattatatgtacctataatatatgatatataatatatattatatgtccctataatacatgatatataatatatattatatatccctataatacatgatatattatatatattatatatacctataatacatgatatattatatatacctataatacatgatatattatatatattatatatacatacaatatatgatattatatattacatatacatataatatatgatataatatatattatatatacatacaatatatgaatatataatatatattatatatacatacaatatatgaatatataatatatattatatacatacaatatatgaatatataatatatattatatacatacaatatatgaatatataatatatattatatacatacaatatatgaatatataatatataatatatacatacaatgtatgaatatataatatatatcatatatacatacaatgtatgaatatataatatacatatcgtatatacatacaatgtatgaatatatgatatatattatatatacatacaatatgtaatatatatattatatatacatacaatatgtaatatatatattatgtatacatacaatatgtaatatatatattatgtatacatacaatatgtaatatatattatgtatacatacaatatgtaatatatattatgtatacatacaatatgtaatatatattatgtatacatacaatatgtaatatatattatatatacatacaatatgtaatataatatataatatagaaatttatatgtgtaattatatatttatttttatatttatatatttattatatatttatatattatatatatatttatattatatttttgttttgttttgttttttgctccttagatgattttgtctttcttctttaatactgttagtatttcaagaacagttgtatactctgtgcttgaaaattttattatctgaaatgtttaggggagtctaagtctattgttagttaactttgttgactttctttcatgttgacttattaccttgtgtgcttggtgatcttattttttttaagctgtgataatcttataactgtgggtctcattcctccagagatgatttgccttctcctctgtgtgcaagccaagaattgcttccaactggcattatgttagcttccttcaaggatctcagcttcatgtgggaatcagaggttcacattctctaccttggatcactaggcttagtagcccaattttaaccttgctatgggaatttgccacacggagattctaggttttgcttactaagcccccttttggttttagctcagtgttttgttatcctgttattgttttcatctcttggatatatttcttactttcttgcaaatccaacaatattttaacaggaatatgtgttgtaatttaactaggatcagggaatattttactgggtaagtctccagaagaatatccggtccaccatatttctggaactgtggttctggactcctagaatatcctaacttttgtgttgttttcattgttcgccttcattttttaatgaatgtgcctattttttcctataatatttaaggtcgttcagatcaggggttgtgatttatttatttttgtatctcattgacttcttagaaacgactgctactcagtacatgaatatttaatgaaagcagatgtttttgctgataataaaaactaactttcttgcatagtgaaaggctgaactgtgaaagaatacaatggagaatatgagaccagtgacagaggagaaacaagaagagcaggaaactgggaggttgcttagagcagtgatagaatgaggagagactccaaataaaaatttctctcttctccccctcttcctctctgtccatctactttaccatgtatttgagtaatgttttgtgtttcttattctaaattatagagtagattagaatgatttgtttttctttcaaaacaaactaataaccaataatcagataagttactactaaatagatggaccttattatatgttgttgctttctgagtataaatggtccttaggcaggcgaaaatgtgtcttcctcacagcactggacacttctactgagggcatcattgctaaagtgatataactgaaccagttattgcccaagatttatttctcttctcatactctgtattctaagtagtagttgcagaagcagcttttatttgagttattgcagtgcctctggtgcttaagttcttgcctctaacatagatgttattgttaatgtttggggtatttctatctcttgtgacactgttgatattaaagataggggcgcctgtcaattttgtgtttgtgcctgaagaaaagcagaaccatctgctgctagtaacttttccaatttgaaatttgatggaaatattctcagctcggctggcaaaattctctgactcctgtctttgtgtcttgaatcttgttccccacagtcgaaagaaccctcttggtcttatcattgccctagatgagaacaaagaagcaaaaggagaacttttctgggataatggggaaacgaagggtgagcacttatacgataatgttgctgtttcccaacctgcacctgtgacttatggtccttcactcctgctggtcattcagctgtgggagaaatctcagtaggcacagtagcaagagtcacttaagtattttgtttctggttgcaccattcagaggtagtggtagatgacctacaaaggaaagaaaaatacatttctatctctggcaattctcctattggacagtgatatctataataggctttttatttatttatttatttatttatttatttatttatttatttatttatttattgaggtggagttttgctcttgttgcccaggctggagtgcagtggcgcgatctcggctcactgcaacctctgcctcccaggctcaagtgattcttctgtctcagcctcccgcgtaggactacaggtgcctaccaccatgcctggctaattttttgtatgtttagtagagatgaggtttcaccgtgttagccaggatgatctcgatctcctaaattcgtaatctgcccggctcggccccccaaagtgctgggattacaggcatgagccaccatgcttggccaataggctctctttttattgtcaatgggtgcttagaagagatggtttcaagactgttcccgtaacccaatgttaatgtcttcctcctgaaattcttatgagcaaatgttgatgatatagaaatcatgcccctgccagtgaggcagtgagaatatactttttagcatatttgtggatccagtatactaacaattcctgtgcttcaagtttaggaaatagattcccttgaggcatatgccttggaagcccttggaagggaaactttgcaatgttccagtaggaaagagaaggaaaaacaatggcttggccttggagactcttgtccatctaatccaatgtgtagatttaaatatttattttttaattgcaaaatatttaattggcaaataaagatgaaatatattcaaagtggacaatgtgaggatttaatatatatataggcatagtataatgattaccacagctattttaaggaacagatccatcaccacccatactgtagactggatccccagaacctattcatctaataactaaaaatttgtacccttgaccatcatctccccagtttccacacctgcaggctctaagaacaacagttatactgtctgcttctaggagctcaacttttttaggtttcacatgtaagtgagaccatgcagtacttgactttctgtctctggcttatttcacttagtataacgtcctctagattcatccatgctgttgcaaatggcagaattttcttctttttatgtctgaataatattctattgtatatatataccacaatttctttattcattcatccattgatggacacttaggttattttcatatctttgctactgtgcagaagtaaaattaaaaacttaaatgtaagggttgaaattgtaaagctcctagaagaacacaggaaacaacctccttgacattagtcttggcaatgactttttggatatgataccaaaagcaaaggcaaaatagcaaataataaacaagcatgactacatcaaactaaaaggcttctgcacaggaaaataaataatcaacaaagtgaaaaggcaaactacagaatggataaaaatgtttgcaaaccatgtatctcagaagagattaatataaaaaaataaggaactcatgcaactcagtagcaaaagatcaaatgacccaattaaaaagtgggtgaaggacctgaacagatgtttttccaaggaagacatacaagtggctaactggcatgtgaaaagatgctcaacatcagtaagtgacacaggtatgcaaataaaaaattacagtgagctaccacctcacacctgttagcatggaaataataaaaaagataagagataagtgctggcgaggatgtggagaaaatggaatttttgtagactgttggtgagaatgtaaattgttacaaccgttatggaaaatagtatgcatgttcctcaaaaaattaacagaacttccatacaatcccatgaaatcccacttctgggtgtatatccagaggacatgaaaccagtatctttaagagatacagtcactcccacgttcattacagcattatgtgcaacaaccaagatatagaaacaatctaattatacattgatgaatgaatgaataaagaaatgtgatacacatatacaattgaaaattattcatccataaggaaaaggaaaactgctatgtgtgacctcaaggcatagctgaaaggagtggtagggtgaaatctgttcttctgaggtgggcaggccagaatctgacttgtctttctctcactttcagatactgtggccaataaagtgtatcttttatgtgagttttctgtcactcaagtgagtagcatatttttatgaatcttaggtgtgggctttggactgaccattagcacatctgtgcttgtgtatattgtatatgtgtgattatatttgtaactttatatgcattattggctataggtgagtacatttctatttatgatttcatcgatgttttcaaaaggaggcattaatatagcagctagtgtttctgaacacagtttttaaatgcctgtgtgtttttatgatcgttttaaattagaggattatccaaataatgttgtacttcttcagcacacactagtagagaaagcagagaggcatttatggcagtggggggtatccggtctggaatggaatatttgagtgacttgagaatctgtgtatactcatatacctttatgcatacttggacttaattgttttgcagaaccgcttggaggtgaatatttcacaatcaacctacaaggaccccaataatttagcatttaatgagattaaaattcttgggacggaggaacctagcaatgttacagtgaaacacaatggtgtcccaagtcagacttctcctacagtcacttatgattctaacctgaaggtaaaaacccattttgttgagatggtacattgagaattctccatagcatcgtgatgttccttcttgccaagtttgcatgggtccctgaaggaccagggcacctttgaggcctgttttggggaagtgagagggctggggaaaaaaatgaggtggccagagctagaatgagttgggtatttttcttcttattcccttctctgcctatcagtgttcccgtctttctagctggtttcacttgcttttcccaaaaatagaataattatgatgagacccaggaacagcaaagttggaaagtggggaatagcctgacattattagactgtgaattttgtatgactagcacaaataagaattggtatttgaaaaaggccagtttggataggaaacttgtggtcaggttttggaggtcttagttaccaacttgatttaattctcaagcagtctcatattgatccttgaatgaaggctgtgctactgtgtgtgagcattgttgggagtgggagtgggggctggggactagtagaacagggaagtacaagatggtttagattgggaggagactaggagaaggatgataatctttagaatgtgatttttgtactccagacaagtgagaactttaacttgggaagtgttgtttaaagaagtgtcaagataagaaaactatatagaaaaatattaaatatttgaactaatggtattcaaggaaggtttcagaattggagtctttgggcttagagaaatgaacatgctgggatgttagaaatagaaagaaatataatgtttttttcaacttttcaaatttgccgttgctaaaattgaaacccaaagaaatgaaacagaatacctgacttaccctgatgtgattattatgccctgtatgcctgaatcaacatatttcatataacccataaatatgcatacctactatatacccattaaaattaaaaattaaaaaaagaaatcatttgtccaacattctacagaaatgtgggcatgataaccaggtcatatgattcttattgctgtgctctttctaccactccacgccaatgggtgatactggtttgggcattggagagcaagaggatcaactcactttaggatgacatcatgtgtcatctcacagcgagctaagaggagtcagggtagaaaagaataaggggtgatcacaacaggttttatttgacctaactgttttcattatgctaagtacaagattgtgctagaggggagacatttgacctgttgctgctaaatagattctcccaatgtgcagttctcttcttataagctaaagtcatatgttgcttggatgtttgaaagtctggtctaatttctattttttttttatcgaaaaaaaaacctcaggtcttgcaaagcctgtctcctaaagatgaatttccttatgatttccacattcctacaggttgccattatcacagatattgatcttctcctgggagaagcatacacagtggaatggagcataaagataagggatgaagaaaaaatagactgttaccctgatgagaatggtgcttctgccgaaaactgcactgcccgtggctgtatctgggaggtaaccatgctgatggggtttgtgtgcatgagaatctccacacctaatctgtagtttcttaagcatagcagtggtacttacataactacttaaaatccatagaaagaacttcctaagggacaggatctagatgtgacaagtaggtggggacatgtgcgaaacttcttaagatgaatattttgcttggagacaaggaattgaaatttatgttattgccaagtgataagtgatgggctagttttatcgtcatataaaatgactttactaaccctgtttaggttagagaactttaagaccacatgctgtgctgatctatgactttggccttacttttcaggcatccaattcttctggagtccctttttgctattttgtcaacgacctatactctgtcagtgatgttcagtataattcccatggggccacagctgacatctccttaaagtcttccgtttatgccaatgccttcccctccacacccgtgaacccccttcgcctggatgtcacttaccataagaatgaaatgctgcagttcaaggtaaacacagtacatgtatcaggtagtgattagacccttttcagttccattaccttttattggtctggatcacagaaccctaaaataagttaatcatgctacaacagactatatcattatccagagagcattgagaaatcattgagggaacaatgagacctgccctaattttcatttggaaaagattactgtggctactgttaggaaaatggttgggagagcaagagtaggtacggagagacaacttgggaggctaccagttaggcaggtcagtggagggattaggtttggactagacagtggaatgcaggtggagaacagtggacccgtctgaggttgagaaagttgggttacaggatctagtgctcaattgcaagcaggtgacaatggagatggaacatcaagaatgatgaccgtgttggtatcttgcatcttaatatggatggtgctgacattaactcaaataggaatactgaaaaagtttgtgcttgatcaatgtaagatgatatgttcagtttgggatgctgaatttgagatttctgtaaaatggccatcaatatgcagtaatttcatttctttccagaatttaattgcatttaaggactagggatggactagctgtgatgtctatttttctattaaactaagcttctcaaggacaggaatgtgccctttcctgtttgtgcttctgaaatctacagagcctggccgatagtgctgtaatgttattgacagagtaagtgaaagtggtcaggacattgtcacattgcctgaaaggttctttacaatctgacatcaacccgaattctgagttcttgttcatcctctaatgcagggaagaatctcttgtatgtttgtaccctccttgtaacactagcatgttttaggcacctaatgggtttgaagtgaatgaacttccctggagttctagccttaaccattgcctactctacctcttgaccgtagagtaactctttccaaaatatgtgcctctttctggcccactttaattctctctgccttcgtggttgttattcttcaccagaatgacttgatctcctttctttgtttggttaatgactaccaagcttttaatattctagactgtatttctcccgtgagaccgtctcagtctcccagaaacaatgttaggcatttccttccctagaatctcacagcacttctacatagctctcccttagcacacatcacccacgtgttgtgagctgctctctttgacttcttattcgcatgtgaatttcgtaaaaccataacactgccttattgagctcacgtccctagtgtcttgtgcagtgtcaggcaggggatgtagtaggtactcatgaatcagtttagataccactttcagcaaggacattctgattattttaatcaaatagatttcattttggggagacaggtttttttttgaactcataatgattttaagttatttatatatactcatatacccacagaaaataacaagtaacatattcataaataccacactgattccagaatgattttccaagtcagcagcaatgtcccattgagtttattaaggtaatagaggccttaataatgagaaatcacagaaaaatgttaaatgtgacattgttatctgatatattaattaaatctcagatatcataaagaagatagaaacatagcatctgaactttgtgtccaaaaatcaaaaaggttctgctaagggtataggtttcaagagtagtattgttgcctaaaattgatttcctctggcctagatttatgatcccaacaagaatcggtatgaagttccagtccctctgaacatacccagcatgccatccagcacccctgagggtcaactctatgatgtgctcattaagaagaatccatttgggattgaaattcgccggaagagtacaggcactataatgtgagtggcttctagtgtgactcagagttgatggctacctgcgccttcgctgccaggtccattgtccttggatgtatcctggttcaaaacatcacattgtccacttccagatccatggatgagttgtttccttcagacctattcttacaggaaatctttagcattctggaaataaatactgaaggagttgaatgtgcctgaggattcatccaacaaatgtttatggggtgccttctctagattaggtgctgctccttatacacagctgaggtttctcttctcatgacaacaaataataagtaaatatcactttgagtgctatgtagaaaatggactgaggggtgcaaggatggaaggcagtgctggtgtggagtggtcccagctgtgatgatgaggggtgcttggatttgtattgtggaggaccactgaaaggaggcagtgacagagggaaacggaagaatgatgaataactcctgggcttttagcgaggatatctgtgatattttaatcaaattgagtttcagttttgtttgggatatgaacagcttcttggtaggaatcaagtgttctgttgtccttgaaaagtcacctgctggaaacagagataaaagctcattttctgtttcaaatctgcgtttttgtgtttcagttgggactctcagctccttggctttaccttcagtgacatgtttatccgcatctccacccgccttccctccaagtacctctatggctttggggaaactgagcacaggtcctataggagagacttggagtggcacacttgggggatgttctcccgagaccagcccccaggggtaaggacagagcatttgggatctgtgtctctgcttctctccacccacactgctcaggctttgggcttcatcttcccaaactccacttggtcatcacattctgcttttaggcaagtgggccaattctcaggctcctttgtttcatgtgtttagtttatgtgtctagtttcatggagaaaactagagccatgttagcaagcacatttttgttgagtttctttctcaggcataatgtcttttaaactcctactgcttcttcccatgactccccagtacaagaagaattcctatggtgtccacccctactacatggggctggaggaggacggcagtgcccatggagtgctcctgctgaacagcaatgccatgggtaaggccatcagcacctcccttattttggggggataccaatcatgcctgagtcaatttacaatgtgtttagcctaactgttccttgaaggcaaaatcttcattttacgggcactgctgtttattttttctttgtgtttagcctttctgtttatttcaatctaatatcatgtaataagaagatttaacccaactctcattttggtaaaaatcacataagaagggatagtaacaccacatgggtcccaaatatcctggagggcagctcgtgagagccagttatataatttgaattagggtaaaactatgggtcagagaagttagtctgggggtattgagggtgtatggtatgttggaaaattacctatcgggtactctgctcactgtccgggtgagggatccataccctaaacctcagcatcatgcaatattcccatgtaaggaacctgaacaggtatctctttatctaacataaaacttgaaatgtaaaaaataataattttataagagtagaatgataaaatatagtaaagtaccctaaagagaatcaaacccaggaatgggacctgtagacttccattgatcttcttcagttctgtgagtatgatagaaaatgcctgctgttactactctatgatagggagggtgcaggaagatggagaatgtgtggatttcaggggtgattcgtgacatggaaggtgtccgtgaggcttggcatttttctttattttcagatgtgacgttccagcccctgcctgccttgacataccgcaccacagggggagttctggacttttatgtgttcttggggccgactccagagcttgtcacccagcagtacactgaggtagggggaaatccaattgtttatcaagtacttacacagcacattctgggtgccagagtccacattgattagtataactctcagttgacaactggaaatattggtctttcttggagagagattatagaatgagaaaaaataaatacattctaattatcattaaatttatagcctctgtaagcattgcagaatagcagaagttatagtggtactagtggtggtgctggtagtgatagtagtgtgatgttggtgttatttgtggttatatggtgatgatggcagtaggggctgacggtggtgatagtgatgtgggaatggtgataatgatggtggtggtagtagtggtgttggtgatggtgatgatagtggtgggggtggtggtaatgggtgtgttggtgatgatgacggtgatagtggtggtgatggtgacaagggtggggctgacgatggtgtttgtggtagtgatggtgatgatgatggtggtgttggttatggtggtggtggtagtggtggtgacagtgaggtggtgtgaggagtgtgatgttggtgatagtggttgtggtgatagtggtgatggtggggatggtggttggggtggtggtgggggtggtagtggggggtggtggtgacggtagtgaagggtaatgataatggtaatggtggtgggggcacgatcgtggtactgggggtgatggtgaaaatagtgatgatggtggtggtgatgatggtgatgatgaccatggtggtcgtggcagcaacaacagacacttacatactaccaagtgcgcatcactgatttatcacttgctgcatgttagagcatttcacacatattaactcattcatgcatcacagaaacactatcaggcagatgctattattatccgttatttacagatgaagaaactgaagcactaagagattacttaatttttgcccaaggtcacacagctagcaggattggagcctgtatactaagccaggcatatgtctctgattctgggtttcttaaccagttatctacagtgtctctaggaatagcgtaacatcagattttccataatttttaagaaggagctcaagtctagcagaaagctttctctaagtatcctagtggctctatatcctgtcagttttggtctggatttcaattagttagttgtctagcttggggcacagaaaaatattcttattacttgatgtaaaacttcaatgtggtgcctctgttctgaagactaatattttctgtctattttctagttgattggccggcctgtgatggtaccttactggtctttggggttccagctgtgtcgctatggctaccagaatgactctgagatcgccagcttgtatgatgagatggtggctgcccagatcccttatgtacgttctcagtcatggctctggagtttcaaaactaacccaggtgcctctgtgtctgggttcatttgtctaatgtttgttggattccataaagacataaagttctttttcagacaatatcacagttagcctcaccccagcacagtaatataggtaagggcacttgtttccgtcttccagagatgacagctcaagacccagcatgactcgccagagtgggagataggctggctccagggctctttctgctctcccgtgcttccttccatttctttcacttggcttcaaaacatgtagtcaaaaaagtccttggtttcataagaataaagtatatcccacagttcttttacttaattcttgaaaagactaaccacaaatcaatcagacaattgtatatgtgaatacaacctcagttcctgcatcagctctgagctaataacagatggattaaacagatcctgggatgggtttccagaggacatacatatggaaagaaaccttatccttcagtggaggatgggaggggacccagtcatcagagaattgatcccatgaaccatcacatatttaattttatcccacttttctattgtttacagttgttccattagtggaatgtagtgtttccattagtggatagtgaaatgcaatattacagtctcaggaagaatgttgtgtatgattaccctcaagattcggtattccaaagcaactatacatctttgctttgttttgtagtagatttactattagtcctggataattaacagtatttttcctaaacatgaaccactgataccaggggcagcctcttggggtaggtcatcaccatcactcctgatagtggcagtttacaaagcactttccaaaccagtgttttctcttatcctcagaatagccatgctagagacgcattctcatcctagcttgtgctgacttcgattttttttctatcttatcactgaacattttaaaaattaagtgtatttcccagcacctgtacctaacaaatggcagagctgggatttgaatgcatcaacaagaagctgtctggaattccaccatgggtggtggagggttgttctcctataaagcttgggcgtgtacagcagcagcctctcagctccccatgtcctcccgcaggatgtgcagtactcagacatcgactacatggagcggcagctggacttcaccctcagccccaagtttgctgggtttccagctctgatcaatcgcatgaaggctgatgggatgcgggtcatcctcattctggttagtcctgatgtgaatgtgtgcggtctgtttgggagcaggtatgggctttggtggagtcagagttatactttatttccatgttgcaagtagataaattgaagtgcagtaagaaaggtgtatttcccaggactcacagaaactctactgtgcaggtagaagccagcgagttcacccttgaggagttctccttcattctgtttctcctcattctctggctttggttttcccaactgacttatgctttgatttcaggatccagccatttctggcaatgagacacagccttatcctgccttcactcggggcgtggaggatgacgtcttcatcaaatacccaaatgatggagacattgtctggggaaaggtataatcctaagcgatgatccactagtccccagcctgagggtgggtcactgttggtgggtcactgttagtgggtcacacgcctgtgtatgttatttttggccttttctatttgggctctgaggtcagaagctctccttttctcaatcaatatttgttgatacaattaacgacttttaaggtaatgtaacgtgttatggagttcacttttcttttatgtcaatcctatgtgatagtcaaagtattattgctcctaggagcacggtttgtataacaatttattaggaaatactatgtaagggaaattgtctagtgcatcgctactgaacgtatttctctccataggtctggcctgattttcctgatgttgttgtgaatgggtctctagactgggacagccaagtggaggtaaaagggtgtttgtaaatttgggtggagtcagggtttgtaggcaggggcagctgttcctgggattgtggacatgcctgtaccgtggacatgggcttggcaagggagaaacacttaggtgatgtgtcttgggtgtcattctgtatgcctattactttataggtagtcatactttactggccactgggatgtagatatgtattattatccttggaatttaagaccagagagcttaaattatttgttcacagttttaggtgacagagtggtgatttcaattccaaggctgtcagattccaaaggcccaagaaattcccactgggcgatacctcctagcagtgccatcttttctctgaactggcatacttactgttgttgcctcggttatcccttttaaacagtcttcaaccctcgaagactgactaggtcattttctttgtatatctttctttttttccccatgaacaggtgtctccatcttcatacttacgagtcctgccccgagccccaccattccttgggtttctcaactttgcttttacctgtcagtttccagccttattgtaaaacttgctctctcctggggacggtttgttgcttgtaatggatccaagtagtccatgcttctggacctgaatttttttcccgattgactaagcatttcttgcttgaatgaatacatggctccttacaggagagtggagaaagtgaaggcagaagccacaaggcaagagttgaatatggacaggcaaagccagcaccttggagaacggcagaacatttttatgaagttggaaagggtcatccgagcagtacttagggaagttcctacctcacggctggccaggttccctacgtgtaccccgtatgggatagaattctgactcagctgtggctgataatctctttattctaattctccatcccccacccatcccgtcgtttctaaccctgcctgatctggagctctcagtttctggtgaaaggttctctttgtcgggtttcctggttcctacctccatttcctaacaaaaggcatccctggcatgcccacgtctctcaagattctctgtgatgtgacccactgtcttctcacatccttgactgccagacccatataggctgatctgtttctgttttcttatgttcccttttctgccctttttctagacatctgggttcctacctgccctttatctgtggtgtataagaactggagctcccctagaccaagtcctgtttttgttgccttccccaccctcctcaccagcattctttagctctttcactcttacaatggtgtgattatcatagaggaggctatttactgagacaaacaaaggactgtaatgttctataacaaacaacatgagtatattaaaattgaaggacatttacttgctgcttctaagtggtgtgaacccactgttaaacactgagtatgtattttatcccaggttctaagctcagcattgtgggcaatataaatatcactcagaaggatataaaacaaacttcttactctcaaaaatctacaatgtagttaaaaagttgtatcttgaatctttctttcaggttaaggtaaaaacactgcttttattatgtgagggtagaggaaaataaagggaagttgatgcatcctctttaagtcctctcaatttatgttacacacagctgtagttgtcatgtgattctgaaatcgtagaaaacactgaggcgtacttgtctaatatccagaaatgtaatcttattccttcctcccctctctcagtgggaatgacataggagggagtccctgggtgtttcttcctaacctattaccatgcatctcatgtctgcagtctctccctggctttgtctttgaggagtgcataggaaatggcaggactgacgttgagggttgggcatcgagtgcatgaggtcactagttcgggtcattgattgtcatcatccacgtgtataggaagagaacagtttttggatgttttccaaatgctgggaaggtgtgcaaattgcactaatttctcctctcattctacatttctctaagaagttaataacattatttaggccctgttcaggctgtctgtcaccatgcagttgaagtatttgtgtgagttgcattctcagtaagtgcctgtttgctgtcttctatatttgtgtgggacaaagaaattatatttcttttttatagctatatcgagcttatgtggccttcccagactttttccgtaattcaactgccaagtggtggaagagggaaatagaagaactatacaacaatccacagaatccagagaggagcttgaagtttgatggcatgtggattgtaagtgtgtgtgtgtctctgtgtaccagtggctcttgtctatctttgtgtgcctaagtatatgtaccactgaccttcaatcaagaggatagtcattgtccaaagaagactttggacatagcagacacttcttcctctcaggagaggaactgccctggtagccctcacaccttctaccagacctgacgctcctactgtaaaacctgtgaggcgggaccaggcgtggtggttcacgcctgtaatcccagcactttgggaggctgaggtgggcagatcacctgaggttgggagtttgagaccagcctgaccaacatggagaaactccgtctctactaaaaatacaaaattagttgggtgtggtggcacatgcctataatcccagctatttgggtagctgagggaggagaatcgcttgaacataggaggcagagtttgcagtgagccaggatcgcaccattgcactccagcctgggaaacaagcataactccatctcaaagaatgaaaaacaaaaccaaaaaaaaaacctgggaggcaatttactaggaatttctggaaatttgattgcctcacagccaccctgaaagagatctatttttttacccctctagccagtcgttctgtaggagtgaattaatctttctagccagttctcaccaggatttgatgaagctcccagggctggcatctacagagattactggatgttgaacaatttattcactacttccttggctcagaattggcaggacgtaattatcttaaaaagtgaggtatgtctgtgtttggcatttctaggatatgaatgaaccatcaagcttcgtgaatggggcagtttctccaggctgcagggacgcctctctgaaccaccctccctacatgccacgtaagaagccttggcctccttgactggcagagccatgactggaaggattacactggaggagcccgaggccaggggcagccccacagctgagggcacatcctcatggctgctgtggtttactggggaccagagacaaaagctctgcacgtgctttacccagccgggcatgggcaagtgactagactcattgagcaaatttcttgaaatttgtccagaaagcacttagcagagctcatggcacaaagggttctcacagctgagtttcttagtttttaggcttgtgtgaattccatcacaggaatttcttgtgtcatcagtgagtggaaattactggcttccccttatcatggagctgatggactttggagttacacttgggttcatatcttggctccagaaattgttctctctaggagttttgtgacttttcacagattatgtgatatttccaaatctcagtttgctaaattgtaaaagacggataatgagatcttcttcatagaattatggaaataattggaagtcaaaagcctaaatcagagcccgtcatgtagtgtttgacagctgtacgttcttcctgacacctctgcttccttcagtgaacttgatgttggaaacacagcaggcgccaatgcagctcagagctgggggcgctgtgctcatgtctctggggagatggagagcgacacaggcaggactgaagttagtcttaagatccagggcccagtcccttgaagagaagtcagggagaaacagaatcagggctgggtttcacctcgccagttcttcctcctcagatttggagtccagggacaggggcctgagcagcaagaccctttgtatggagagtcagcagatcctcccagacggctccctggtgcagcactacaacgtgcacaacctgtatgggtggtcccagaccagacccacatacgagtgagtctccgtctcccttctccagctgtcacaacctatagcgattgccagtgactgacatagctaccctagttttcctttcattccatttctaaggattaagaagattctcataactctgtaatgattcttatttattaaacaaatgctcattgacatggagccaggccctgtgattaaaagtaggaggacagatttaaataaggcatggtcccaccagtgaaaaacttaatgatcctagtgggaaagactcacatggagacaccataatggtcacacagggcagccagtggaacaatagctttagttacaggaggtgaagggaacacagaggactgggcatctctcccgttcatttcaaagtgaatcatctttggagatgtttgtatttttggccattcttggtggagggtaactggtattgtactgaattagcacagtcctgctttgcaagctcaatgaatagtatgaattcttctaagaggatcttataaccttcactgtgttccttctcaaatatagaaaactaagtattgaggaaaccattagcaagacatagtaattccttagtattttgggagtactccagtgaggctgctacagtgaagttctttgtaaagcactgtgagaacacgtgactcattatctccatcatctgggatcagtggaactcctattacagctcagagtcccatgttccctccagtcacgcagcaaacattgactaggctcaagggctctgggagcagaagctctatggcctttactccctggctgttgcctcagttcacctcctgttcccttccaagcagagccgtgcaggaggtgacgggacagcgaggggtcgtcatcacccgctccacatttccctcttctggccgctgggcaggacattggctgggagacaacacggccgcatgggatcagctgaagaagtctatcattggtgcgtgggtccttccccagggcctttgccgacagggcagggagttgggatccttagggaagaggtgaggaggcagatcatgagagcctggtgtgacacagctgtgcttctcgttgcaggcatgatggagttcagcctctttggcatatcctatgtgagtgtccttgggatcctcctaagcaccaagaaggtggggacatctttcagaaatcatcagcaggctccttttatttcctcttgtttcagacgggagcagatatctgtgggttctttcaagacgctgagtacgagatgtgtgttcgctggatgcagctgggggccttttaccccttctcaagaaaccacaataccattgggaccagggtaggacagtggcttctacctccactgttttatgtcacttgaaagacagtctccatttctgtgctaaaagtaatgcagtctctatttcctgggatatctttaaaaaaaggtgtttttttttgttttgttttgttttgtttttttttttgaaacagggatttactctgttggccaggctgaatcgtgcagtgtcccaatcatggctgactgcagcctccacctctggggctaaagcgattgtcccacgtcagccttctgaatagctgggataaaggcacatcccagcgtggctacctaatttttgattttttgtagaaatgggatcttgccatatttcacaggatggtctcgaactcctgggctcaagcgatccactcgacagcctccaaaagtgctgggattacaggcgtgagccactgcacccttaaaaattgtgaagacctggtgtctcaatgaaccatattcctcattgtgctttagattattatttttttcctgtatttcaggcagaattttaccaaatgttccaaaaagaatgtcttacagtgaaattttatcagctgtcttaggagagctttggtgactctttccggtctattaagaatattctctgggcctcatgtatagttttcttttgtttagctgtgagtgatcttcaattggagtatgcttttagtgaccttcttaaatcccctagaaattccagggcgagctcccaacactgttctctttctcctttagagacaagaccctgtgtcctgggatgctgcttttgtgaatatttccagaaatgtcctgcagaccagatacaccctgttgccatatctgtataccttgatgcaaaaggcccacacggagggcgtcactgttgtgcggcctctgctccatgagtgagtgtccagcagggatcccgatgactaatggatgacttattgcattctatgtggtagcagttgatatacacaacgcttccaaattaaagacatgatggccttttgacatgagctcttcagacacaaagtatacctgattactgtctttagcacagtgttatacataccgtaggtcataaaaaaagggtatttattgaatgacgaaaattgaaatgatgcagtacagcatagaatagtttcattctaatttggttgtgcaaaggcctatcttatgtagcagttttgttatatggacccaggtcacaaaagaaggatttcagcaagagaattgagggacgagggccatcctcacatttaaaatgtgccatggttaagaaatgaggtaatattttacaggagagaacacatctacatcccagcatttctgaagtttgaggcacatcccatggggaaagcagaggctgggtgctcctgatgaagctaggcctaggaacaaagcaaggatggctcaggggcagctgtatttccgacttggatctgaacttgaggagcttcttcagagtgtcgggctggggctctgttgggctctgttgggcaccttcatttccctttccaggtttgtgtcagaccaggtgacatgggacatagacagtcagttcctgctgggcccagccttcctggtcagccctgtcctggagcgcgtgagtatggaggcctccgatgaggggaggatcccagctgtgaggcttggggaaaaggacgaggagaagaggcctgagctggtgggggtcctgagacatggtttcttattctacctgtgtctcttcctctctttctgagctgaagtccatcacttaggtgttcttggcactcagctccttcatctttaaaatgagcctaacaattctggttcgtaggatgatcaagaagaaaacacctcatggaatagtcaatgacacaatcatttcttcgttaactaaaataattaatagaaggtcagatgggggcagtattgtaaaaaatttataacagtcctctagcactattacaacttttcagaaggatgacttggcaatgtgtgtacttgtattgctgctggctaacccttcccttcctctacaggagctcctcccagcagtaaaagccatttctttacttctgttgttgattaggcttctgattaaaatatcaattaattgtacctccctcaaatatatatatatatatatatatatatataaatatatatatatatatatatatttttttttttttttttttgagacagagtctcactctgttgcccaggctggagtgcagtggcatgatcttggctcattcaacctctgcctcctgggttctagtgattctcttgccttagcctcttgagtagctgagactacaggcatgtgccaccattcccggctaatttttttttctttttttgtatgtttagtagagatggggtttcactgtattagccaggatggtctcaatatcctgacctcatgatctgcctgacttggactcccaaagagctgggattacaggcatgagccatcgcgcccggccccaaaatctcattatacccacaaaattttcttctgccccagacacaacctcccttgtttgtctctttaagagtcaaaggggtaagtctatgtctataagcaaacagtgatttattttttcccgaagtcctggatatcaaagtgctttatgaaagccacttgttttgggtagacaaatctctggtttaaaaaagaaaacaggaagaaggttgccccagttgttaacctcttgggacatgaggcagctgggtccaaagccatcacaattatttcacctctttcctaagcagtttggttactctgtcctggaaaatggtggcactgcctcaccttgtttgtgtttcattttagaatgccagaaatgtcactgcatatttccctagagcccgttggtacgattactacacggtaagtttttctgaatgtttatataacacgggaatgtggtagagagtacaaaggctttaggtccgatagaccttaggtcaaatgctggctctgtaacccacctgctgtgtggtcttagagaagccactttaacccttgtaatctcagttttctcacctccaagtggggtaagaccactttcctcatagaaccattgtgaaataacacataaagcatctcactcagggtctgtttttttgtgggtgttctctttgtgttagtttttaatatttctttatatcactgctatttacaatgttgtgtaaaggcagatgctagccaacatctgagattgtgttgcaaactatagtttttgtttttattgttgatatctttgcctgctgtaagtttgtaagcatagaggccgttttgtctcttttgattaaatacctccttccatagcatagatgctcaaagaggggcgctgcacataattacataaggcacacaagtgattaggcaatgtgcaaaacacacacagaggtatgggacccaacccttgtgtgtctaagtagtgcaagtgcatttagaaatgaggaagcaatgaagagctccttgccgcatagtttcattgctagtatgattcccaaagactcagctgggaagccagggtcttcccgggcagctctggggtggtgggctcttgctgggaccctgacaaatcagaccctgattcttggggaagaatcaaaggaggtatttccttcgtttctaactaggcctcttcttctgactttctgaggagaacatagttgagggctggaaatacaacaaaggggtacaagcagggatacaggaagcagagcatgtgctggcccctttcatccaaggagatttcagtgagattaagtgaaaagtggagaaggatgtgcaattttgttccttctcttctcagtccattggagcccaagtcctctccacagccccagactcctcttcctgctgctagtctggatctgcccttagggtggtaacatgttaaggctctgctatgtgtgtcccagccaggcgtttcccaggaagaggtggccagctttctttacgtgagactggcctttgtcctgagtgtgcatgttgagtctcccattcactaccagaagatatctttgatggaagagggaaagacaaaagaagtcatggagcaagctgtttagaaaaagatgaaattgggccaggtgtggtggctcacacctgtaatcccaggactttgggaggccgagatggacagatcacaaggtcaggagatcgagaccatcctagctaacacggtgaaaccccatctctatgaaaaataaaaacaattagccgggtgtaggggcatgcacctgtagtcccagctactcgggaggctgaggcatgacaattgtttgaacctgggaggcggaggttgcagtgagctgagattgtgccactgcactccagcctgggtgacggaaccagactttgtctcaagaaaaaaaaaaaaaagaaagagatgaaatttttaatgtttaattaaaatgaagatgaatctcataattaggattaatgaagaagtgtcaccttaattaatcttcccaagtttgggtaactattactcattctagagcacaagctggcaaactatggcccacagccaaatctggttgttagctgatttgcaaataaagttttagtggaacacagccatgcatatttgtttgcttgttgtcaacaataactgcttcttacctgtaaagtagcagctctgaaatgagaggattttgcctaccaggggacatttggcaatgcctggagatatttttggttgtcacaacaggctgggggtgaggaggctatgcggctgacatctgaggattctgctaaatatcaaaaggcacaggatagccccatcgccagagaattgtctggccccaaatctcaatagtgctgagactgaaaagccctgctctagttgagaacatgtaggatggaaggatggtcccttaggttctgatacaggtgagagtgtagcagttcttcctgttacacatcaggcaaatgtagtttgtatggtggaagcaaaggtaagagaccctaacaagatattatagcagccttgcgaggttttatgcagcactgtgcgaatgcagaatgggtaatagcaggtatgttgcaaagggtgatgaacaggcataagttcagaggggaggatgagatgtctggcaggatgcattgttcagggaggggcctgtcctctccttcatcatcttttaccttcttctgcccccagggtgtggatattaatgcaagaggagagtggaagaccttgccagcccctcttgaccacattaatcttcatgtccgtgggggctacatcctgccctggcaagagcctgcactgaacacccacttaaggtgaatgacaggactcaggttttcctttacatttcagttagctcaacaatttgtgatgaagtctaccaaaatgtaagcatcactttcaaacccacatgcaattctactcaacacttgttttttctttgttttgttgtttgtgtgttaatctttttcagactctatactttttgtctaattattaacaactcttttaagtctaagggagtgagatgaaaggtctaagaatgtcattttttaaatctcacatctgacatggaagtcaaaataagagcaaccacaattcacaagagcttttcagaagctgttgttttagaactgtatccagtagattttgaaagactgtaattcatgtccttccttaaaccctttgaatttcttttcaaacacgctaacagccaggtggtcagcctccttggtttgccaggactgatgcattttagcaccagaactctcctctcttgagatgcttctcaattctgggtaaaccaggtcagttgatgcctctatctgccttggccacactgctcacccatgtttctttactcttgaatcacttattctcattttaggagggtcaggatccactttccaccctcctagaatctcaacttcctctttcttttctcccgctaagagatttctttcttgtgattcaaaagtggattcaaaaaaaccctcaaaagtctatgtcactgaattttgctttatacgtaattgattccaaaattatagattccatctgtactaaagaggtgtgcatttatatcttcatgcctttgagagtattaacctatttgtctttaatagactaggagttctttggaagccagaaacctgtcttttcttttgaacctctcttactgctttaatttttcaaattctagacttttttatgatactaatgggaaatatccctaaatccaataccagttggcttccattttctaactgttcaccttcaagctgttctgtacagtgataccaaattgatttttccaaaatgaaaatctcaactggttgctcccaggcttgaagtccaaagtctttcattaatagggtattcaaaaccaatcacaacctggttccacgttaccttaacaactcttatctcctgccatacctccatgtacatacagaccaggtatgccaaaaaactggcgatttcccaaacatacccatgtattttactgcatgtgggcttttgaatttatcctttccaacatctgtgcctggtgtattcttaatgatccaaatgaaactttacgtttcagcagcaagaagtctttccctaatcttccagcagaggaagcactgccacttccaagtttctggtcatttgtaatatatatttatttgctccttagatgattttgtctttcttctttagcagtgttagcatttcaatagtagttgcatactctgtgcatgaaaattgtagtatctgaagtgtttaggaccatctaaatctattgttagttctttgttgctgactttcctttatgttgacttattaccttgtgtgcttggtgattttttgtttcatactgtgataatcttaagcatctaaatgtgggtctccttcctccagagatgatttgccttctcctctatttgcaagccaggaattccttccatctgacatcacgttaacttccatcaaggatcccggcttcatgtgggaatcagaggttcacattctgtaccttggattactaggcttaatagcccaattttaaccttgctgtgggaatttgccacatggagattctaggttttgcttactaagcaccctttgagttctagctcagtgttttgctatcctgttattgttttggtctcttgagtatattccttactgtcttgcaaatccaagaacattttagcaggaatatatgttataatttatctaggatcaggtaatattttactgggtaagtctccagaagaatatacagtctaccatatttgtagaactgtgtttctggactcctagaatatcttaaatttgtgttgttttcactgtctgcgttcattttttagtgaatgtgcctaatttttcctataatattgaaggtcgttcaggtcaggggttgtgatttattaatttttgtatctcattgacttcctagaaatgactgctactcaatacatgaatatttaaagaaagcagatgattttgttgataatggaaactaactctcttgcatagtgaaaggctgaactgtggaagaatacagtggagaatgtgagtccagtgagagacagaggaggaataggaagagcaggaaactgagaggttgcctagagagtgacagagtgaggagagattccaaataaaaattgctctctatcctcttcttcctctatgtccatctactctaccatgtctttaagtaatgtgttgtgtttcctattctaaattctaaagtagatcattagaatgatttatttttctttcaaaacaaactaataataaataatcagatacattaccatttagtagatggaccttagtgtatgttgttgctttctgagtataaatggtccttaggcaggcgaaaatgtatcttcctcacagcactggacacttctcctgagggcatcattgctaaagtgatctgactgaaccagttattgcctaagatttctttctcttctcatactctgtattccgaacagtggttgcagaagcagcttttatttgagctattgcagtgcctctggtgcttaaattcttgcctccaacgtagatgttattgttaatgtttggggtgtttctatctcctgtgacactgttgatattatagaaaaatgcatctgtcgattttgtgtttgtacctcaagaaacagaaccatctgctgctagtatcttttccagtttgaaatttgatggaaatattctcagcccagttggcaaaattgtctgactcctgtctttgtctcttgaatcttgttccccacagtcgaaagaaccctcttggtcttattattgccctagatgaaaacaaagaagcaaaaggagaacttttctgggatgatgggcaaacaaagggtgagcgctgttacaataatgttgctgtttcccaacctgcgcctgtgacttatggtccttcactcctgctggtcattcagctgtgggagaaatctcagcaggcacagtagcaagagtcacttaagtattttgtttctggttgcaccattcagggatagtggtggacgaactactgacgaaagaaaaatgcatttgtatctctgacagttctcccattcgccagtgatacctataatggctcttattttattgtcaatgggtgcttagatgagaaggtttcaagactgttccctaattctatgttaatgtcttcctccgaaaattcttatgagcaaatgttgacgatataaaaatcatgcacctgccagtgaggcagtgagaatatactgttctagtgtgtactcagctagccatacgttttagcatatttgtgggtccagtatactaacaattcttgttcttcaagtttaggaaatagattcctttgaagcatatgccttggaagcccttggaagggaatctttgcaatgttctggtagaaaagagaaggaaaaacaatggcttggccttggagactcttgtccctctaatccaatatgtagattaaaaattaattatttatttggtagtcaaatattttgttggcaaataaagattgaatatatttaaggtggacgatgtgaggatttaatatatgtaggcatagtataatgattaccacagctattttaatgaacacatccatcactaccaatgctgcagactggatccccagaacttattcatctaagaactgaaagtttgtacccttgaccatcatctccccattttccacttctgcaggctctaagaacaactgttgtaggctctgcttctaagagatgaacttttttagattccacatatgagtgagaccacgcagtattggactttctgtctctggcttatttcacttagtataatgtcctcctaagtcattcatgctgttgcgaatggcagaatattcttctttctatgtctgaaaaatattctactgtatatatgtaccagaacatctttatctattcatccactgatagacacttaggttgttttcatatcttggctactgtgaagaaagaaattaaaaattgaaatgtaagggctaaaattgtaaagctcctagaagaaaacatagcaaaaaacctccttgacgtagtcttggcaatgactttttggatatgataccaaaagcaaaggcaaaatgccaaaaagtaaacaggcgtgactacatcaaactaaaaggctcctgcacagcaaaagaaacaatcaacaacatgaaaaggcaaactacagaatggataaaaatgtttgcaaaccatatatctcagaagagattaatatcaaaaaataaggaacatatgcaactcagtagcaaaagatcaaatgacccaattaaaaagtgggtgaaggacctgaacagatgtttttccaaggaagacatacaagtggctaactggtatgtgaaaagatgctcagcatcagtaaatgacacaggtatgcaagtcaaaaatcacagcgagatgtcacctcacacctgttagcatggaaatcataaaaaagaaaggagagaagtgctggtgagggtgtggagaaaatagaattttttagactgttggtgggactgtaaattgttacaaccattatggaaaatagaatggaggttcctcaaaaaattaaaaacagaacttccatacaatcccatgaattcccacttctgggtgtatatccagaggacatgaaaccagtatctttaagagatatactcactcctcccatattcattacagcattacttgcaacagccaagatatggaaacattctaagtatacattgatgaatgaatacaatggaatattattcatccataaggtaaaggaaatactgccatttgtgacatcaggatgtaactgaaaagagtgggagtgtgaaatctgttcttctgtggtgggcaagccggagtctgacttgtctttctgtcactttcagatactgtggccaagaaagtatatcttttatgtgagttttctgtcactcaagtgagtagcatatttttatgaatcttaggtgtgggctttggactgaccattagcacatctgtgcttgtgtatatgtgtgattatatttgtaactttatatgcattattggctataggtgagcacatttctatttatgatttcatcgatgttttcaaaaggaggcattaatatagcaagtagtgtttctaaatatagtttttaattatctgtgtgtttttatgattgtatcaaattagaggattatcaaactaatgttgtacttcttgagcagacactagtagagaaagcagagaggcattcatggcagtggggggtatccagtctggaatagaatatatgagtgacttgagaatctgtgtattacaggcatacctttatgcataattggagttaattgttttgcagaaccacttggaggtgactatttcacaatcaacctacaaggaccccaataatttagcattcaatgagattaaaattcttgggatggaggaacctagcaatgttacggtgaaacacaatggtgtcccaagtcagacttctcctacagtcacttatgattctaacctgaaggtaaaaacccattttgttgagatggtacattgagaattctccatagcaccatgatgtttcttcttgccaagtttgcatgggtccctgaagtaccagggcacctttgatgcatgttttggggaattgagagggcacctttgatgccttttttggggaaaaaaatgaggtggccagagctagaatgagttgggtatttttcttcttattcccttctctgcctatcagtgttcccatctctctagctggtttcacttgcttttcccaaaaatagaataattatgatgagacccaggaacagcaaagttggaaagtggggaatagcctgacattattagactgtgaattttgtatgactagcacaaataagaattggtatttgaaaaaggccagcttggataggaaacttgtggtcaggctttggaggtcttagttaccaacttgaattaattctcaagcagtctcatattgatccttgaatgaaggctgtgctactgtgtgtgagcattgttgggagtgggagtgggggctggggactagtagaacagggaagtacaagatggtttagatttagaggagactgggagaaggatgataatctttagaatgtgattttattactccagacgtgtgagaactttaacttgggaagtgctgtctagagaagcatcaaagataagaaaaatatatggaaaatattaaatatttgaattaataggattcaaggaaggtttcaaatttgcagcctttatgcttagaaaaataaagatgctgggatgttagaagtggaaagaaagatgattttatttccacctctcaattttgctgttgccaaaattgaaattcaaagaaatgaattagaattcccaatttgccctgatgtgattattattcattgtatgcctgaatcaaaatatttcatatactccataaatatgtatacctactatatactcattaaaattaaaaattaaaaaaagaaatcatttgtccaatatactacataaatgcgagcatgataaccaggtcatatgattcttattgctgtgttctttctaccactccacgccaatgggggatgctggtttggggactggagagcaagaggatcagctcactttgagatgacaccatgtgtcatgctaaagaggaagtgcagaagacacccttccagacaagacacagagggctaagaggagttagggtagaaaagaataaggggtgatcgcgacaggttttatttgacctaattgttttcattatgctatgtacaagattctgctagaggggagtcatatgccctgttactgctaaatagattcccccactgtacagttctcttcttataagctaaagtgatatgttgcttggatggttgaaagtctggactgatgtctatttgtttttccaaaataaataaataaataaagtcttagattttgcaaggcctttctcccaaagatgaatttccttgtgatttctgcattcctacaggtcgccattatcacagacatcaatcttttcctgggagaagcatacacagtggagtggagcataaagataagggatgaagaaaaaatagactgttaccctgatgagaatggtgattctgcagaaaactgcactgcccgtggctgtatctgggaggtaaccatgctgatggggttcatgtgcatgaaaatctccacacctaatctatagtttcttaagcatagcagtggcacttatataactacttaaaatccatagaaaggacttcctaagggacatgatctggatgtgacaagtaggtggggacatgtggaaaactttttaaaataaatattttgcttggagaccaggaaattaaatttatgttattgccaagtgataagtgataggctggttttattgtcatataaaatgacttttctaaccctgtttaggttagagaactttaagaccacatgctgtgctgatctatgactttggccttacttttcaggcatccaattcttctggagtccctttttgctattttgtcaacgacctatactctgtcagtgatgttcagtataactcccatggggccacagctgacatctccttaaagtcttctgttcatgccaatgccttcccttccacacccgtgaacccccttcgcctggatgtcacttaccataagaatgaaatgctacagttcaaggtaaacacggtacatatatcaggcagtgataagacccttttcagttccattatctttttctggttcaggtcacacaaccctaaaataagttaatcatgctacattagactatgtcattatccagagaacattgagaaatcattgagggaacaatgagacctgccctaattttcatttggaaaagattactgtggctactgttaggaaaatggttgggagagcaagagtgggtacggagagacaagttgggaggctgccagttaggcaggtcaagtgagggcttaggtttggactaaatactggaatgaaggtggagaacagtgcacctagttgagattcaggaagttgggttacagggtctggtgcttgattgaaagcaggcgacaatggagagggaagcatcaagaatgatgaccgcgttggtatcttgcatcttaatatggatggtgctgacatcaaccagaatgggaatactgaaaaggtttgtgcttgatcaatgtaagatgatatgttcagtttgggatactgaatttgagatacgtataaaatagccaccaacctgcagcgatttcatttctttccagaatttaattgcatttaaagactagggatggactagctgttacgtctgcttctctattaaactaatcttctcaaggataggaatgtgccctttcctctttgtgcttctgaagtctaatacagagcctggcagatagttagtgctgtaatgtaattgacagagtaagtgaaagtgatcaggacattgtcacattgcctgaaaatttctttacaatctgacatcaacccgaattctgagtttttgtacatcgtctaatgcagggatgatgctgttgtatgtttgtaccctcatcatagcactagcatgttgtaggcacctaatgggtttgaagtgaatgaacttccttggagttctagccttaaccattgactactctacctcttgaccatacagtagctctttccaaaatatttgcctctttctggcccactttaattctctctgccttcgtggttgttattcttcaccagaatgacttgatctcttttctgtgtttggttaatgactaccaagtttctaatactctagattgtatttctcctgggagaccatctcagtctcccagaaacaatgttaggcatttccttctctagagtctcacagcacttctacatagctctcccttagcacacatcacccaggtgttgtgagctgctctcttacacttctcatttgcttgtgaatttcataaaaccataacactgccttattgagctcacatccctagtgtcttgtgcagtgtcaggcagggatgtagtaggtactcatgaatcagtttagataccaccttcagcaaggacattctgattattttaatcaaatagatttcactttggggagacacgttatttttcaattcagaaaagttttaaggtatttatatattctcatatacccacagaaaataacaagtaacatattcataaataccacgctgattccagaatgattttctacgttagcaccaatgtcacaatgcttatattgatgcagtagaggccttagtaatgagaaatgacagacaaacatattaaatctgacattgttatttgatgtgttaattaaatctcagacatcataaacttaaagaagacagaaacatagcatctgaacttttgtccaaaaatcaaaaaggttctgctaagggtataggtttcaagagtagtattcttgcctaaaatcgttttcctctggcctagatttatgatcccaacaacaatcggtatgaagttccagtccctctgaacatacccagcgtgccatccagcacccctgagggtcaactctatgatgtcctcattaagaagaatccatttgggattgaaattcgccggaagagtacaggcactataatgtgagtggcttctagtgtgactcagagttgatggctacctgcgccttcgctgccaggtccattgtccttggatgtatcctggttcaaaacatcacattgtccacttccagatccatggatgagttgtttccttcagacctattcttacaggaaatctttagcattctggaaataattactgaggcagttgagcgtgcctgaggattcatccaacaaatgtttatggggtgccttctctagattaggtgctgctccttatagacaactgaggtttctcttctcatgacaacaaataataagtaaataacagagataatttaagttatagtataaaaaggagattgtgatagtgataattgctgtgtagccaaaagagcagggtaattgagggttatggtgtggttactgcttctgatattggggtcagagtagatctcgccaagaaggtgatattttaataggacctggatgagaaggagccacccacatgagacagggcgaagggaaagagcatttcagacagagggaataggaagtgggtaggccaggagatgaagcgaagctggcatgctaaagaaaagaagtctagtgtggttggagcaatggaggaagtaagcaggtgagtgctgggagaggaagctgcaacgccggttgagggggcagcttcagccttgaaggcttcataagatgtttgcatgagaagccatggaagaagcacaaatgggagtgacatgaggtgagatcctcgtaggaatatcgctttgagtgctacgtagaaaatgcgctgaggggtgcaagggtggaaggcagtgctggtgtggagtgttcccagctgtgatggtgaggggagcttgtatttgtattgtagaggaccactgaaaggaggcagtgagagtgggaaacagatgaatgaagaactcctgggcttttagtggggatatctatgatattttaatcaaattgagtttcagttttgtttgggagatgaacagcttctgggtaggaatcaagtgttctgttgtccttgaaaagtcagctgctggaagcagagagaaaagcccattttctgtttcaaatctgcctttttgtgtttcagttgggactctcagctccttggcttcaccttcaatgacatgtttatccgcatctccacccgccttccctccaagtacctctatggctttggggagactgagcacacgtcctacaggagagacttggagtggcacacttgggggatgttctcccgagaccagcccccaggggtaaggacagagcatttgagatctgtgtctctgcttctctccacccacactgctcaggctttgggcttcatcttcccaaactccacttggtcgtcacattctgcttttaggcgagtgggccaattctcaggctcctttgtttcatgtgtttaattgatttcatggagaaaactagacccatcttagcaagcatatttttgttgagtttctttctcaggcataatgtcttttaaactcctactgcttctccccatgactctccagtacaagaagaattcctatggtgtccacccctactacatggggctagaggaggatggcagtgcccatggagtgctcctgctgaacagcaatgccatgggtaaggccatccagcgcctcccttattttggggggataccagtcatgcctgagtcagtttagaatgtgtttagcctaactgttccttgaagtcaaaatcttcattttacgggcactgctgtttattttttctttgtgtttagcctttctgttcatttcagtctaatatcatgtgataagaagatttaacccaactcttattttggtaaaaatcacataagaagggatagtaaaaccacatgggtcccaaatgtcttggaggtcagctcgtgagagccagttataaaatttgaattagggtaaaactatgggtcagagaagttagtctggggattgtgagggtgtatggtatgttgaaaagttacctatcgggtactacgtttgctatctggatgacaggattcataccccaaacttcagcatcgtgcaatattcccatgtaacaaatgtgaacatgtacctccttatccaaaataaaagttgaaatgtaaacataattttaagagtagaacgacaaaatatagtaaaatacaccaaaggaagcaaacccaggaatgggacatttagacttccactgaacttcttcagttctatgtgattatgatagaaaatactggctcttactactctacgatagggagggtgcaggaaatagagaatgtgtggatttcaggggtgattcatgacgtggaaagtttccagcttgattagcatttttcttcattttcagatgtgacgttccagcccctgcctgccttgacataccgtaccacagggggagttctggacttttatgtgttcttggggccaactccagagcttgtcacccagcagtacactgaggtagggagaaatccaattgtttatcaagtacttatatagcacattctgggtgccagagcccacattcattagtataactctcagatgataactggaattattggtattacttggaaagagattatagaataaggaaaaataaatacattctaatcaccattaaatttatagcctctgtaagcattgcagaatagcagaagttacagtggtactagtggtggtgatggtagtgatagtagtatggtggtggtggtatttgtggttatatggtggtggtgatggtgatgatggtggtaggggatgatggtggtgatagtgatgtgggaatggtgataatgatggtggtagtagtagtggtgttggtgatggtgatgatagtggtgggggtggtgttgatgggagtgttggtgatggtggtgatagtggtggtgatggtgacgatgatggggtggtgatggttggtgtttgatagtgatggtggtggtggctatggtggtggtagtggtggtgacagtggggtggtgtgaagaatatggtggtggtagtggtggtgatggtgaaaatagtgatgatggtggtgaccatggttgttgtggcagcagcagcaaacacttatgtactacctactgcacatcactgatttattacttgctgcatgttagagcactttgcacatagtaactcattcagtcttcacaaaaggactgtgagggagatgctattattatacccttatttacagatgaagaaactgaagcactaagagattacttaatttttgcctaaggtctcacagctagcaggactggagcctgtatctaagccaggcattttgcctctgattctgggtttcttaaccagttacctacagtgtctctaggaatggagtgaaatcagcttttccataatttttaagaaggagctcaagtctagcagaaagctttctccaagtatcctagtggctctatatcctgtcagttttgatgtggaattcaattagttagttgtctagcttggggcacagaaaaatattcttattacttgatgtaaaacttcaatctggtgtctctgttctgaggactaatattttctgtctattttctagttgattggccggcctgtgatggtaccttactggtctttggggttccagctgtgtcgctatggctaccagaacgactctgagatctccagcttgtatgatgagatggtggctgcccagatcccttatgtacgttctcagtcatggctctggagtttgaaaactaacccaggtgcctctgtgtctggcttcatttgtctaatgtttgtgagattctataaagacataatgttctttttcagacaatatcacagttagcctcaccccagcacagtaatagaggtaagggcccttgtttccatcttctagagatgatagctcaagacttactgtgatttcccagagggggagataagctggctccagggctctttctactatctcatgcttccttccatttctttcacatgacttcaaaacatgtagtcaaaatgtccttggttccataagaataaataatatccacagttcttttacttaattcctgaaaaaaactaaccccaaaccatcagaccattgtatatgtggatacgacctcagttcccgcagccctggtgctgtagcacagtgtcccatgagctctgagctaatcactgatggaatacacggatcctggaatgggttccagaggatgtacacatggaaataaagcttatccttcactggaggatgggaggggacccagtcatcaggcaactgatccaatgtaccatcgcatatctaattgtattctacatttctcttgttttacagtagctccattagtggaacatagcgtttccattagtggatagtgaaatgcaatatttcattctccagaagaatgtagtgtctgatttccctcaagattgggtattccaaagcaactgtacattgttgctttgttttgacttgttttgcagtagatttaccatccacattgtattagccctgggtagttaatattattttttctaagcatgaaccactgataccaggggcagcctcttgagggaggtcatcacagtcactcctgatagtggcagtttacaaagcactgtccattccagtgttcgtatttatcctcagaatagccatcttagagaggcattctcatcctattttatgctgactttgatttttttctatcttatcactgaacgtttgagaaattaagtgaatttcccagcacctgtacctaacaaatggcagagctcggacttgaaagcatcaacaagaagctatctggaattccaccatgggtggtggaggcttgttctcctataaagcttgggcgtgtacagcagcagcctctcagctccccatgtcctcccgcaggacgtgcagtactcagacatcgactacatggagcggcagctggacttcaccctcagccccaagtttgccgggtttccagctctgatcaatcgcatgaaggctgatgggatgcgggtcatcctcattctggttagtcctgatgtgaatgtgtgcggtctgtttgggagcaggtatgggttttgttggagaaagtgttatactttatttccatgttgcaagtagataaattgaagtgtagtaagaaatgtgtatttccctggactcacagaaactctacagttcaggtagaagccaacaagttcgccctggaggagttctccttcattctgtttctcttcattctgtggctttgatttttcccaactgacttatgctttgatttcaggatccagccatttctggcaatgagacacagccctatcctgccttcactcggggcgtggaggatgacgtcttcatcaagtacccaaatgatggagacattgtctggggaaaggtataatcctaagcgatgatccagtagtccctagcctgagggtgggtcactgttagagggtcacacgcctgtgtatgttatttttggccttttctatttgggctctgaggtcagaagctctccttttctcaatcaatatttgttgatacagttaataacttttaagtaatataatgtgttacggaattcacttctcttttacatcaatcctacatgataatcaaagtattgctcctaggaacatggtttatataataatttctttggaaatactatgtaagggaaattgtctagtgcatcgctactgaacatgtttctctccataggtctggcctgattttcctgatgttgttgtgaatgggtctctagactgggacagtcaagtggaggtaaagggtctttgtaaatttgggtggagtcagggtttctaggaaggggcagccgttcctgggaatgtggacatgcctgtactgtggacatgggcttggcaagggagaaacacttagggcatgtgtgttggatgtcagtctgtgtgcccattactttataggtagtcatactttactggccactgggatgtagacatgtattattatccttgggatttaagaccagagagctcagatgacttgtccacggttttaggtgacagagtgttgatttcaattccaaggctgtcagattacaaaggcccaagaaattcccactgggcgatacctcctagcagtgccatcttttctctgaactggtatacttaactgttgttgccttggttatcccttttaaacagtcttctaacctcaaagactgtttaggtctttttttggtgtatcttttttttttccatgaacacgtttctccctttccacacttataattcctcctctgagcccaatccttccttgggtttctcaactttgcttttacctctcagtttccagccttactgtaaaacttgctctcttctggggatggtttgttgcttgtaatggatccaagtagcccatgcttctgtacctgaatttttttccagattcactaagcgtttcttgcttgaatgatacatggctccttacaggtctaggaaggctacggccccatcctctggccaagatgtgtgtctcctgaactgaggcagcctgtgtgctttactatcaattgttgtgacagtacccacaggcaggattcttagtgcgggtccaagggcttcctggagaccaagtaccttgccctacctctggagctgttcttcaataatgcctattctttctgggcaggaattgtagcagggcatgtgtagcctatgtgacccccacagaaaagctggggagacaaggaaaaggcctcttttctagaacatctgccaggaattgaagggacaaagaagctgacttgtgcagtcagcaatgcggtatatgttgtagtgtctagatactctctcaggatcaagtattaatcagacaaatatccatgttgtgggcacaaatcccagcagctgtaattctgttagcagccactcagaagtccaggggcaaagacctcttttgggagttctttctacgtaatgtaagattgtatcccatggacagaggtgcaggagaaacattgatcaccaggaatgtgactggtgatcaccaggaatattggagttaggccaaatattcatgccttatccagataagctggttttcagggcaagtggtgagtcctagagggaaaggcagatattagacagaaccacacaatctggagccagggactgaggcctggcacagctctgatagggtagggagaacagatggtactgcaaacacgtgatgcatacttctctgttgtcagtctctggcctcctggatcccagagccagttggcagcagtagcactattgatttaaaatgagacacacttggcaccaggctgcttggctattggactgcatgtctttatttactgtcagtagatgcagtaaaacaaaacaaacaaaacagaagctggggctggttttgaagattggcaagaacgagtcagactcagttcaaggctgttttccttatgtctactactgaacaagtatctatctatctatctatgtatatccatgtacccatctatgtatgtatgtatgtatgtatgtacgtatctatctatctacctatctcagtctatcatatctatgtatctaccgatcaatgtattaattcatccacccactctatctatccatccatcctctatctatctatctatcatctacctcatctatctatatctatctatctatctatccactctatctactcaggttatatctatctttctatctgtctgtctatctatctatctatctatctatctatctatctatctatccatccagccaccctattcatttatgtctgtctgtctgtctgtctgtctgtctatctatctatctatctatctatctatctatctatctatctatctatctatcattctatcctatctatgtaccatctatctatctatctatctatctatctatctatctatctatctatctaatctatctccacctctattcatccactcaccctatctatccaaatccctcttctgtctatcatttatctacctatttatatatcatctatctctatgtatgtatgtatgtatgtatgtatgtatgtatctatctatctatctatctatctatctatctatctatactgttcaagggagaagacctagcttcctgtcctctcgtcacctctcacagagaatcacttgaagcttagtggtccaagcagcccacatggacacaggaacctgcccagccagagaagttctgggtcatgggcttcctgacttttatcaagtagtcagtatcagaaccccacagttcatcagccagtaggggcaacactgccatcctgaggcaatttggaaatctgagggcagtgttggttatcacagggacaccagaggcattcagtgggcagtgggcagggatgcccatagctctgatttcagggaattctccacaaaatatctctcacctcaaacgccagttatacccctgatgagaaacacttcattagggagtcacagaatctgttagctcataagaaattcttggtagataggataattataactattggttggtacaaaggtaattgtagtttttgccattgaaagttattaaaagtaggccgggcatggtggctcatgcctgcaatcccagcactttgggaggctgatcacgaggtcaggagttcaagatcaacctgaccaccatggtgaaaccccatctttactaaaaatacaaaagttagccaggcgtggtggcacgcgcctgtaatcccacttaggaggctgaggtaggagaatcgcttgaacccgggaggcagaggttgcagtgagccaggattgagccactgcactccagcctgggtgacacagcgagactccgtctcagaagaaaaaaaaaggaaggaaagttattaaaagtaatgacaaaaacttcaattacctttgcaccaacctaatatttatattattaataaagacccactcgatgaagctggtgaggatgaagccactgatgtccaggtctggctttactgaatataaaacaaacagccaacagccccatgaaaagcagatttctgagtccaaagctccagcaatttaattcaataagtctgatgggatctaggaattgcattttgtagcatgcaatgtgccacaaaaagagtgctaggtgatcctgaggcccagtgtgtgggtggttatatcactgtttgaagactggagaaagtgaaggcagaagccacaaaggcaagacttgaatatgcacaggtgtaaggtagagccagcacgttggagaacggcagaacatttttatgaagttggaaggggtcatccgagcagtacttagggaagttcctacatcatggctggccaagttcaccacgtgtaccccatatgggatacaattctgactcagctgtggctgataatctctttattctaattctccatcccccacccatcccgtcgtttctaacccttcctgatctggagctctctgtttctggtgaaagattctctttgtcaggtttcctagcttctacctccatttcctaacaaaaggcatccctggcatgcccacttctgtcaagattctccgtgatgtgacccactgtcttctcacatccttgacagccagacccatgtaggctggtctgtttctgttttctcatgttccttttcttgccctttatgtagacatatgggttcctacctgccttttgtctattgtgtgtaagaactggagttccccagaccaagtcctcattctgttgcctccccgaacctcctcaccagcattctttagctctttaactcttacaatggtgtgattgtcataaaggaggctatttactgagacatacaaaggaccataatgttccgtaacaagcaacatttatttgctgcttcgaagtggtgtgaacccaccattaaacagtgagtatatattttgtgtcaagttctaagctaagcattgtgcaaaatataaatgtcactcagatgaatataaaacaagcttcttgctctcaaaagtctacaatgtagttaagaagttgtatctggctgggcatggtgtctcatgcctgttatcctatcactttgggaggctgaggtgtgtggatcactttaggtcaggaatttgagaccagcctgaacaacatgaggaaactacgtctctactagaaatacaaaaattagccaggtgtagtggtgtgtgcctgtaatcccagctactcaggaggctgaggcaaaagaatcgcgagaacctggaaggcagaggtttcagtgagccgaggtagcaccactgcactctagcctgggtgggtgacagagcaagactctgtctcaaaaaaaaaaaaaaagaagttgtacctttaacccatcttgcaggttaaaacaaaaacacacctgttattatctgaagaaagatgaaaataaggggaagttgaaatgtcctctttaagtcctctcaatttatcttccacacagctgtagttgtcatgtgattctgaaattgtagaaaacactgaggtgtactggtcttatatcctgaaatgtaatcttattccttcctcccctctcgcagtgggaatgacataggagggagtccctgggtgtttcttcctaacctattaccatgcatctcatgtctgcagtctctccctggctttgtctttgaggagtgcataggaaatggcaggactgacattgagggttgggcatcgaatgcatgaggtcactagttcgggtcattgattgtcatcatccatgtatatatgaagagaacagtttttggatgttttccaaatgccgggaaggtgtgcaaattgcactaatttctcctctcattctacatttctctaataagttaataacattatttaggccctgttcaggccgtctgtcaccatgcagttgaagtatttgtgcgagttgcattctcagtaagtgcctgtttgctgtcttctatatttgtgtgggacaaagaaattatatttcttttttatagctatatcgagcttatgtggccttcccagactttttccgtaattcaactgccaagtggtggaagagggaaatagaagaactatacaacaatccacagaatccagagaggagcttgaagtttgatggcatgtggattgtaagtgtgtgtgtgtctctgtgtaccagtgacacttgtctatctttgtgtgcctacgtgtatgtaccactgaccttcagtcaagaggatagtcattgtccaaggaagactttggacatatcagacacttcctcctctcaggagaggaacagccctgatagccctcacaccttctaccagacctgacattactactataaaacctctgaggcaattgactaggaatttcttggaactttcactgcctcacgcccaccttgagagagatttttttttaaccctctagccagttgttctgtaggggtgaattcatctttctagccagttctcaccaggatttgatgaagctcccagggctggcatctatagggattactggatgttgaacaatgtattcactgcttccttggctcagaattggcaggacgtaattatcttaaaaagtgaggtatgtctgtgtttggcatttctaggatatgaatgaaccatcaagcttcgtgaatggggcagtttctccaggctgcagggatgcctctctgaaccaccctccctacatgccgtgtaagaatccttggccttcttgattggcagagccatgattgaaagaaggattacactggaggagcccgaggccaggggtggccgcacagctcagggcacatcctcatggctgctgtggtttactggggaccagagacaaaagctctgcacgcgctttacccagctgggcatgtgcaagtgactagactcattgcacaaattttttgaatttgtctagaaaacacttacgagtggtcatgccaccaaagggttctcacagctaggcttgttagttttttaggcttatgtgaattccatcacaggaattttttggtgtcatcaatgggtggaaattattggcttgcctttattgtggagctgatggactttggagttacacttgggttcatatcttggttccagaaattgttctctctaggagttttgtgacttttcacagattatgcgatatgtccaaatctcagtctgctaaactgtaaaagacaggtaatgagatcttcttcatagaattatggaaataattggcaagtcaaaagcctaaataagagcctgtcatatagtgtttgacagctgtacattcttcctgacacctctgctttcttcagtgaacttgatgttggaaacactggagccgccgttgcagctcagagctgggggcgctgtgctcatgtctctgggaagacggagagtgacacaggcaggactgaagttagtcttaagatccagggcccagtcccttgaagagaagtcagggagaaacagaatcagggctggatttcacctcaccagttcttcctcctcagatttggagtccagggacaggggcctgagcagcaagaccctgtgcatggagagtcagcagatcctcccagacggctccccggtgcagcactacaatgtgcacaacctgtacgggtggtcccagaccagacccacatacgagtgagtctctgtctcccttctccagctgtcacaacctgtagggattgccagtgactgacatagctaccctacttttcttttcattcccattctaagggttaagaagattctcatgacaactgtgtaatgattcttattagataaacacttagtgacatggagccaggccctgtgattaaaaggaggaggacagatttaaataaggcatggtcccaccagtgaaaagcttaatgatcctagtgggaaagactcacatggagacatcataatgatcacagagggcagccggtggtacaacagcttcagttacaggaggtgaagggaacacagaggactgggcatctctcccctttatttcaaagtgaatcatctttggagttcttttttgtttttcaccattcttggtggaggctaattggtattccactgaattagcacagtcctgctttgtaagctcaattaatagtgtgaattcttctaaggacgatcttataatcttcactgtgttcctcctcaaatatagaaaactaagttttggggaaaccaatagcaagatttagtaattccttactatttttggggcactccagtgagtttgctacagtgaagttctttgtaaagcactgtgagaacacgtgactcgttatctccatcatctgggatcagtggagcccccattacagctcagagtcccgtgttccctccaatcacgcagcaaacattgactaggctcaagggctctgggagcagatgctctatggcctttgcttcctggcggtgccctcagttcacctccttttcccctccaaccagagccgtgcaggaggtgacaggacagcgaggggtcgtcatcacccgctccacatttccctcttctggccgctgggcaggacattggctgggagacaacacagccgcgtgggatcagctgaagaagtctatcattggtgcgtgggtccttcccagggcctgtgccggtagggcagggagttgggatccttggggaagaggtgaggaggcaggtcgtgagagcgagcctggtgtgacacagctgtgcttctcgttgcaggcatgatggagttcagcctcttcggcatatcctatgtgagtgtccttgggatcctcctaagcaccaagaaggtggggacatctttcagaaatcatcagcaggctccttttatttcctcttgtttcagacgggagcagatatctgtgggttctttcaagatgctgaatatgagatgtgtgttcgctggatgcagctgggggccttttaccccttctcaagaaaccacaacaccattgggaccagggtaggacagtggcccctacctccagtgtttcacttgaaacacagcctccatttctgacctaaagttaatgcagtctgtatttcctgtgatatctttaaaattttttttttttttcttttgagacaaagactcattctattgcctaagctggatcttgcagtgtcccaatcatggctgactgcagccttgacctctggggctcaagcgactcacctacctcagcctcttgaatagctgggactacaggcacataccaacgtgcccagctaatttttgtgttttgtagagatgggatcttgccatatttcccaagcttgtctcgaactcgtggcctcagtccccgaaagtgctgggattacaggcgtgagccactgcacccttataaattgttaagcccatgggtctcagtgagccatattcctcagtgttctttaggttattattatgttttgttcttcttgtttgggcagaattgtaaaaaatataccaaaaagaatgtcttacagtgaaatttcatcagctgtcctaggagagcatcagtgaacttttccagtctattaagaatattctctgggcctcatgtgtagttttcttttgtttagctgtgagtgatcttcaattggagtatgctttcagtgaccttcttaaatcccctagaaattccagggcaagctcccaacactgttctctttctcctttagagacaagaccctgtgtcctgggatgttgcttttgtgaatatttccagaactgtcctgcagaccagatacaccctgttgccatatctgtataccttgatgcataaggcccacacggagggcgtcactgttgtgcggcctctgctccatgagtgagtgtccagcagggatcccaatgcctaatggatgacttattgcattctatatggtgacagttgaattcttccaaattaaagacatgattgccttttgacatgagctcttcaggtgcagaccatactttattactctctttagcacagtgctatacatgccttaggtcattaataaaaggttattgattgaatgagcaaaactgaaatgatgcagtatagcatagaataatttctttctaatttggctgtgcaaaggcctatctatcttttgtagcagtttggttatatgtagccagatcacaggagaaggatttcaggaagagatttgagggaaaagggccatccttgcatttgaagtttgccatggttgagaaatggggcaagtattttacaagagagaatacatctacatcccagcatttctgaagtttgaggcacatcccatggggaaagcagaggctgggtgctcctgatgaagctaggcctaggaaaaaggcaaggatggctcaggggcagctgtatttccgacttggatctgaacttgaggagcttcttcagagtgtcgggctggggctctgttgggctctgttgggcaccttcatttccctttccaggtttgtgtcagaccaggtgacatgggacatagacagtcagttcctgctgggcccagccttcctggtcagccctgtcctggagcgtgtgagtatggaggcctccgatgaggggaggatcccagctgtgaggcttggggaaaaggacgaggagaagaggcctgagctggtgggggtcctaagacatggtttcttattctacctgtgtctcttcctctctttctgagctgaagtccatcacttaggtgttcttggcctcagctccttcatctttaaaatgagcctaacaattctggttcataggatgatcaagaagaaaacacctcatggtatattcaatgacacaatcgtttcttcgttaactaaaataaggaatagaagatcagatgggggcagtattgtaaagaattcataacagtcctctagcactattacaacttttcagaaggattgcttggcaatgtgtgtgtacttgtattgctgctggctaacccttcccttcctctgcaggagctcctcccagcagtaaaagccatttctttacttctattgttgattaggcttctgattaaaataccagttaattgcaccttcccaaaatctttttttttttttttttgagacagagtctcactctgtcatccaggctggagtgcagtggtgctatgtcagctcagtgcaacctctgcctcccaggttcaagtgattctcctgcctcaacctgccgagtagctaggactacaggcacgtgccaccaggcccggccaatttaaatttttttttttatttttagtagaaacagcattccaccatgttagtcaggatggtcttgatctcctgacctcatgatccgcctgactcggcctcccaaagtgctgagatgacagacgtgagccaccgtgtccagcccgcaaatcttatggtacccacagaatttttttctgccccagacacaacctcagttgtttgtctctttaagagggaatggcgtaagcctatttctataagcaaatagtgaatttttttttttcccgaagtcctgggtaccaaagtgctttatgaaagccacttgttttggggtagacagatctctcctgtttgaaaaaggaaaagggatggaaggtttcctcaataggtgacctcctgggacatgaggcaagtgggcccaaggccatcacaattatttaacctctttcctaagtattttggtttctctgtcctggaaaatggtgccactgccacaccttgtttatgtttcattttagaatgccagaaatgtcactgcatatttccctagagcccgctggtatgattactacacggtaagtttttctgaatgtttatacaacacgggaaaatggtagagagtacaaaggctttagatctgatagaccttaggtcaaatgctggctctgtaacccacctgctgtgtggtcttagagaagccactttaacccttgtaacctcggttttctcacctccaagtggagtaagaccacttccctcatagaactgttgtgaaatgacacataaagcatctcactcaggtttttcgtgggtgttctctttgtgttaatttttaatattttcttatatcactgctatttacaatgttttgtaaaggcagatgcttttgagattgtgttgcaaactatagtttttgtttttaatgtttatatctttacctgctgtaagtttgtaagcatagaggcctttttgtctctgtctttttattaaatatctccttccatagcatagatgctcaaagaagggcactgcacataattacctaaggtaagcaagtgattaggcaatgtgcaaaacacacacagaggtatgggacccaacccttgtgagtctaagcagtgcaagtgcatttagaaatgaggaagcaatgaagagctccttgccgcatagtttctgtgctattatgttccccaaagacttatctgggaagccagggtcttcccgggcagctctggggtggtgggctcttgctgggaccctgacaagtcagaccctgattcttggggaagaatcaaagaaggcatttccttggtctctaatggggcctcttctgactttctgaggagaacatcgttgagggctggaaatacagcaaaggggtacaagcagggatacaggaagcagagcatgtgctggcccctttcatccaaggggattgcagtgagattaggtgaaaactggagaaggatgtgcattttgttccttctcttctcagtccattggagcccaagtcctctccacagccccagactcctcttcctgctgctagtctggatctgcccttagggtggtaacatgttaaggctctgctatgtgtgtcccagccaggcgtttcccaggaagaggtggccagctttctttacgtgagactggcctttgtcctgagtgtgcatgttgagtctcccattcactaacagaagatgtctttggttgaagaggaaaagacaaaagaaatcatggagcaagctatttagaaaaagatgaaattttgatgtttaattaaaatgaagatgaatttcatagttaatattaatgaagaagtgtcaccttaattaatcttcccaagtttgggtaactattactcattctagagcacaagctggcaaaaactatggcccacagccaaatctggttgttagctgatttgcaaataaagttttattggaacacagccatgcatatttgttcgcttgttgtcaacaataactgcttcttacctgtaaagtagcagctctgaaatgagaggattttgcctaccaggggacatttggcaatgcctggagatatttttggttgtcacaacagagtgggggtgaggaggtgatgcggctgacatccgaggattctgctaaatatcaaaaggcacaggatagccccatcgccagagaattgtctggccccaaatctcaatagtgctgagactgaaaagccctgctctagttgagaacatgtaggatggaagcatggtcccttaggttctgatacaggtgagagagtagcacctcttcctgtcacacatcaggcaaatgtagtttgtacagtggaagcaaaggcaagagaccctaacaagatattatagcagccttgcaagatttcttgcagcactgggtgaatgcagaatgggtaatggcaggtatgttgcaaagggtgatgagcaggcataagttcagaagggaggatgagatgtctggcaggatgcattgttcagggaggggcctgtcctctccttagtcatctcttaccttcttctgcctccagggtgtggatattaatgcaagaggagagtggaagaccttgccagcccctcttgaccacattaatcttcatgtccgtgggggctacatcctgccctggcaagagcctgcactgaacacccacttaaggtaagtgacaggactcaggttttcctttacatgtcagttagctcaacaatttgtaatgaagtccaccaaaatgtaagcatcactctcaaacccacatgcaattctactcaacacttgttttttctttgtttgcttgtttgtattttaacctttttcagactctatactcttcgactaattattaacagctcttttatgtctaagtgggtgagttgataggtctaagagtgtcatctttcaatctcacaattgaaatggaagtcaaaataggagccaccacgattcataatagttttagtatactattgggtctgattgaatatttcctaataaaactattgctgaaaaattgtttattcctctacaagatgttaaaattctagatcaaagtctatgtataaattaaccatagctaacatccagtgagtgcttgccctgtgcctagaactatatgaatatgggcatttccatgtggaaattatctattttttcttagcaaaaggaaaacataaattctgtgaggttagtactgttaccaccatttcatagatgagcaaaaaggctaagtgatttgctcagagtcacacagctactaagtacatgaatgcggactaaaattcacatctctctggtatcaatactaacattcttagactccctattcatttgattctaaagatttaaataaaaatgaagaacttaggacatttgaaaatagaactccctgtatatgtttcagatattaggtcacgaaaacagattttcagcatcaggattttcctttcaaaaggaaaagaaagaacccagttagtctggttgtcattattttaagagccttaaagcagaatcctcttgattcattcactaattcatttgttcatgatatgaagtcatagagccagacagagacagaattagaactaagacacaagtctcttgaattctagtatgcagtctttatcccccaaagcacttccctttgctgctttatgtttgtatgtaaagtcttggtttgtggctgtggctttacttttagctaatgcctctctgcctgctcactgcagccgccagaaattcatgggcttcaaaattgccttggatgatgaaggaactgctgggggctggctcttctgggatgatgggcaaagcattggtgagtagaggttgcctgagattcatgctgatggcactgactacattcctggattatcttacaggcctgctttcaccttttccctattataacaattttgcattttaaaatataatcatttgttaattcaagggtataatccatattggacatgatctttattcctcatgtaaatgaagctcagttctgaatcacctcccattatgcaacctttgtaatccactatagaaggtagcaatatgggagccatggggaaagtttatttgtagccagcggagataaactttcataggatttatggtcaaggacacattcccgaattacatggtttactgtcccagtaagaggggtaatacctctatccgttgtattatttatgggatattttctattaggagtttataggaattggtaaactctcaggaggattgctcaagaaattattagctatttctagacaagtgctatccaatagaactttctgcagtgatgacaatgttctatatcttctgctgttcaatattgtatctagtaggcatatgaggctatcgagcatttgaaatgtgtgacaagtgcatctgaagaattatatttttaattttattcaatcttaacaagcttaaatttaaacgtgttacattttactagtgactgctatcttagacagcacagttctaagggatagccagtggcaactgactgagtggtgagtcatttagaaaagggccagcacagtcgagctcagtgcctcacgcctgtaatcccagcactttgagaggccgaggcagccggatcacctgaggttgggagttcgagatcagcctgaccaacatgcagaaaccccctctctactaaaaatacaaaaaaattagctgggcatggtggcacatgcctgtaatcccagctacttgggaggctgaggtaggagaattgcttgtacccgggaggcggaggttgcagtgagccgagatcatgccattgcactccagcctgggcaacaagagcgaaactctgtctcaaaaaaaaaaaagaaagaaagaaagaaaagaaaagtgaaagaaaaagaaaggggccagcacacaggaaagagtgtgacagccacgagggcagggtgtaggatgggaatacttgaaaccaagctattgactagttcaccttcaccggctgtgctgaacttcatattcttcctaggcctgtggcacacatttaggataaaggacaaagaaggcttttctttgatcatctttgttctctggagatcacatttttaaatttgcctaatacctcaagataaacccaccaagacaccagtgttggtgtttgcatatgtatatgcatataaatgtgtgtgtggagatgtgtacatacagcaaaagaaacctggaaattctgagctggttaggaagatgctgggatggtagaccacaaggaagagaagtgacttaaaaatggtgtcaggaaactgtgttatatgaagtgactctgtcagacagatgtgtctatacacattcatttcaagcattttgtgtaaactgagtgtgggtgcagggtttgattagtctccataaagagcacttacattttaaaatagaacactcaaaagacagaaataaaaacaaagataagccttactctctcaaacaagacaagtaggcaattagaacagcatttatatattctatagcatagagttctacagcacaggtccaggccatgtttatcttgttttttgtttgcagatacctatgggaaaggactctattacttggccagcttttctgccagccaggtgagtgtgattgatatgaagtgagaatagggttccactggcttaggagggtgctgaatatcgtaagggcataaaataccacctagaatttcttcattgctcatcttgctaattcacattcttctacttctctagacttccggtggaaatttactatgctcccaggaggctttctgcaattaaacctatccacatctcatcagtaatgatcattattctagtttaccatgttacaggtggacgggcagtttctgttatctagcccttgttcctgagttgccttggaatggtctgcacattttgggattcctccacctgtagaatataagtatcttaacagctgagactttttgtctcctgtagagttcagggcagtgcgaaagaccctgtagctgcttgtcaatgcaaagtggatgggagttggcaataggccatagagtgatgaaatcatgatttccatgatccaaagttacaagatggtgactctgaagttgtcttactttatgacctacatttgtgcctaaaaagaggttagaaaaatttgaactaattctgctattatatttttcttttatctccaattcaacagaatacgatgcaaagccatataattttcaacaattacatcactggtacaaatcctttgaaactgggctacattgaaatctggggagtgggcagtgtccccgttaccagtgtcagcatctctgtgagtggcatggtcataacaccctccttcaacaatgaccccacgacacaggtttgtgaccagcaaaaagtgcgaatggtattctccacccttaatatgcctagtgcagtgcctgactgcttcccttccaaatgatgccctctcctgccaggccctccgggaatccctgagttttccatgtgttaggaatggaccacgtggagatgaatgaaaaatcatggtttatcatcatttggaatccatggcctggattcttactttccatgtttgtcttcttgtctgcaaacctatgtaaaactttgtcttgactccctcacctctgcctcagagatcaacttcccaaacaggttggaactatcatattttatcaaatatgataccatcagtgaaaattgcttcattatttcatgtgccacaaagaaagaaaaaaggatgacaaaactatgatagaatgcttccttatcactcaattttttttttttttttgagacggagtctcactctgttgcccaggctggagtgcagtggcatgtgatctcagctcactgcaagctctgcctcccaggttcatgccattcttctgcctcccaagtagctgtgactgcaggcgtctgccactatgcccggctaattttttgtatttttagtagagacaggttttcactgtgttagccaggatggtctcgatctcctgaccctgtgatccgcctgccttggcctcccaaagtgctgagattacaggcgtgagccactgtgcccagcctcagatttttataataaacttatagaaagtttttgaaacttctttagccataaagttttacctatatatttcaatattgtaagtgataatatggaggaaaatgttgagtggagatacattgatgattctgcctcaacgtaatttaaaagaggtagaccctaaatgtgaagaagcactagaaatagcttaaccaacttgtatcgtatttaaattgtactatttaaattcatattaaactgttttattatttagtttattgtatttattattatttagaagaaaaatatgtgttacaaattggttaagatatttcctctgtactgcaaaaggtgttggtgattcagcattttataaaaattcttccactagtgtctatgaagtttttttcctgagccactaacacactttatatacattttcatcctagtgctttcttgatcttactaaatattccttcctgtaataatccttaaatgttttcagcccatccattcataacacagtaatagcaatgaagcttacacaggcacagacaataacaattatgccatgagtgctgcttggctcacagtaattctatggttgtcgattacaagacacgctcttgtcagatgaatgttaaatatgtgaaaaatctgtaccttgggattaatgctgtgtagtggtcctgacacttatcatcccgatggtaaatgaaactttcttccttgtgtgcttacttattattttttttcctgaacttttttctttcataatccttcctgatgattaagcctgaaacaaaagttttctttcagttttgcattctttacagttatttcctcatacttgtggttttcttgtcaacaacttccccaactataccataaaggactttgcccaatcctgttgctgaccagctcagggacagacatgcaagctgatgagggcacatgcagtgaaagcttcttgacagcatctgcctaggaagaagcaggaatagtggactcttgctgggcaaacactggggtgctatagtggaataggagaaggaggaaacagaaggatggtgccaaggaaaatcaacacctcagtagaatggaaaagagggcattctctccagtttgtgcagttgtttctcttcagcggttgcatattgaacattttttttttttttgactgagtctcactctgttgcctaggctgaagtacactggtgcaatcttagctcactgcagtctccgcctcccaagttcaagtgattctcctggcttagcctccctagtagctgggattacaggcacctgccaccacgcctggctaatttttgtatttttattagagctggggtttcaccatgttggccaggctggtctcaaactcctgacctcaaatgatccacccacctgggcctcccggagtgttgggattaccggcgtgagccaccgcacccggcccatattgaattatttaaaggcccatctctaccactgaataatctttgtactctaaaaaattagaaaacacccttctcatctgaaactttgaaggcagtcttttaactagacaatacaatgtagaagtattagggggttatttggactggatacttgcacctgatttatttgcatgcaggaaatttcaacaccggatgcccaattcttttcctttggttcctaacaggtattaagcatcgatgtgactgacagaaacatcagcctacataattttacttcattgacgtggataagcactctgtgaatttttacagcaagattctaactaactatgaatgactttgaaactacttatacttcatactcataaaaattattgtgtgttgctaatttgttcatacccactattggtgaaatatttctgttaattttgttatatgttttttgtgtgaaccctaaaggttaaaccttagccctgtgggataggcagttagggaggtgtggaaaatctatgcattaccttaatgtctctgtgtggttagtatggtagtgactgttcatcatatgacatttactgaagatgaactgggtccatgatgaagtgtgtgtatgtccacgtttgtaatcatagaatggaccccattcttttgttaaatacacaagagaaagctttctgtgacagttccaggtcttgaagctaatcagcatctcaagaaagtatccagaaagaacatctgctagttggttataggcggtgggaggaataatatacctaattggttataggtggggggagcatgataagcaaagaaaaggcaaacacaaggaaagatcagatgaaacagaagatgatagtaaaagtgatcctaagtaagaacataatgtaaaattgtcagcagcctcatggggaggaaaaaggaagagtcaactcacttgaagaagagggtcttgagaaatccttagcataaagggctactggtgagattgagatctgagcaggcaaagctcaaaagagagtttggaggttaaaaataatttatttttgcagtagtgtgctttgaaatgtgtaaatcttatttctaatgtatacaaccacatttcacataaaaatatgcaatttatatgccagataaaaataaaacaagtgaatttgcaagtga

SEQ ID NO: 1386 - DNA, 489869 bp, Homo sapiens
tattttttaaatattccatgatattctttttatttccaggtgtggcatataaaactgacagcttacagtaagaaatatttcttatgatcaaacacttcatatgcactttattgcttttagttttgaattatttcaaggtatgttagaaaatgaaaaaataaaagatcgtaagtatatgtaagattagatgaactaagttgcttaagtcagtggtttccatatcaacaatgtgactacaagttaaaagttctgaagtcctaaatgtctcttcctgagaaatttcccatttggggctcaacagcacaaaacttttattagcgcttctctggggaatcacttggcattcctcggtctctgcaaactggacagcaggttcctttcaccaattcaggactgggacagggagccgggggacaaatctccaccacacaggtgacctggccactctgaaaggcagcatgcacatatcacctccatgtttcttataatcaaagtacttaaaagacaaataaatgtttcttataatacataatctaataagctgactgtctcaatataataaaaaatgctcatagtatgagctcatttttgcatggtttctattcattctttctttctatacatttgcagcacgaacagcaagcctgccctataaaatgttacctaccttactgtaccatatggtaggattagctgaggaagttcatgcatttctacatggctggaaagaatcagctctgttcaaaaagcaaactaaataacgaatacagagcatttttattttcttttgttttggtagacaccatgataacacttttttatttttccatagaattgtgtaggtttaccaagtgcctttaggcagcatttataatgagcctgactgaagaataatgagatgaactcaagtcccaggttggctcagtttacttactgacataaacttccttagccttggttccctcgtccatcagtgaacatggaaaaagctcgtggtctctagcgactgctcattagattgtgactatactcttttattaataagcaaaagcctcaaaatttcacaccagtaccttgatcttaaaaatatgcctagaatctattgacataaaatatattttttctccttttgaatttttcaagtatgcttcaactggctggctagaagtgaaatggggagttggactggaaaactcgcagcacaaacctcacaaatgcagtgagtgcagtcttctttcatccagcgctcctcggccttccttggaacccctctaacatctgtacaccctgcctgcctcaggcgtgcctccagcttgtttatctgaaaggggaggcaaaggaaagaagagtggaaattgaagcggatagcaacaaagccaatcaataacatggtttgatgaaatgctctattctgtaagcacacacctagaaggcaaaagaaacttcaaagcctacataatttttcattttcccccaggacttaatgagcttgaatcatccagtatccaaacaaataaacagttctgtaggtgttaaaaaatattgaacatggacctagagtatgaaagagttaatttctaaaggaaggggaattaaaatcaaatgaatgaaattacatatttggaaaatcttctcaataagcacacttgtaaattcaactaataagtattttatttattttttgtcccccaagttgttataaaataatatttatttaacaaatatttattaagtttcaaagatgaaagcaagcagaccagggtctctccaactttacaatttggtataaaggccaataaaccacagctataagcctttagataataacggtctttaggaatcccaaggggagcagaagggcagttgatatggtttggctttgtgtccccacccaatctcatgttgaattgtaattccaaatgctgggggagggacctagtgggaggtgattggatcttgggggcagatttcccccatgctgttctcggggtagtgaattctcatgagatctgatggtttaaaggtgtgtggcagttcctcccccatttgctctctctctcctgctgccatgtgaagaaggtgcttgcttcccctttgccttccaccatgattgtaagcttcctgaggcctcccagtcatgcttcctgttaaccctatggaactgtaagtcaactaaacctattttcttcataaattgcccagtgtcaggtagttctttatagcagtgtgagaatgaactaacacagaagccacactcagttctgcctcagggaatgaggggatgcctgatattatggactgaactgtgttcccccaaaattcataagttgaagccgtaatccccaatgtgactatatttgggcatagggcctcgaaggatgtaattaaggttaaattaggtcatgggagtggggctctaacccaataacattggtgtccttgtaaaaaagaggaagagacaccagatgtgctcacacagcgaaggccatgtgaggacacagggagaaggtggccatcagcaagccaaggcgtgaggccttggaagaaaccatccctgctgacactttgatcgtggactttcagcctccagaactgtgaaaaaacaaactgttttaagttacccattttcttgtattctgctatggtgcctgagcagactaatatatgatatatggaaaaaagcatttgagctgtgagagatgaccatgtctttcaggagaacaagcagggaaaaggcatttcaggcaaatggaaaaaaaaaaatatgtgttaaagcatgggtaccagaaacagatcagtatttcagaaatgtacatttctctcccctcctttgttggggagatctacagagaacatgttagtgggaactgaggtgggatgagtgggcagcaaagaaaattaggcccttaaaagtcacataaattaattaagtgcagtctccaggcaatgggaaataacatcacaatgatcactcctgtggcaacatgaaggatcactggtgagaaactaacatggagaccaatatgggctccactgaggaaggagggagtgagacaaaaagagccatgtagcaggtagaggagattggctagatgtgggtttaaggagaagaggagaacccaaaaaatcacgatgaactcagacttcatttagaaagcaaaaagtcttgatgtgaaagaattttgattctgtaaattcttttcactgcttttgtattgaagtaggacaggagggttggttcttggaagataatttagcatgagtgcctacacttgggcagtggcatccacccattcattactcaatagatatattcagtacctgatatgtaccagctaatacactaataaactagcaggacttgacccctgactttaggtgagcagtgagaatggagaggatgataagacaaatattacaatgcaggcttgaatgacaaggcttcacaataaccagatgtgaaccaaataatccattcttgagtggggtcatgggtttgaagtatgaaaatcacaaaaaaatctctaaagatattaatgaatatgtcctagcagactaggacatatagaaaacttttatgtccaaaaacactgggaaaatgcatatctattctaaactttaggcacttaggacagtaaagctttttcaaatttaaataagctaacaaattaataaattatttaagggaaatagttttgctttttttgttttgttttgttttttgagacagtctcgctctgtcacccaggctggagtgtagtggcaccatcatggctcactgtatcctcaacctcctgggcttaagtgatcatccctcctcagcctcccaggtagctggaaccactggtgtatgccaccacgtccagctaattttttgttgttgctgttgttttgtaaagatggggtctcgctatattacccaggctgatcctaaactcctgggctcaagcaatcactctgtcttggcttcccaaagtgctgggattacaggcttaaaccaccacaccctgctctaagaagggaaataaatagtttaagaatcttgtatgtaccagggctgggtgcggtggctcatgcttataatctcagcactttgggaggctgaggcagggggatcacctgaggtcagaagttcaagaccagccgggtcaacatggtgaaaccctgtctctactaaatatacaagaaaattagccgggcgtagtggtgggtgcctgtaatcccagctactcgggaggctgaggcaggataatcatttgaacccaagaggtagaagttgcagtgagccaagatcatgccattgcactccagcctgggtgacaagagcaaaacttcatctcaaaaaaaataaaataaaataaaataaaaaaataaaaaaaaaaagaatcttgtacgggtcattagtataagaaatacagtgcgtggcacttttattccaggcttaactaaaaagtcttgataataaaaggatgtaactttccttttcctatcacccatgtgttcattgttagtatacagaaatgccattaattttttctacgtttatcttgggtttatgttgtatcctgtaaccttgctcaactcatgtattcattttaggagtatttttgtagattccttgagattttctatgtaggcagctgtatcatctgaaaatagttttatttcttccttttcaatctataggccttttcattttcttgacttattgcactggcaagaacttccagcattaggttgaataagagtggtgagaatggacatccttgccttgtttgcaataccttgcagttttatggggaaagcattcaagcattcaccattcagcatgtaaatggcagggtaatgtttctcttttgctgctttcaaaatgttttcctttttattttgttgtcaaaagtgtgactatgatgtgtcttggtgtgcatttctttggaattgtccttcccttctctcttctttctatccaagacctgaatgacacaaatgttggatgttttattataatcccacaggcttctgaggctctgctcatcttgtttttgtctatgctgtctctgttgttgagaatgtataattgctagtcttctatcttccagttcactgattctttcccctctgatccatattccgttttgagcccatcaactgatcttttttatttctgttattgtagttttcagttccaaaatctccatcttgtttccctttgtgtcttgtattactttgatgaaaattttcatccatttttcatttgtttccagtgtgtttgaaattgctcattgaagcattttttatgactgctttatttatttatttgtttgtttattttgagacagagtctcactctgttgcccaggctggagtgcagtggtgtgatcttggctccctgcaacctcctgcctcagcctcctgagtagctaggattacaggcatgcaccaccacacccggctaatttttgtatttttagtagagatggggtttcaccatgttggtcagactgatctcaaactcctgaccttgtgatccacccgcctcagcctcccaaaatgctaggattacaggtgtgagccactgcacccagcttatgactgctttgaaatctttttcagataactgcaacacctctatcacttcagtgttgattgcctgttttcattccatttgggatcttcttggttcttggtatgatgaataatttcgtattgaaacctggaggttttggatcttacttaagccttctggtttaggtgttttcctctgaaactgctctggcatgggaagaggggtcccacatcattactgccatgtgggaatagaagtccaggttccctccttggcctccgttgacacacaaaggggttctcttcattactgctgggtagagttggggttctggctccctgtcaggccacctcataaccctcctggatgggaggcatagtattctgtgacttctcccgacatggcctccatgcacctcaggatggtgaggggcagggcagcctcatcaccccctggtaaatggagagcacctggaacctccactaggccttctctgcaaccaccccagtgaagagggaggggagcttcattcctgctgggttaggacggaagcccaggctccccttatgaccccaagtttttgcatgcaatcatctggcatgatgaccccctagtttcctacttggctttctcggacagcagcctcaaggtgtccttaggtgcctcagtataccctggggagagtgaaagccacctcctcacttggcctttgctggtcttgctggaggtgggggccacagtttcttctgtgctgtttggctggggtagagtggttattgtctagaagttacctgtattgctaggcctccacttttatggcctgttgtctagagggactcaggttttgttgggcctttttctgtgtctgttgatgtgctcaggttgctggcttcttcagtttcaagcctgagctacgtgaggaaaaactacccaggaaagagcatcacattgttcctggagcccaaggtccctgatcagtctgctttcttgctcttcaccattctgagtcatcttatgtttgttttaaacgtgatatccaggggttgtagctgtctatactataatcaagaggcgtctgtgtgcggtggctcatgcctgtagtcccagcactttgggaggctgaggcaggtggatcacttgaggtcaggatttcaagaccagcctggccaacatggtgaaaccccatctctgctaaaaatacaaaaattagccaagcgtggtggcaggcacctgtaatctgagctactcaggaggctgaagcacaagaatcgcttgaacctgcaaagcagaggttgcagtgagccgagattgcaccactgcattctagcctgggtgagtgagactcagtctcagaaaaaaagtaaaaataaaagaaaaataagcaggaggcaaaaatacatctactcggccttcccagaaatagaattctcattagacactatttcatgtaacatttttacttaatttattcaaactattgcagttttagatttcctaaggatatataatcaaaagtgtagccttctcagcctcactgcattccccaaaaagcagctgctgtgtcaaagtagataatactgacaatgattgcatcattgttctgcattccagaagtatccttatctgcatggttcctgcttggggttgagctgcatcactccccaaattcaaatcttgaggtcctaaccctctgtacctcagaatgtgatattttttggaaataggagtattgcagatgtaactagttatgataaagtcagagtagagtgagcccctacttcaatatgactgatgctctcataaacaaaggaaatctgaacacagattggcacacagggataatcccatgtgaacaaaaagacagagatctacaagccaaaaaacatcacattctgaggtactgtctaatgagacttctattgcctatctccttctgcaacaggaaggtatactccatttagagatgctccttcctctgggttggaagattgaaaaactgtggaggacagacacagctgaaccccaaagagcaagcaacgtgagtgaaaaacaatcctccttgttgccataaaccaagatttgggttgttactagagcataacttagcaaaacctgtctaattcatggcttaatctagaccaagccgctgtataaaacgccagtgaaagaaaaaactctcatcacaacaacaagaattaccaagttatcttcttcagtgatggccctgatacaatcatgtaagtgtcttttcactgggagctgtacggaaacagttacggaaaatttagaagagctttcttattaaccaattcatgttgctgaaaaccttttgtatgcaaaattaaaagggtaatggaaagtactgcagaattgtaactacataagcttgaactataaagtcaagagcactccaagactcaatgttgtaaagttcaatacttttgctcagtgtacttaagatgcatctccaaatgttttatgcaagagcatggcccataaacctgaagaaccacatctcctacaagataccaggacttttaaattggcaaagaagtctctttgtgttcagaaatatgagtaaaacataaagcaactccagcattagttccagcatgtggcaagcttgtaaatcatcactcccatcctcacgacaagaaaaattggacacactgaaaatcaataaatttcttagagagctaaggttgaagggcaaaccactaaggtgaaatctgaagagacaggaggataacaagagaggcagcaaccaagatctgcttacctgggacagactgactgagcattgagccatactggtgggaacaccctgatggttagttttatgagtcagctttgggagtgcttttggatgagattaacatttaaactggtgaattctgggtaaagcagattgccctccataatgtgggtgggcctcatccagtaaggtgaaggcctgaatagaacacaaatagcagcctcccagagcaagactgacttctccagcagatggccttccacttcatctgcaccatcagctgtcctgggtcttcagcctgtcaggccaagattttggactgtccagcctccataatggtgtgagccaatgccttttaatacacatatcagatggacagacagacatttcctattaattctagttctctggagaactctgactaatgcaaactcttaaatggtaaattttaagaagttgctggaggcttccttcacttttttgttccagtcaggccctgaacaaattgaagaatgcacccctacactggggaagggcacctgcttttctcagtccaccaattctaatgctaatctcttcagaaatactctcacagaaacatccagaaatattgtttaaccagatagctgggcatcccacgatccagaaattgacacataaaattaactatcacactcaaggtggcaggggaaagaatctgttgacctgaagatatgtcaatagtaacttcccgaactaaaatgcaaagagaaaactgagaatgaaaaactaacagaaaatctaagaactacagggcaatataaaaaatgtgagcatgacaaactactaggtgttactgtcttagtgaggtaaggtattcaagaagtttaccttaaggaaacttaagaggttctcattgaagagatccaagaaacagcccctcctggccctggcagcgggaggggaagatatccttcatgaaaaacacccaaagccttctccataaaaaaggcctctataccaagggaaaggaacttgccagggtacagtactaaatcctaaaacaaactgggaaaagggattctaactcactgcatcctactccaggcttcctgactcacttaatcaggaaaaagccaacagaaaaaccaggggtcagcccttcagtgaaatcaattagctgcacaccagccagggaaaggagtaggaggtggagaaaaggccacagtactggagcaatgcttgtgaaaatcatagcctcagaacataagcccactagaaagctgaggtttcatcagaggatgataaaatatttcccatccccacacctgaccagcacatcaacaggatgccagcataataacagtgattactgctgaagcagctgaaagacacagactctctctgaggaagaatacataagaaaggccaaagtcagtaggaaaaacaaaaacaaagacactggaggaatttaaagccatggcatctacagctacaggaaacactaaacacagcacaacagtcagccttttcaatacaaaaacctaaagcaaaggcttatcaactacagttcctattacccaagacatcatgtatggctttaaacaaaatttacaaggcgtgctccaaaggaagggaaaaaacacagttttaagaggcaaaacaagcatcagaagcagacccacatgagacacagatgttgaaattatctggcagggataaaaataactatgattaatacattcatgaccctagtagaaaaagtaggcaacattcaggaaaacatgggtaatgtaagtagagagataaaaatgcaaaagaagaattaaaagaaaatgttagaaatcaaaactataacagaaatgaagaatgccttcgatggcttcatcagtagacgtaatgtattagtcaagattctccagggaaataaaaccaataagacgtgaatataaagagatttactataaggaattggatccatgtttatggagattgagaagggccacaatcttctgtctgcaagctggagacccaggaatgtcactggtacagttcaaaggctggagagccagaggacaaatggtatagattagtctgagtctgaaggcctgagaaccaggagtgctgagggcaggagaggcttatgtcccaactcaagctgtcaggcacagttaattcaaccttcctccaattttttgttccattcaggcctgaacaaattgaaggatgcccccctacactgggaggggcacctgcttttcttagtccaccaattcaaatgctaatctcttcagaaacaccctcacagaaacatgaaaaatactgtttaaccagatagctgggcatcccatgatccagaatttgacacataaaattaactatcacactcaaggttgcaggggaaagaatctgttgacctgaagatatgtcaatagtaacttcccaaactaaaatgcaaagaaaaaactgagaatggaaaactaatataaaatctaagaactacagggcaatattaaaaaaaaaatgtggctattcagcatcccttataattccatatgaattttcgacaggctgtttcatttctgcaaaaacggtatcttagtttgctagggctgtcataacaaaataccacagattgggtagcctaaacaacagaaatttactttctcacagctctagaggctgaaagtccaaaatcaaggtgccagcagggttgatttcttctcaggcctttctcttggcttgcagatggttatcaactacattcacattatgaggtactggggattagaactcaacatgaaaatttgaggaaaagacacaatttagtccataacactacaccctttgaacccctaaaattcatgtctttctcacatgcaaaataatcaattcaccccattgcaatagcccctaaagtcttaatccattccaagcctcaaatctcattaaaatatcatctaaaccaattatgggtaagactagagtatgactgatcctgagagaaaattcctctcaatctgtgaacctgagaaaccaaacaagttatttgctttcagaatacaatggataaggacttccgatagatgatagcagacaggaggcaggactagattgcagatccggatactgcagcattgcggaggcttgcattgtgaaacttaactccagatcaactgcaagaacaaaccagcaatcccgagaggatccacagaccctctgcaggaagcagactgctcctgcaggacccaggagacaccccaaatactgtaagtgccccaactgcagaagtgggaaaaggaaaccctcctttcccggacacacacccccactggagaagcttaaggtctgtttgtgggagatgttcccgactttacctggagctgagttgagttagagagccaagccaagtgaaatacaggggtggaggaggcagcagggaggccctgggagctcactgaatccccaagcagccctttcctgcctgacactgcagggatccatcaggagagaggctggaggagcaggggataaaaccgcactggagagaaggacttccttagctgaactttgtaacaatttcagtggggacagaagcttcctagccagaactctggggagggcgtgaatccggcttacagacatcacaggcaggggaagaactaaagcccttttctttcgtagctgggaggcagaaagcctgaaagcttctggcaagttttcaagcctgccctccacctggaaacagactaggggctgttgcaggtgtcacggtgggaatgggaccggcccttcggtttgcatgggagctggatgaggcctgtgactgccggcttttcctcacttcctcgacaacctgcatgactcagcagaggcagccataatcctcctaggtactaggtacacaactccagtgacctgggaatctcatccccatcccccacagcagcgcagcaagactggcccaaggagagtctaagctcacacacgcctagcccggcccccaactgatggtccctccctacccaccctggtagtggaaaacaaaggacatataatcttggtagttctagggcccagtccctctctatactactacagctgatgctttctgcagagcaccacctcctggcaggaggtcaaccagcacaaaaatagaacattaaaccacccaagctaagaaacgtcatggaatccacttcaccctctgccacctccaccagaacaggtgctggcatccatggctgagagacccatagagagttcatatcacagatttctgtgcagaaaccaccaggaccagccaggagctgtgtagactcgctggatggctagacccagaagagagacaacaatcactgcagttcagctcacaggaagccacaaccatgggaaaagggggtgagtactacatcaagagaacaccctgtgggacaaaagaatctgaacaacagccttcagccctagaccttccctctgacagagcccactcaaatgagaaggaaccagaaaaccaaccctggtaatatgacaacacaaggctcatcaatgatcccaaaaatcacactagttcaccagcaaaggatccaaaccaagaagaaatccctgacttacgagaaaaagaattcaggaggttatttattaagctaatcagagagggaccagagaaaggcgaagctcaatgcaagagcttgtatcaaaaaaaaaaagatacaagaagtgaaaggagaaatattcaatgaaatagagtgcttaaagaaaaaaacaataaaaaattcaggaaactttggacacacttttagaaatgtgaaatgctctggaaagtctcagcaataaaattgaacaagtagaagaaagaaattcaggcctcgaagacaaggtctttgaactaacccaatccaacaaagacaaagaaaaaagaataagaaaatatgaacaaagcctccaataagtctgggattatgttatatgaccaaacctaagaataatcggtgttccttaggaagaagacaattctaaaagcttggaaaacatgtttgggggaataatcgaggaaaacttccccagccttgccagagacctagacgtgcaaatacaagaagcacaaagaacacctggggaattcattgcaaaaagatcttcacctaggcacattgtcatcaggttatccaaagttaagatgaaggaaagaatcttaagagctgtgagacagaagcaccaggtaacctgtaaaggaaaacctatcagattaacagcagacttctcagcagaaaccttacaggctagaagggagtaaggccctatcttcaacctcctcaaacaaaacaatcttcagccaagaattttgtaaacagcgaaactaagcaacatatatgaaggaaagatacagtcattttcaggcaaacaaatgctgaattcaccattaccaagccaccactacaagaactgccaaaaggagctcgaaatcttgaaacaaatcctggcaacacatcaaaacagaatctctttaaagcataaggcacacaggaccaataaaacaaaatataagttaaaaagtaaaagcaaaaaacaaagtatgcaggcaacaaagagcacaatgaatgcaacagtacctcacatttcaatactaacattgaatgtaaatgtactcaatgctccacttaaaagataaggaactgcagaatggataaaagctcaccaaccaactatctgctgccttcaggagactcacctcacacataaggactcacataaacttaaagtaaaggggtggaaaaaagcatttatgaaaatagacacccagacaaaacaaactttaaagcatcagtggttaaaagagacaaagagggacattatataacagtaaaaggccttgtccaacaggacaatatcacaatcctaaacatatatgcacctaacactggagctcccaaatttataaaacaattactaatagaccaaagaaatgagatagacagcaacacattaatactgggggacttcaatactctactgacagcactagacaggtcatcaagacagaaaatcaacaaggaaataatggatctaaactatgccttgtaacaaatggacataacagatatatacagaacactccattcaacaaccatagaatacacattctattcaacagcccatggaactttctccaagatagatcatatgataggccataaaatgagcctcaatgaatttaagaaaattgaaatcatatcaagcattctcgcagaccacagtggaataaaattggaaatcaattccaaaaggaaccctcaaaaccatggaaatacatggaaattaaataacctgctcttgattgagcattgagtcaaaaacaaaatcaagatggaaattaaaaaattcttcaaactgaatgacaataatgacacaacatatcaaaatctctgggatacagctaaggtggtgctaagaggaaagtttatagccctaaatgtcaacatcaaaaagtctgaaagagcacaaacagacaatctaagatcatgcctcaaggaactagagaaataagaacaaaccaaacccaaacccagcagaagaaaggaaattaccaagatcagagcagaactaaacaaaatcaaaactaaaaaaagtacaaaagataagtgaaacaaaaagctggttctttgaaaagataaataaaattgatagaccattagcaagattaaccaagaaaagaagagagagaatccaaataacctcactgagaaatgaaacaggagatattacaactgacaccaccggaatgcaaaagatcattcaaggctgctatgaacacctatacacatataaagtagaaaacctacaagagatggataaattcctggaattcctatccatccagaagaaaaaatgtttattccttcctcatatacttagattccagaagaaaatctaatatgagcttattaggtcttctcatctagaaactttctgcctcaccaggctccttgtacattgttttgacaattttgattagctaatctccagccacactgaacatcaatctgttccttacgtatgtcataacctatttaatcttaactgtttcactttctataattgttatttggtaataacattacctgtctcctaattttaagaaagcctctggagtatcttttattccttcctttcaaccatctacatttacttgtttaatgaagtgaggaggctggattttctagaacagttctaatgtatgcatttttttccagacctaattaattttagattaacaaattatagtggccgacatagtgatctccatatctctgtttatatcagtttgtttatttgttttatgtaattggcattcagaacagaattctgtctttgtgaccacaaagtgtttttctggcgtcatgtaccatctttcctggatctctttccctttgtggttttgggttagagtctaccaatgagaggcactgatataagatttggaaggagacgccgatactatcctaagtgcagttgtcagcagatgcataaaggagggctgggcttggggatcctgtacaaatgactgagatgtgctatggcttcctggtgagctcctttcagtagctgtttccatgacctttgttctcactgctccaacagttgtgagaatctctaacttcttttattaaaacctctcctatttgtagtacctcgagtacatgcatgcacacatttttgtaatatctgtgaagacctcattaacatttttattataattaaaagtgtaaattcttatatctcatctcattgttcattatataccctacacacacacacacacacacacacacacacacacacacatccatgccctctccacagtcaggtaaactagatacaatctcaaatagaaataataaaatgttctgagtgtaattatggctctagttattcccacaataatcagaatcaaacgaaaagggcaaatataatttactgggcccaactacttacacaagagctataacatgtatgaaaatttgcagaccactttggttagcttgatcccatcatggtgataaatcaagaccaaaaatcatcattcctagacattcaaaagtcacttaacaaaggtaaaacatcaacagtgtgaaatgtcaagacagaccttatgttgcagaccataaatgtaatgtcacctagagttaggaagtaaaggtaagaaatctttagctgaagtttggaatcccctcacatctaaaggatgagtctcaagaacattagtaatctcccatgatgaggcccattatggtatatagattctcttaaacattctagattctgtttaatctatttcttcactaatttcacttccagaaatatacatgccctttatctctatgctgatttttcacaaaacaaagggtttttgtaaaaagcaaccttttcacaggacttactgcatccacaatggtgagtaatagaaaaaccacaaagtggcatacactgaacaatcagaaatttccttctccagctaacaggctcactgttacaacctacctttcaatgtggaccattaaaatttatgtctcagtatagtaagtgacagatcagtagtaagtgctaatttcacaaatactcagggcttgtcgcatctcaaaagaccgttggccctcacaaaagtctgtcttcgtcatccccatctacctttgggtgctccccactctactatagttgcacctgacagtcacccaggaaatctgcagtttatcattgctatctatcctgggttctttatttttctcaatcccctttagatgatctgggttgatttctggctttggtcaatatttcttattgctggtgttatgtcatgtttatttattgtttaattcctatcagtcaggcatttgctacatgtcactcagtgtacatgaggcactgggaactgctgcaacttctttccacctctacagcctggtcatagcttgagtaagtctctgacctctataagagatcacaggaccttctaattctctcattgaaccgtgtccagcctgtcacacaccttagattatggagagatctagagctaacttttcatgttccaacacaaagaaactggctatttttaaacacagactttgtatcaggctctgaagatacccctgtgaaatagtcacaactattaagaaattaacagtggaatggaagagacagacaattaaacaggcaaaaacactccatcttgataaatttagatataagtactaagaatgctactaaacacctagaaggggcaactactgcagtcttggggtatgtttaaaaacatacatctctgggatgtttttaatcactacagcacatatcaaatacacaattatcaccaccaatatgtaatgaaatggaaattgaactgaaatgttgctcatggaatctacctgtgtctgtaaatccataaattaaatttatgaaaaaatagtttgttgagtgatatatgagttaatgtttaaattgtttgggcccaccttctctagcccagctctgaggacttttctttgctgttacaacatctcttccctgatacacattaactcacgaggatgaaatagggtttccggactctgtgatgtccagagttctcagtcaccccaaccattgcatgctatctatcttaagggtaaccttctagaagcaatgcctcacgtctttcagatttttataaggctcagactgggctgggcatggtggctcaggcctgtaatcccagcactttgggaggctggcaggcagatcacctgaggtcaggagtttgagaccagcctggccaacatggtgaaaccccatctctattaaaaatacaaaaatgagctgggcatggtggtgggcgcctgtagtcccccagctacacgggaggctgaggctgtgcttaaacctgggaagcagaggttgcagcgagctgggatttcaccactgcactccagcctgggcaacagagcgagactccatctcaaaaaaaaaaaaagcacattggatggccaggcacagtggctcacacctgtagtcccagcactttgggaggtcgaagcgggcagatgacctgaggtcaggagtttgaaaccagcctggccaacatggcaaaaccccatctctactaaaaatacaaaaattactcaggtgcagtggtggacacctgtaatcccagctacttgggaggctgaggcaggagaattacttgagcccgggaggcagaggtaggttgcagtgagccaagatcatgtcattgcactccagcctgggtgacagagcgagactccatctcaaaaaaaaaaaaaaaaaaaagggaaaaaagattcagattggacaagtgatttcaatggtggctatttctggtcaagtgaaggcactgatacagaccacagctgcaggcagcttagcttcccaatgtgagcctctcagggaagcatatgcacctggtaatcacaccgctccacctgggactagacgtgttcacatccaaaagaagcaatcatattttaaggggcttgtagttcacaaagtccttctgttctagaatctctttggatcctcacaatagccctgaagttcagatgaggatacttgttctgaatgattaaataaattgactgggtcaggccaatagtgagggcagaacttcctgatggcacagcctgggctcagcccatcctcctacagtgttttctgctttcaaggctttgatgctatgaagaaaagcatatacctcacagtgacattactgtctaagaagcagacagcttggcaccatgccttgaaagaaatcagacatatatttttgaataaaaatatctacatcgcaatttctaatacaagtcttttccttcttgttgattcatcctcaagtttttggaaaaatgaaataaggcatgagccagaacaactggcaaaataagcaaaagtatagcggggtgtgggaatgttgttttccacaactttgtcagaaaaagaaagccagagaaaacagtacttcctaagaagcttctttgactctactccacgaaaaattgataagaaaagtatacatcgtgctgttaaaaattatctccatctgtggagatgaagcaggcatcaagttcacagttattcagaaaagtgctggtgaggcagttggaagcagcaagcagagccagtgccgaccaaattcatgcccatcagagccctgagcgttaggtagaaaggatgaagctctctgcctgtttgtagtgtgtttccccaaggcctccttccctaactcacttcttattacaatactactccctgccggtgcagtgactcacacccgtaatcccagcactttgggaggccaaggagggcaaatcacttgagtccaggagttcaagaccagcctggccaacatggccaaaccccatctctactaaaaatacaaaacttagctgggtgtagtgacggacgcctgtaatcccagctacttgggaggctgaggcagaagaatcacttgaacccaagaggtggaggctccagtgagccagaattgtgctactacattccatccggccgacagaacaagactgtgtctttaaaaaagcaaaagtaaaaacaaaaaaaaagcaatacaactccctgtataggtttttattattctgatactgtgctgtaattgtggagagttactggacaaatcttttatgtttagttattccaacgcatacaataaggacatgttatttgaagagaaaacaaacctgctctctgagtgctgtgatggtttcctgaatttccgctgcaaacgtgctgaaatcttgggagaactttgtttttgccagaactgtcacatttctagcatcttcacccacatatattttatcttgttgcctatttataacaagaagcaaataaaatgctgaaaaataaaagtcgtgtgagaattttaaaatatcatcaaatcttctttggtcatttggcatgtacaaggcattgtgattggtgttctttgtgatcttaaaaggaaaatggtatgagtggaattcaaaattaaaattaaatggcagataagatgataatccagagtgtcacatctggttcatgtaatttatctaaaataataagaaagtatttcttatgacataaaggaaatttcatgttgtattacatatatatttgatatattatttagaccttaaagtatttcttttgctaacgaattcttcatttcactttaaacagtgaaagagcagtgacaaatttaatataacatattatccagtagccaggtagggaagctgctttctctattataaattcatggcaagaactaaaataagataaggatactatgagtgacaaaaatctaacctttaacctgatgcaaaatagctcagtcttgttgataataaaaggatataaggaaaccttgggttgaatttaagatatgtttctttgagtttactgaaactttcaaaaaacagaagcaaataactaatttgggaaatagaaatgaaagttctttctatttacaattatcatgtattgttaaaaatatttttagatagatttgatttattgggtatgatatctgcatttcaagtgctcttacgtttttccaaattttgtaaaaagttgttccttgtgaagaaaccattataactttcaaaattgttctgctttattctatttgaaatatgtcttccattgtttactaagaaaatggcttgccagaaacagtacattctatgagcttgtaaaacaagtcataaatcagagacatagtatagagtttacattaatcagggaatttaaaaaagggaaacaaagaaaaataacaaaagttaccaacagcagtagtttagtcactggataactccatgtcctctgaggcactgtgagctagaggcaccatgaatcagtactgaccacatgctagcttctatacagtactgtgttaaaacagtttaaatatacaagtattgttagggataatattaatgcaaatggttggacattttactttcataatgctctcttctgtaaatcttcagtgtctaatcaaaggtatttaatcctgaagaagcctgaatgaatgtatgaagatataaccaacagtcaaaagaccacacgtgggaacacggggaagtggctgatgttggtgagcccagatgttgtggagtaggacggtattcacaatttaacaaatatgtgtgggtatgggccatgcatcaggcattctgctcaggtagatgggtgcaggatgtgagggtgctgccgttaggctcctcacattctttcaaagcagaacagttggcaaagaagcaagacacatagcatctgcattaggaagacaaataagaggtataaccttgtatttataggcaacaatactacattttaagctttactgatgtacaactgatacacacaaaaacacacatatttaatgtatacattttgatgagtttggacatgtgcatatatacctgtgatattacaaagtactaaatataaatatattcaccacctccaaaaatttccttattttttttcacgtgtgcatgtggtttgttttggtttttgtttgtttattttcatgatgatacttaatatgagatgtatcttctcaatctatttgaaactatacagtaccatttattaactatgggtactaggttgtgcagcgaatctctagaactaatttgtcttgcataagtaaaactctttactcattgagcaacaattctccatttcgtcctcctcctagcccctggcaaccaccattctattctctgccactaagaatccaactattttagatacctcatataaacagaatcatgcaatatcttccttttgtgactggctaatttcacttagcataatgtcctctagaactacaatgacatagcacctcacacctgttaggatgactattaccaaaaaacaaaagataacaaaaatgttagtgaagattatacaacgttggtggaaatgtgggttggagtagccactgtggaaaacagtatggagactcctcaaaaagcaacatggaactaccatttcatctagcaatcccacgcctgggtatacagccaaaataattgaaatgaggatatcaaagagatgtctgcactcccatgttacctgcaaaattattcataattagcacaatatggaaacaatataagtgtccatcaatggacagatgaacaatactgtattgtacactgacaaatgtgttaagaggtatgatctcatgttaagtgttcttatcacaataaaataaaattaataaagtaaaataaaatatataaaaaataaggttttacccataaaaaatagtatatgctatttaagaagatttgcaaaatgcagtaaagtataagagaaaaatcatcagtactcaattaaaaaataggggagggatgacctatattcatcagaataaacttttaacataattatttatatttttagtttattatttcatttacaaataggttttttccatagtaaaggtagcacatgttattttagaaaaaaattgtttaagcagaagttcagaagaaaaaaataccacttaaattaatcaggaaaaatggttctttcatctcaaaaattactttgcattgttgatttctgattgaaaaaaaattagaaatctctgaaaacacacaatatgaagaataaaatccacgatagtctcaaacaaacatgaatgcataaataagtaagaaggcaatgccctctgcctgggagcagagcagtaatgagtctgggaagctgtgtaaagagaatcccacgtcaggtccatgtagttagtgcctgctctgcgcaggcaggagtcgaagtgctagcgtgcactctgtgtcacttaactgcctagtagttctataagacactataactagcctgtgtttcaggtaagaatactgcagcttagaaagttgttaacatgtccacagtatatagagctgttaaactgcacagctgggatgctgattaagattcaaaaaaaaaaaaaaaaaaaagggccttgctcctaaccagtacacagtctattttccatccatagagagtggtgggtgatttaaagaatgatcaggtttacattttagacaatttggaaggatagaagagaggcaacgagcccaggtaggaaggttattgcaaaaaatgaaacacaaaaacccaagacactgtgaatgttgctatattttggattcttaccaaaaacataaaactcaacatattgcttataaaaaaagactcttggatactgtattgaaagctagctttaatttgtgaccaagacagaagaaagaaaagatagagaagagaggataagtgcaagtaaaatgggcacacagagaaaacaagaagtgaaattacaaccgcaattctttgtgcatgttggttgagggaatttgacctcctctggtctaaacaactatggtacatttaagcacaacagaaacaatctataaaggattactaaagcgtgtgttgttataaaacaaaacaaatcagagctcttcttacctttttattgtcagattaatgataaactgaactcataattgtaaagtgtatgtttgagtaaaagtttgataagattggcaggaggctaaaaataaaattagccaatctttagctgaggcaacatctgagctgggcttcaatgggccacccagagtattaagtgtttcggtaataagttaattttatctcaaaaacaagcaaaatgagtctttgaggtaaaacctgggtgtggctgtagaaaaggacagaaggtagtaatgggtgttgttatccatgcctgtgcttgtggacaccactggaagggactgatccccatcaccatcttataaaacaagggaaattgccctccaatatttgagtccggtacccacttctgatgacacactggtaaaacgcttcacctgaatcaatggaaaaacagatgaaatgccaaataaaagggccaagtgaatgtttccaacactcaaattatttaaaaatggttctcactaggactccaactcctgatcagagttccaattaccttgcctggattagctccaggaacacaaaatatatttcatttcctcaccctggaatttacagctcttcactctttgcctcaaccttctttcagaatgttctggaagaatgttcttcattcctagttattgaacacaccaactcattcattcattcattttgggttttttgtttgttttttatagaggtctatagacagtctcgttctatcactcagggtggagtatagtgccgtgatcgtaattcatgggaacctcaaactccttagctcaagacattttcctgcctcagcctccctagtagcagggactactggtgtatgctaccatgcccagctaattttttaaattaaaaaaaaaaaaacttttttagagatggagtctcactttgtggcccaggctggtcttgaactcctggcttcaggtgatgctcccacctcagcttcctgaatatttgggaccaactcatttagacacatgaattgtaccattctccaaacacacctcacttccctttgctcatgttgttctttcagacttggactcccctaaatgctatcaaaatcttagcttatccttcaagagccctcctctgtctacccggtcaaagggccccaataagaattaatcaccccttgctctgcactactcactccatgattggatttcacttcagtactcatataagcactttcgttaagtgagttaatatttgtttgatgcttaaaagaatgtttggcattcagtgaacactacaacagcatgtgtcattacagaatgtgtgttacagaatgcctgtaaaatgctaggtactatattagtattcagtgctttacatatgtatcctcaagttaagacaataatcctgtaaagtaggtattacatgcccattttacagcagaggaaatggagatttggaaattttatataacatgcatagttatgaagcagtagaaacaggatttgaatccatgtgcctgactctaaagccttcacacttcttgtccaacaacactatctcctctcctcaattttaaaacttagagtacagggcccatatattgttcaagttgacaactgtaattgaagaaatggatgccaaaaatggattttgaatttgactaaattatactacttagaaggcagctatggacaacaaaaataggatacatggttccttgaaagaacctgcatggactatgaagctgtgaattgcaatgtttattttggtaacttaatttcacaagtatgtactgactccttattcaatgaaaaggagctactggacatacctatgctcaaggtagtgtttctgctttcagaagcttccaagtcaatggtagggagaaactttttaaggcaacactttgtatcaagctaatatacaagctacacaaaagaagtcctaagggatttcaaaggaataagactgacatttctcaattttctaagagttcaaaaatattccatcttggtcacaaatcaagccttgcttgccatatattattcatgaattcaaatcaacttaacatgaattagcttaaatagatactattacctttctcgcaaacaatatgctgtttcatattttcaaaaagaatctgaaaaatatcaactcataatgtcatttaagggatcaaaactagcatctaatacacttagttttctgcactttactgagaaaaattcattgccaaatacgctctggttgggctattgcagagtgaaatggaacccaaacacattacagaattcattctgtgttttctccttttcatgtgattcatcctatatgtaaataagttaactgtggtctctattaaaaaagataaaaacaaattgtaggtttgaagcaaatctatagtaagttgcctaaagaaatgagatatttctatacatacctacttcttagatgacttaactccatatccttatcaacaggatagctgtattgagctgagcgtttcttttgagactcttgcgtcactgctctgaactgtcctctactcctacagtctgtggggaaagaagtaaccacaatagcatcatgtgagatgcgatgtcatgatctcatctagatcatttctttaacagtcagagagggcaagagtaccaagaagaaagagtagagagcgagagtgagagagactcatttagtccgttccattttgctgggtgaccacagtctcagatacctgcttttgcatgtcactgaatctctgttttgcagcagcaagtgggatgcaaggcagtctgcagaacctctggaggagccccaggcagagtgatgctgaatcttacttagtaagggcatggattgcatggtgtcttttattcactaaggacttggcacaatgaagaaagaagcaggacagtcctgagtggaatgcttgaaatttggcaactcctcaaagtgtctcaggcacacctgatacccactagggatttgttttttaagataccccctgttgcacaactgtactgtgtcctccaagtggttaaaattgtaagttttatgttatgtgtttttatcacaatcaaaaagatatgagaataacatgaaaaacttgttgcaaataaatatggaactttaaaaagtggtctctgatatagtacggatatccccctcaaacctgctgttgagatgtaattcccagtgttggtggagcctggtgggaggtatctggatgtgggagcggctccctcacgtctttgtgctgtgcctgccatagtgagtgagttcttggagatctgtcgtttacaagtgcgtgggacctcccgtactctcttgctcccactcatgtcatgtgccctgcctcctgctcccttttgccttggccatgagtgaaagctccccgaggcctccctagaagctgagcagataacttgcaccaggcttccagtatggcctacagaactgtgagcccattcaactgcttttctttataaattacccagtcttgggtattttttatagcaatgcaaaaactgcctaatacactctctaaaatttcatatgaaaacagatggtctggaaactaagatattttgaaaatgaaaaagaatgacgtaggaatcaacattctcagatagtaaaactactatatatgaagttcaaaaataaaaattcttaatattggtgggaaaatacctgaaaaaataaaacaggataacaacccgagagcatcttaccatgcaatcgaatttaacacattatattaggcagcataaattggaaaataggcagagagtacttttgttctgggcagctagcaagttattcttaaaagaagagaaagtgaaaaccacttacatcttcaccttatcatatgtaaattaaattcaagaggaatattacatgaaagattattaagctaacatgaatatgaaatttaggatgatttttaaaataacacaacaaactgcaaatgctataatgctagacaaaataagagtaaaacttatacatatgaactcactggtattaaaacataccagaaataaactaaaatgaaaacatcccaaaattaccacagtgacattgtctagaatactggttatggttgttacttgttttcttttttatttctacttctaccttttgttttcaattaaaaacgtctttatttataaaatccaaacacagttcactgaagaaaatccaagccttcttataaggtttacaagttaattatcatattgttgtatattaccataattggataaaaaatttctggaggccgggtgcagtggctcatgcctcggcctcccaaagtgctgagattactgtcatgagccaccgcgcccgacctattgctacttttataacggtgaagtcaagacattctagataaagctgtacattatactaagggacccacaggtgcttattttcccctactgttatgctgttacctcgacttagtactttactgataattaataacgcataaatatttgcagctctgagtaaaaaaaaaatacatagaaatatttacgaagaatacaactaaagaaagtgaacttcaatcgtaaaatgaaactcagtctttctatttctgaatagcacacagcttttgtcaataaatatttatggagatcttactgaattaaggtattaggctaggcactgtagagaaaataaaagtggataaggcatggttcctgattttcaataggttgcaagtattctccccactacaatgcagcatctccggctaagccaaatatctttcttttcaattctcatataaaaaggaaaaaatatagagaaaaggctctgcagataaactctcatcatctatggtctttcattattttttagaaagatgaagctttagaatttatttactttaaagcaccaatagattgttcaaggtcatataaataaaacccaaaaagcaaagaatcatgtatataacactgcaggtatacacagatgagtacacctgaacagaaacaacccaccagactgcagtgacatggcaggtttcttgtaatgtgacagctaaaatgttgtagttctgacatcatttcttttaattcacttcgttatttattcctggatactgccaaagaagcagagtattcttgattgctgaatgtttggctcttaagcaaacaacattacatttacatttaaatgcaatgttagtatagtagatgctttgattttatccctatgcatatttatcttatataaatatatacatatgcatacatatatatctatgtgcatgtgtatatatacatacatgttttcaagctctgttcttaggctttacatgagttatttatttgaaactttacaataacctatactcaatattatcttccctattgttaacctgaggcacagaaagattatattatcttgtacaaagtcctacagcttttcaacagaagagacagggtttaaatccggacagtcagactcaaaagccataacactacagcacagaatgaggaaaacagaagaaagttaactcctagatttctggcttatgcaacttgcaaataatagggtcattatttgttaactgaatgaatggatggatgagtctagtgtggaaagtaaaatgaaatgacttaaatttagatcagcttaaatttctggtctatgtgtgacatgcgggtatgaattacagcagatagggtgtttgaagacggcaacagatgtggatgaagatacagccagataactcgtgttcaagaggcataacggtgggtgggtgtgtgtgtgggggtgtgtgtgtgtgtgtgaatcttcccattcagggcagccttggttgcccccaccctgacgctgctcctgcctttgctttgtgaatggtgacctagattcttagtgggtgaaacaaggttcttccctatgcagcaccttcttgcctctccagtctcatttctccctaatgcacaatccacagccaatgatcctgctccaacttcatttggtctcacttgagtgacaaatgccataggtgtcatgtcagccttctccaggaagcctttcttaactgccaagagcaagtcgaatgtaaactcattgcactctctcagcactctctggatacattgggtcttactcctcacattctctgagaagagcagaagagaagggccttgtcctacctaccggttaatcctcagcacatgcttgtggcaggtgcctagtaaatgctttaataaaactagaaaattctcaagacagcaggttgctttcagaatatgtctgaatattgcagttcattggagtggattgacagtccgtggtgaataaacaaggtcaagtttgggagattgagctacagtagctcaggcaatcctatgtctttccacgaattgatcaaaactatgcaactttggaacactagtatcccaatgctgcattccatagattaaaaatatgtcaaaattgatttttcaaattggcaaaaatatatctgatttttattttcaacactttcaacacctcttatttgcttgcaaaaaggggaaaagtacaaataactgaaagcaaacttacaaaactgacaataaatttgagggacactttgagaatgaatgcattcatattgcatatgaaacatctctgttgtctggggtatataccctggttctttatctcttaccgagaaaaaattcaggacacggacacacacgaggagtgggtttagaggcataaagtttaatagacaaaaaagaagagaaagaaaaaaagcttccttatgctgggaaagctggtcgcccaagatagggtctctggtttgggacggaatgcaatcaattttgtacagaggcttgaggaggcagtgattgattcgcatagggcccaggggattggtctgaccaggtatgccatttagataacctaggaaaagactagccctcccaccctagtcttttattagcaaatgcagcttcttttttttttttttttttttttgagagggagtttcactcttgtcgcccaggctagagtacaatgatgcgatctcggctaactgcaacctccgcctcccaggttcaagcgattctcctgccccagcctcctgagtagctgggattacaggcccacactacccggctaatttttgtattattagtagagacggggtttcactgtgttggccaagctgttctcgagctcctgacctcaggtgatccgcccacctcggcctcccaaagtgctgggattacaggtgtgagccatcgcgcccagccgcaaatgcagcttctacctggcagcggccatgacacccgcacacgtggtgacaaggaaaagggagcaggaaccgccatgttggatggacttggctcttagccacatgtatttacacatgcatatctatgcttgcagcctgacctttcagactgctttttgttagagaagaaatgatttggggctgctttttattaaaggaaaattccaccgagaacttttaccctcgctaacttcccaaaataatttcttaataactcctgtattaatagcaaagtggcttctagttctcataaaggaactgagtatattaatacatcatatctttagatgatgtttcacctcaattagaatcaatactgaactatccccacaattgttttgaagtgagacggttccagtagcaccccattaatatttcttcatactcttactggtatttcactttcttattacaattgctttaggaatctatcacagtgttaacaggttactacaaatgcaatggcttaaaatgatacaaacacatttttatggattgctgtgtattccctcaaaattcatatgttgaaattctaatccccagtaactcagactataacattatttggaaatagggttgttgcagagtaattcgttaagagaccacactggagtagatgggccactaattcaacatgattaatgcccttataaatagaagaaatttggacacagccatgaacacagaatactgtgtgaacatgaaggtagaggtcagagagatacagcagaagccaagaaacaatggatgttggcaaaccatgaaaagtagggtgaggggcatagaatgcattctcccacacagccctcagttggaaccagccctgccagcacttgatcttagactcccagcctctggagtggggagacacattttgctgtctcgtttgtggtgctttgttacagaatcccaagcaaactaccacacgcagcacatcacaccttccgtggccagaatgcaggactcctggcacaggttagcaggtcctttgctcagtctcatgaggctccaatctgttagttgggctacattctcatgtcatctggggcagaatctgtgttggcagaactcacttcctcgtggttgtgttactgaaggccacctggaggccacccacagttcccttccatgaggccctctccataataaataaaaatcagaaaaatgttatctccacaacatagtggtttgctttctcacaatcagcaggggaatctttctccctccatctagtaagacagagtctaatatgaggtagcttcatcatgggagggacatttcatcacctttgctgtattctgctgattagaagcaggtcacaggttctgctctcactgaagaaaagggatgacatgagggcgtgactcctcagggttacattagtgtgtggtcatctcaacaaccatccactgcacactgccctcgacttactctcatgaatcaggaagataattcccaccataaaaaaaaatgtactgtagtatggagattttgcaaaaagctaaaaatagaactaccatttgatccagcaatcccactactgggtatttaccaaaaggaaaagaaatcattatttcaaaaaggcacctgcactcatatgtttatcacagctctactcaaaagagcaaaaacacgagatcaacctaaaagtgcatcggtggattaaaaaatgtggtatatatacaccatggataatatggtttggctgtgtgtccccattcaaatcacatctctaattgtaagccccacatgtccagggagggacctggtgggaggtgattggaccatgagggtggtttcccccatgctgttctcatgatagtgagggggttctcacgagatctgatggtttaaaagtatgacacttcccctttgctctctcttcctcccgccaccttctgaagaaggtgctttcttctcctttgccttccaacatgatagtgagtttcatgaggcctccccagccatgtgaaactgtgagtcagaaaccctcttttatttgtaaattatccaatctcaggtagtacctctataacagtgtggaaatggactaatacaatggaataatactcagccataaaaagagtgaaatcatgtctttttcagcaatgtggatggaacttgaggccattatcctaagtgaaataactcagaaacataaaagcaaatagcacatattctcacttatgagtgggagctaacaatgggtacccatggatagacagagtggaataacatgctggagactccgaaaggtaggagagtgggaggagagtgagtattgaagattacctattgagtacaatggtacaaagaagtatacaactaaaaagcattcctatgtctcaagactccaagaaagaaaatggctacaatcttcttctaattttcaatttcatttttctctctttgtcattattggaaaaagcatgttattattatgttattgtgtatattactatgtattatatatatattatacctatataatacatactagatattagatgaatatataatttcttatagttattacttctccttcctttattttttaagccagctattagatttattcatcaattccacttatatctttattcaggctttctcagtacattcatatttatttagctgtcttttctctaacatcttaagctgtgtgttttattaatttatttttattatttcatttttaataaaactacaagtttgtttctgtatttacctctgttacccataaattttgataataatgttgtaattaatatttttagatattacacttcttgataaaatatttatttggtctaatgactaaaaaattctcagtagctattttcttttaaatttgattattttagattagttgcactgtggtaaaagataatgaagtctgcttctgggaattttagtgttcctagtgacctagcatataatcaatatttgagaatctttatgaatatttgaagataaagttaattttagcttatagggacaaagttaaagacatctttcacaaattgatctcattagtaatattcagacacaattctattaagctgtgctgaatggatgctaagctatttcaaaattgagattgaaataaacttcgtttcagtgaatgcttttcttacttacattcaactgtgtattgttattgccactcctgtttctgtgtgcctgacttaactttgatgtatgcttttatatgtgaccattatcaatattttgcttatgtatggcccttgttaatggtatagagttaaaagctgctttttggatagataaagcagtcttcgactttcagtaattctcttaatgcactgaaacttcaggcacatttgggtcttatgaggattttaagatttttgttcttcaatgtttcctttaaactccacattgttggttttccctagtgatctgcagagcatatatcctgtttaccaaatattttgccttttatgggaacatatttgaaaccaaatttcattaattatcaatgtcatactttaacaatattaataattacaaatgtaatgaggatttctaaattttctaatttttatcatttatcatcatgcttatgctaagtcaattttatcagtagaattttgacttatttgattatggcacaaacaaatggacaattacaaaatttgctgaaataagtagattggtaacaaggacttgtgaatgttgtttaattgcacctgcaatgcctaaagtattatgcgaacactcttgatcctactgattagctgatatgaaaaattagcttaaattgatgttaaaatgtcaagattgttgcatttgtaattcattagcataagattctaaaagggaaggtcatcagctaaagacagttctcatgtttactaaaaggcacatatctaacgggaaaatactaagaggaacatatctgatgggaaaataccaagaggcacttattttatggtaaaataaagttctagtattaagaaaccattttcttaaattaagcaacttggtgaagccctgctaatgaattacctaatcctgatatagaaaaatttttctttcttatgtgatagaatagattgtaaataaatgcagaatgctgtatttggaagataacttatccttagaacttatgagagggttattttcaagggaatgctttgtactctatgtaaagtcaacatcatcagtagagtttgattaatcatctatatcactgaacactcattctgttttgtatcatttcagggctattatttgccctttttcctactgtaatgttctcaccttgatttcaacaagtttttcacacaagatattaggtactaacagacccaaggagagtgggagatgtccttatggtgttctattaaaaatagcaaaaactgtcaaagacaaacctgagatcactgttgcaatgtaattgcttcattaaagctttataggagttgcagaaatcttacttctttagtaatacttcgaaggcattttataagttaagcatgaaaatactacagtgtcatgaaatacgatggtaataaaattagtctcttatgaaagaaattaaactttcattagttcacaaacataagcacaatttatttgaaagaaagtcatgagcaaacctaaatatatttacatttgtacataaaatatactgtatttacaattacttgatgctctaaagacagaacttaatgtgacgtatgcagctggaaattacaagaccacatggttcaataaatcccagtagaaaatatacatctgttgactctttgtgcaattgttttatttgaaggaagttttatttaatcgagtggtatagtgtcttagtacgtcacttatcttgtcttaggaaacatcccacctgccttaggtgtaagtttttaatttctaaaataaatgagagtaaatcattttctgttctatattgaagagaatgctttctgctctatgcaaagtcaattttatcagtagagttttgactgatttatgacacaaacaaatgtgtcaattgtagagtttgctgaaattagtagattggtaacaagaacttgtgaatattatttaattgcatctgtaatgcctacagtattatgcaaagactcttgatctattgattagctgatactgaaaattaatttgatgttaaaatgtcaagactgttgcatttgcaattttttaggacaagattctaaaaaagaaggccacccagctaaagaagagttcctatgttaactactggtgaaagagatttggagaaaattacagaaagtataacgaaaggaaaactaacgacgaggtcacatggtggggtgaggaaaacaaatggacttggcaatggggagtctgagctctatccctaggtctgctaataaataactgagagcaaattacttaaacctttccaacttttgcttcctaatcttaagatgaagtgttggtttttttggtcttgtttcttagtcaaatactctcttaggccacctccagcttcaaaaatctataactggctgggtggggtggcccatgcctgcaatcccagcaccttgggaggccgaggagggcagatcacctgaggctgggagtttgagaccagcctggccaacatggtgaaaccccatctctactaaaaatacaaaaattagcttggtgtggtggcgggtgcctgtaatctcagctactcaggcgcctgaggcaggagaatcacttgaacccgggaggtggaggttgcagtgagccgagattgccccattgcactccagtggtgataagagtgaaactccatctcaaaaaaagaataaaaaaaaaaaaaagaaaatccgtacctaagatagctaaggaaagaaaagaacctagtaatttaatgtgaaatgttctgtaaagtatgttaagtgatataaaatattaaatctcaaagaaaatttgaaaatttttgctttatcttttatgctggtaaaataagattcttggctttctcgttatagtcattcatttatcaatcttggttactgtgatcttttgataactacaaatttagcatttgtctcatgaggtttcccttttcccttttccttaaaagaaaatccaatcaaacaacattttgaacacttgctgcttatcacttcaccagctacgcctctgtcggagctctcttggttccttatcttttcttaatattttcagtgggcacttactattccctaggccttacctacagcactgaattattatgtttctgctggctaaaagaacaaaaactccaatcaagcagctgattcatctgataattatcccccaaaccaccctactgtttatataagctctgagtcaacttgtaagttgttttgacataatttggacactgtcaatggaatagcattttctcaagtacccagaaaaacaaaaacccctcctcatggacaacaagcaacataatctttggccagaatatcccattatttgaatcagaatatagtctcattatccttaccagtattaatccttccagagtgctgtattaatggactaagttataagtatactggttttctcctatgtatcttgtaccaaagacatccatctacctgaggcaagagtacacacagaagcagcacagaactcctggactgcctcgcctctgccatgtttccacattctctggtactactgatggcagttcctgtgcaaatcacagcattcccagaatgacttccagtaaaatgctgggtggcccaaagataagtaattatacagagaatatcaagaagtggtccctgaaggaggtcatctaagcagacagtatctgatgtggcttcttcagatgcatttgcacatattttttcatacatatttagatgcaacttgctcatattgacaaaatcagagtcagtatacacacacaatagagagtataaatctatgtgtcaaaataacatgggcagagaaattaacccacaaggtaaaagaaagaagttggcaacaccagagtggaacaaataggatgcctagggaagaaaggatccctgactttttttggagattaaccacatgatttttatttttttcctaatggagggcttgtaggtttgtttttgagtaggtaagaaatataacagattggacaattctgtcaatatccacaacatacctttaaagctatgcctacttctgggcatcacactttaataaagaccttgatgaattataatgttctgaaagaaaaactgataagtaaaatcagaataatgaagcaactctaaatcatgcagcatgaagaaactagggagtctgggatggaaggtgtctgtttagtgcagaagaaaagattcattataaaaaagaaagccatcttcacaggataaacatgatgtcacaccaaaggagaattagaattatcccacgtttctccacaaggagaaaaatgaccaaatagaaacctattatgataagtttcatcttagtataagattaaaaatgaaacctaatgaattatctttaaatgaaatagattctcagatgatgtgggctcagagcccatgggatttcatcttctctcttcccaggctaaaagacaggagggggctagctgaaacagtaaacaggtagtaccagttttgctttttacttacgataatcctgaggatccttctaagagctttttcgtcttcaaagaaatcagtgttttagaactgaattccaggtcaccccttggtttcagatcaaaactggttttctcagaccttgtgtcggtacattcctggcccccataatagtgtgtaaaaaaatgattaaacagggtcttctgtgaccttgaaaaaccaaatatgctgattaatgctgtcagacaggaaagctcacatgcctgtgctctccctgaagagctcaggccttgatcagcatgtacctcaaccaaagacaagaggaatggtctcgcctggccccagcatgaggtcctcatcacaggacgctcattgcagcacgcggacaatgagctcacagggatttgggagcacggtgccctgaagatgagcaccccaaagatgggccttcttcccctcccccacaaccccaggggacaggcctcccctgggcaagtggcataggaatatagaggccacagtgtgcttgagaggacaggggaaccctggggaaaaatgcagcacacaatcctcctaaaggctgcaggcctgggggaaccacgcccagccctgctcaactgaggactcagagcagcttacctctgaaagggcttcatgttcagatttctggccgagagcttctgccctcagagtgtgcagtgtgtctccacttctcagaaagccaagaatgaactgaataagtgggttgtcttcctgctttagcctacgggaggctgatgtcatagcccagcccagtgaacctgtctccttctgctaggtttctgccatggagataaacttgacaacttgagccaagataaaaaaagtcactgtccatgaaagggtcccgaatagttatcagagagaggagccactttctcagtgaaaacatgacccaagagacagagatgacaaaagaacatctgtttaaaatagtaacaataataaataataataatacaaacagggcatttccaatgctgcagaaaatgatgtcataaaacttaaacagatgatcagatgatgttggaactaagaagttaaatagataaatttaaaaggaggttgatctctgttgagactgattagtgaatttgatataagtggtcatgggcaaaaaatatatcagagcatttagcaaaaatataaaagagagtaatatgaaggaaaagaaaagagatttggagggtagacctaatgctcaaataaagaacgtttcagaaggaaaaaaaaatatttggaggacacgtacagatatatacagtaaataaggaaatatatgtataaatttccccttgttgaagaaatatgcaaatctatgaattgaaattgttccctaagtttgacactggattgataaggaaagttacatctaagcatattctgctctaattctgaacaaaagatcttacggaatcccattaaaaaagcattagagaaccctatttaagcaggggaaaaaaaatccagactggcacctatcgcacctatccatccaattgcaatataagaaactagaaatcaggaaaggaacactggcaaagaatgggaaagaccacagtccaggaatcctatgcaagtaagatgctcttcactgttcagcgggaaaaagatacttgagtacaaaatgccatttgtagaatactttacacaagtactcaatttgaaagcattacttgataggccactttaggaaaagagaaaagcaaaaaaaaaaaaaaaagcaatgagtagtaaaggcaagcattttccacctatatatatgcacacacctatacatgtgtacacttactcatgtgtatcccagacacgtatatacctatacatgcatgtatacaaccattcacgtatacacttttgtgtacacatataaacatacccatacatgtatacaaatatgcatgtacatacccatatgtgtacacatctatgcatgcatacactcaaacatgcatacacccatacatgtgcatgcttacacatgtacacacatctgcatatacacacctgtacatgcctatacatacaatacctattcatgcatatgactatacatgtacatatgcataacttaaacatgcatgtatcatacgtgcacatagctatacatgcctatacaatacatacatctacatgtacatgtttatgcatacacatgtatatatgtacacaactacacatgcacacacccatatgtgtacacactcatgcatacacatacctatccacgtacacagttatatacacacatacatacgcatgttgttaaattaggtttagaccaaagctacttccttacatattttaagttcagcctaaatgtttttccagacatagtgaactgtaacctaactggatgtgtaaacagactgtagtctactcttgtgtcaatcgctaagttttggccaatcaaaggcagccaactctttcaaactgtgttcaataatgcaaatgctggtctggaaccaatctggctgtttctgtacctcacttctgttttctgtacatcagttctctttttctgtccgtaaatcttcttccaccacatggctgtgctggagtctctgagcctactctggctcaggagtcttcttaattcacaaatcattctttactcagttaaatttgcataaggtttttcttttaacagatggtgtcagaagtgggacctgaagtagaacttcctccgatgcccagaagcaacatgtgaccaagtgagatccctgccaggcccactgtggccactgctttctcacagcaactggggatcatggtattctctctcagattccaaagctccacggatttgtttttagctctctgagtttgagcaaatttttttatctgaactgggttcagaaaacacaacagaaactggactggatgcagaatcacgttggatctgatattaactggcttggatccagttagaggcctcttatgtctgacccagtcagacagaaactgataataaatggaaatattgcagaaggtataaatttcagcttttgcaaattcacagggatttttgtgttctaccccttccttgcacttttctctttttggttgctcaggtagaaaaaaaatcattgactaagttgatcaaggagatctgatagccaaagccaagatgtaaggtaaaaaggagatccttagtttctaaagaactgaataatccaccttccagctatgcctacatttgcatgtataaatatcagactctggaagcagcaaacacttatagaagtggtaaaatcttactaaaggtaatttaaaattagaatgcaatgttccaaatgaataataccacactttaagcagtgcatctgaaaatgagaattcctggctaggtgcagtggctcacgcctgtaatctcagcactttgagaggccaaggcaggtggattacttaaggtcaggagtttgagaccagcctggctaacatggtgaaaccccatctctactaaaaatacaaaaattaggcaggagtgatagtggacacctgtagtcccagctacttgggaggctgaggcaggagaattacttgaaccgcaggtcttgccactgcacaccagcctgggcaacagagtgagattccatctcaaaaaaaaaaaaaaaaaaaaaaaaaaaagaaaagaaaagaaaaagaaaatgagaattcttaaattagtcttaactagggatgcctattgataggcaaaagcttctaaaaagattttaatatctttactgttttttaaaagagactttttacaaatggcaaataaaaagtttaagtgactaattgataagaaaatatctgttaacattttggtttagttattattctgccccaaaggcaaaaagaaagctatcctaaagtgtttacaaaagataagacctccggtaaagtaggcttgcttctttctcacagcaatccatgctgaatccagtcatggaaaatgctttctttgctctattccttaatgggctccatgctgaactcagtaattttagctaagaaatagtagctaagttaaaaagaacacccatggaactaaaatatgcctttctggaatctaactggctatctttaaacctttttgtaaaaaaacctacatttataaaggaaatctccatttttaaggatatctgcctatgtacattagaaactcttgccattgttttcaatttacataacaagtcaaaccttttttaaagtgcttttcagactatcttgtcttaactgaacttttacttccactactttttttttggtttgagctgatgatacaatatttaggtctaaagtcttagctctgtgctgttgaaatacagattttcttgtttggcctgggagttggccctttagaagtacagatttggaattgcctggctggcagttgcttagggcaatgaagcatgtgattgaaagagggatagtctaaagagagaaaggaaaaattatttataagctagctttatgaaaactagaagatctgcttctgtgttcatatgtgtactatatatgttaagtgtatgtgataaaatttggtaaataaaactagtttttaaattgttggcaaaatatggtttcaaaattgtcagttaaatataagtaggtacttgtttgatttgactgtgagcttacggtttggttttgagagtctggattcagtgatctggacagatggccatagtgaggcctggggcaaagttctcagttcctagaacagcagctaccagccagaatcaagcccaacatgacccgttcttccctggcccagttttgcctcctggctattctgggaagggttgtatcctccaggcatcctcctcacagctgtcttccgtcctgacttctacatcaggcatggaaattcaggacttagacaagcactgcccttcatagtcctcctgggtgccacgtggctaaatggcatataggggaagacattagggaaggtacctgggggaagacattagtgaaggtactgtaacaggacaagccgtagacaaaacccctcagacactgagttaaagaaggaagggctttattcagccgggaggtttcgcaagactcacgtctgaaaaaccgagctctctgagtgagcaattcctgtctctcttaagggcttacaactctaggggttccacgtgagagggtagtgattgattgagcaagcagggggtacatgactgggggctgcatacaccggtaattagaatggaacagaacaggacagggattttcacagtgcttttccatacgatgtctgtaatttatagataacataaccgattaggtcaggggtccatctttaactaccaggcccagggcgtggtgctgcgctgtatgtctgtggatttcatttctgccttttagtttttacttcttctttctttggaggcagaaattgggcataagataatatgaggggtggtctcctcccttagtacctgggggaagacattttcagtgcatgttttctggttgtataaaagctttcccatgcacaagggctgatgttataacagtagctaaaagattattcctggagaaatagccagagataggatacttatttcactggacaagttataaaacagttaaataaggtattatagatactatagtactgggcaaagctagaggaactgactgaattgttttggtaaaaggtattgtagattaatgacaatcacatccacttccagtgtaaaacataagttgacacctttattatgtcattgaaaggactatccccctaataacacagtctcatgtatcttccactaataaactctgacataactaaatgctgcaaagccttaatgcactatgtcaaggtgtattttcacaaggtaaagaaagctttacatggtgatctgactgagcacaatctagaacctgaagactgaattttctgagaacaacatcagagttgtcctttgccatcacattgtagcaaaactttgagaccttgaaccttgggttcatgacctcacaactcagaaggtcccctccacactcttactgtattcccactggaaaccttaaggttaaagctaaccaggaaaatttctccccagaagaagataacaccattgatgtgggtagctttttcaccagatcaagaatcaagacttctctgctatcataagactcttatctttctattttttttccttgcttatacttctatgaacaataaaagtgaaaaaggagatggttgtgtggactcatggggtatacttttattttgtgaaagatattgaagccagccttatatacatagacaactttatgctttgatagatggaagatgaagggccagtgtaagtgagaaatgttcatggtacatttgttgtctcacaatcagtcagaaacagaacacggataccctcctcttaacctacatcataggttaaagagaacattgctgccatcggttatggagaaaattaataggaagacttcactcttccaaatgggcatcttttgttaggtttcttttcccatggtttggagtaaatgaagcaatgattagaaatttatccctcatgataggctcttatagcagataatactgtaaatgctatgttatacaacagactttatttttttttctttattttattttagagatgaagtctcgctctgtagcccaggttggagtgcagtggcatgatctcgactcactgaaatctctgcctcctgggttcaaacaattctcttgcctcagcctcccaagtagctgggattacaggcacccaccacacccagctaatttttgtacttttagtagagatggggttttactgtgttggccagcctggcctcaaattcctggcctcaagtgatctgcccacctcggcctcccaaagtgctgggattacaggcttgagccaccaggcccagccagttatacaacagactttaaatgctcctttgaaagttgtgctaaataataaaattgctctagatcacttagtgattaacagagaagtgtctgtgtagttgttggcacttcttgtcacccatggagaaatacatcacatcaggtattacagagattcagttgtaaggaattaatgaatagactgcttggttaaagtgagtagattctttacctagcacattctttgatctatttgattttatttggttggtttggtttatgggaccccaggtaaggagcatactccaagctcttggtattatcctcctgataatcataacagtagtctccctgctgcgttgtattctctcaaaaattttaaacgtttgcatgcagccatctgtagaatgtcaaatggcctttcttcaactggaatgacaaaaactcaaagaaacatgtgatcatgagaacatcgtagcctgtgagtgatatgctgagacagaaaacccaaaatgatggtaactgagagtggtgataaggccctaagtattggtcacatgctcacctaagtgagaaccttaccaaaaagggagaggaggtttttaaacaaaattatgggagatcattgttttggactgagctcctgcaccaggccccaacaaaccagacaaaagcaaaatggaggcacttatgctaaaagcagcataaccaaactgaaactttaaggaaggagataggtcctaaagtgaccattttctccccctgtgaacagtagattccaacaaaagaaggttgcccctactgtaaccctcatgaacacacaaaattacttgacatttacgatgatgacagagtgacattaattcctaaagttttggtctatctcccaaagttgagaggatgaccaaaagagggaaattgctaaattaagcttagcccaaagctgcctccttacatattttaagtttggcctaaagatgtctggacatagtgaacctgacttgaagtgcaaacagactgtaatcaactcctgtgtcagctgagcctcataatcagttggccaatcaaaggcagccaactcttcaaattgggttcaaataaggcaaagcccaagctgtgaccaatttggctgttcctgaacctcacttctgttttccgtacattgcttctctttttctgtccataaatcttcttccaccacgtggctgtgctggagtctctctgagcctgctctggctcaggaggctgccctttgtcaagtaaagtctgttaaacttaatttgtctaaggtttttaacaatgtacacatctgtatgtgtacacacctatacatgtatacagacatagaagatacgttttacgtatttatgtatataatgcatatgcaaataatgggaaaaataaataaggctaatttgaagagggaagctctaaataacagtaaatgaagtaactaaattaaagaaagccctctgtacagtaggacctgacagtgggcagtgcacagggagaaggagcagcacaggtgaaatgcagcagctactttgttacagagaggaccaagggactgaaagaaatcttcttaagcataaaaaaattcaaataaaccgggtgtggtggctcacacctgtaatcccagcactttgggaggccgaggcaggcagatcacaaggtcaggagttcaagaccatcctggtcaacatggtgaaaccccttctctactaaaaatacaaaaattagctgggtgtggtggtgggcacctgtagtcccagctactttggaggctgaggcaggggaatcgcttaaacctgggaggtggaggtttcaataagccgagatcacaccactgcactccagccttgcgacagagcaagactcttgtctcaaaaaaaaaaaaaaaaaaaaaaaaaaaaattcatataaaaggaagcaagcatgttgctgctgggtaaatgatgaaaccatttcaatttagtggcaagcctgggatgttcaccctcaccattgttaacacacagcatttgcagagagctcatacagattgattaaaggacaaagactatgaacacacaatgcacacagccaatccccaaaaccaaaaaccatggaaaaagctgtttaaacacactaacagagaaatgaaaattaaaatgaacttgagataattaagtttttactcactgcactatcaaaaaaccaagggctatattaccaattgctggtggggaaataaagtgggtattaatataattgtttgtggaatcgtcatgtttatctttttagaaataaatctgacaacactttttttcattaaaaagcctatatcctgtacctcagcaactttactttgggaattctataagaacctagcctatggacatataagccctgatatgcaaagtatggctgcatgaattttggtatatacaatcctatccattaaatactaagcaatattttaaaggaattacttatataacagatacatagaatgacttgaggaaatttatgaaaaaaaatgcacgacaatggatttagttaagggcaaaaagaaaaacaaaaacaccatgttgttttagaatagtttgaagagaaactgaaattcatgggttaaaaactgtggatagggccacagggtgcagtggctcatgcctgtaatcccagcattctgggaggccgagacgggtggatcacctgaggtcaggagtttgagaccagcctgatcaacatggagaaaccacgtctgtactaaaaatacaaaaattagccaggtctgatggcgcaggcctgtaatcccagctacttgggaggctgaggcaggagaatcatttgaacccgggagggagaggttgcagtgagccaagatccaagatcacgccattgcactccaggctgggtaacgagcaaaactccatctcaaaacaaaacaaaacaaaacaaaatggtggataacaaaattcttcatcaaacataataaatgacacgaaaactacaaaccaagtccttaacaccccaactttttccagtttgatcacccatacaaacccatagccttacagctaagtgacagaaatcccagctccattatttagatctcatgccttctacctacaaagaataacaagatataatgatgtaaatcttgactgcatttatattatcactgtttaaacagactcagagtccatttcaatgtgtttaggaatttaggagaagagtttctccaggattttaaaaaaatgtagttaaatttggaagatgctggtatcagtattaaccagtaagctattattcgtgggaaacaaaaaatgaaaaaaaaaatagccctgttgaaaataaaattattctttaaaaacaacataaagggctgagggtcaatttaatcatacatttcattctaacaaaatgaaccactaggactgcttggagtggccatttacatcccaaacggaggtctctattttactctaggataatgccagttaaaacaattaaatccactgggcatggtggttcacacctgtaatcacagcaatttgggaggctgaggcaggcagatcacttgagatcaggagttcaagaccagcctggccaacatggtgaaaccctgtctctactaaaaatacaaaaattagccgggcgcagtggtgcgggcctgtagtcacagctactcaggaggctgaggcaggagaatcacttgaacctgggaggcagaagttgcagtgagccgagattgcaccactgcactccagcctaggcaacagagcacaactctgtttcaaaaaaaataaaaataaaaataaataaataaatcatttaaacaccatcacttattttagtctgagagtgagattagcaaaggagagggaagaaatctattaatacaacatgaatgaacacacaacaaagacaagtgtactgagtagtgacatagtttctaggtcctttaatacaccttctctgtttgggaaattcgcaacttcaggtctcagggatggactcaatgtagtcaataccagcacttctcaactgccttacttaactcagaccattaaaatgtataacctacctgaaactacggagccacagtctagaaactagttcctcagagatctgaatgttccagcaggcctctaatctacatagagcaatgtttctgttaattgggaagtgtaagaagcccatcccataagaaagtggtccactttggagcagttactaaacaccttttgttaagccactcattttaaactgtcttttaatttttctgaaaaatccacgcttgttagtcagaaagtacacggaaaaatacacatgtatccatttgtaatggttctcattacaaacattacattaggattggaactacatcaggcatattcatatctttaggtaattttgctactgacatgacttctgagcatttttatagtgccataaaaaaaaaaacactgtatgtttgtatccagttaaggagtagatgtttactgctggcttattaattttcagacattttttaaagacactcacagagaaagagtattcttattattgattgggaccacagatcttgataagaacgctgcacaaactcaagaccccaaccctcctctggtctgttacatccttgcattgcattttccataacaaacattgcccacagcagattcattaccatttaaataaccagaggagccctcctccgagtcttcaacatggaacaatggcaatggggggagggcagcagaggaactgcccttggtgggggcctgctcactgtctctgtgccatgcacctaccctacacgtgctaccaggtggcggtgcgcacagaggaaagagccgaggccttcaggtcagctgtgggaccttagaaaatggatttagtttccaggagccttattttcctcatatgtaaatcagggataataacaaccaccttgaaagactcaggacaattatatgagctaggtgtttccctgaatcacatatcacatgggcagaggtgagaagagctagaaatggtatgtgtcagtatgggcacgcagccctggcctctacacggagccattgcttccttgcagggcactgctctggtcatcacagcccacaccctgccatgccatctatctctccctctgctcagcaggccctatgtcccatcccagggacattggagaagaagcaaaggagtgttacaagttgccatttatatggtttgtatattgctctctgctcctccaacattctgaagaggggggactatttcattattcctggatctaatcactaagaacttgaggtaagggaaagaatgccaccctccccggggtaccacattcctttttgctgtgtccgataaagcaccaccacagtgaaaaagacaaccgtgactcaggtgtcattgagtctggctctgtcacccaggctggagtgcaatggcacaatctgggctcactgcaacctccgcctccagggttcaagcgattctcttgccttagcctcccaagtagctacgattacaggtacccatcatcacgcctggctaatttttgtatttttagtggagatggggtttcgccatgttggccaggctggtcttgaactcctgacctcaaacaatccacccaccttggcttcccaaagtgctgggattacaggcgtgagcctccgcacccggccagtgttctatcacacttctagcagtggctttcaatttcctcccctgacaacaaatctctagtactacttaggtactgagaatgatcatttcagtcccagagaacatcagaactcccaggcccatggccactacacggagcaagcatgaggctatggtggcccttgtgtcattggcgtccagaggaactgcaaatatcctccatgtgacagacacctgctcacctgtgaagacgtcagcatgttctgctccagaatcatcaagtcctcagttcatctctaggtttcaacaaacaatacatcttttctctggccctggctccaccacttactcatctttggactttgagaaagtcatctaatatttttgagccacactttcatcaaaggagaaagaaatccacatttctaaagggatattgtgagcacaaaacagatgcttatagaagcaccttagggaaagtttggttcgtaaacggtgatgttgtagatatcaccaattctgttgtgtcattagggaaagtttttcctgactctatcaaaatttccttgtacttccaatgagcactactgcaacatcttatgaagaatggatagcctaagttagccaagtcactataaactttcatttctcttttgttagatgaaccccaagaagtagatatagtcagtaccaagtgattggcatttgatctttggtgcagaaatctgaaatgcagtaagaaggcagaggccagttttgccagcaagagtccccattctaacaaggttagtgtggaatggaagaggatgggcaggttgggagcctttttcctggtgtccaccccttcatcatctgtcagatttccaaaaggaaagttctgtgttgttggctttttgcgtatctttctttaaatcgcataatctttaccactgaaaacaattcaagcatgagaacatgcacatcaatccagatcgtgctcattgcattattactgacctgcacagcagtcttgccacactcgcaggtccaccttcgggatctcgctgcagttcaggtaatcctgtgggtattctgcctttacaaagacatcagcctgcacttgctgaatgctgtcaccattgtcacaaagcacccggctcagggacgcctgcttcagctgagtgagttgtgccggggtaaatactccagggttttcataccagaacctggtagtcaaccaaaaaaaaaacattgtcgtgggtctgtggcctgagaactcagctgcatgtcaaacagccacaatgcaccaagaagagctcaacataaaagacgcatactgaaagaattatgcttgttctccaactgagtatccttttaattctctccaatatttacaacattcttaaatcacattcttctgaactatcactttctactcaagctctacaaaatgattcaaaggaaagttttctaaggttttcctccaaaaaagaaaagtccattattacatttttaaattttttttaatttttaattattttttgagacggagtctcattcactctgtagcccaggttggagtgcagtggcatgatctcagctcactgcaacctctacctcccgagttcacgcaactctcctgcctcagcctcccaagtagctgggattacaggctcctgtcaccatgcctgcctaatttttatatcgttactagagacggggattcgccatgttggccaggctagtcttgaactcctggcctcaagtgatctgcccacctcggcctcccaaactgttgggattacaggcgtgagccaccgcacctagccctattgttgcatttaaattccatgaactaaccttagaaactgtctgagcaatgtaacattaacacgtttgcctaaaaagaaaatagcacttttgataattaatatatactatttggttatatccatcaactaactagaataagcacattcaattttaaatgaaaggatacaatcaattttaaatgaaagaactattaaagtcaatctttgggtacattcagcaaagtcaatccttgggttcattcattcagtaaatatttgaatatcacatgccaagcacttttttgtgctgagtatagagcaggaaattaagatggtaggcaaaaagacttcttgccactatcttgatgttatggactgagctgtgtccccctaaaatgtatatgttgaagtcctatgccccagtaccttcgaaggtgactctatttggagacagggcctttacataggtatttaaggtaaaaatagatcacgtgtgtgagccctaacccagtatgtctggtgtccttataagaaaaggaaatgtggacatagataacagagggaagaccacgtgaagacacagggagaagatgccacatacaagccagaagagacgccccagtaggaatcaaccctgctgatgccttgatcagcatctaacctccagaattgtaagaataacaaatttctgttgtctaagctatccaagctatgggactttgttacaacagcctggtaaactaatatatatggggaagacagcttaacccccaaactgaaggtttttcaattattttcagtctttgactacatatatttttaaactattgccaattgagcacattaacccaattatgtgagtcaagaaattcagtgttaaaaatgattttaaaaaattaatgaaatatactattaattgttaccaatgtgcaataaagggaattaaatcctttgctactttctctataatttgtaaagggaagggatttaaagtaaagaataatttttattgtaactttaattaaaaactaagctctgggctttgtttcaagtcttatatacatcatctctgaaataatacaaaaggttatattgtcaaacagattcacaagattcctagatcttactcaacactaagcttcactaatgattcagaagataccatgccctggaacatacttgattccaagcaatagaagagcacatgtccactcaggagaggctgcttaggtttgtatttcttggtttttattcttggttagtcttggaacagtaaacagattacgtgactaacttacattctccagcctgctgtttcccattatttcatgattaaatttatttacaatgaacattttagacaaaccaagaaattttagagaagagttcccagttatctttccactcgtaaatgccctcataatgtaattttacaaggagatctggtctagggtcatcaggtcttcctccatgagaatgaagggagggaatctcaaggctgctaccagttccttccttctcaacatcattgaaggctgcagacgtcctatggaataggtacaattgttactcacactttacagatgaggaacctggttctgagtgatacatgtctaaagttaaacagctgtaagtggtgagactcagatttaagcacaacgtagtccatctagccttcatcctctcaatcgccaacttctattgccttttgagaaattctgtttcttctcttcttacaaagatttacaaaaataaatgttatctgataatattggtggttacaaaagttctgtcacctaatgctatctgatattcattatactcaatatgcattaaatcataaaaatatgaatcacaatgttaaacatatacattttgggtcaaaaacaacttttgtgatatttaataagtataacagataatcattcacctatctccatctcttagccgctgaaactgggtaacaaacaggcacataagtgttggtcccactcttgtaccaggaatcaggtcttcaaccataagggcgggccagaggtcaatgtcacctggagagccgtacaacctggaacagagacaggcagacagcgcacacctgagactgaaagtggaattgaaaatattccttatgtgaatgaccaccaagcattattttatccacacaaaaaaagaaaagtagatatgattactgtattctcatttcatgggggaaagcactcaaatgaaggaaccctcagggatcaccccataggcaggaggcagagtcataacctaaccaaggacatatgacaccaagcctcatgcaatgtcccctgtgcaattctttataattattctctaaacatatggagtataactgtatatatatatatatgcaagtgtgtgtgtgttatgtcatgtataaatgcaactagctaattccttcagaaatacatagaaaattaacaattcagcattgagaaatgtccacatcagtgtatatgctaggtatgctaaaaagtcaatagaaaatcataatttgcggagatgataagataaaaagtgttaggtaagttttctcttgataaaaaggcaataagtatttgacctaagatttgaagcaatttttaaaaacaacaaacaaacaaaaaagcacaatgcaaatgttgattataagccaacagccttggctcaccactcagagaaagaaaatatgtccatatgcttgacactcccagtaggagccactctgattgtttttttctctctactctaatgataaacgtgacaccaacttaacttgtcccttgttttattttgtttcatacatatgattctctaaactacaaatagtttagtttgcatgttttaaccttgtcacaaatggaaatatagtattcatacttcctttttctcactcaacagtttacttggcgatgcaattgtgtggttgcatatatttgtactttcttcattttctctgctgtatagtaaacagtctattattggaaaccattccaatttagtttagttacactggtgatgaatacttgtgaggttttcaacttttacactatgaacattctctacatgtttcttcatatgcacaagagtttctctagactaggcgtcagcaaatttttaccataaagggccagagagccagtattttcagctttgtgggacaactgtgggttctgttgcaactacccaactcctgttttgcataaaagcagccatagacaacatataaacaaacagacatagttgtgttccaataaaactttatttacaaaattagaaaagtaggtcagatttggccacttggctgtggtttgcagatccctgctctagattacgttgtgcaagagctagaattctgagggcagagtatagtatcttcaattttaatagttaatgccaaactgctatatgaaattgatgtatgattcatattcccataatgagtacacggaattactctatgatagatatccatatgtatatcttcaatgttaaaagacaatgccaaactgctatccaaaatggatgtacaattcatacatccacaagaagcatatcaaaattctcaatgtcacctggagagctgtacagcctggaacagacaggcatattattcctcgacacattgtaacttattccattttactttattttgttagtcaactctcatcactgctgcccttccccactttctccttcttggtttctgataatagatggactttttagatttccaagtgcctgcttgaatgtttgagtgctgtttaattctggtttgaatgttgtgttattgtttcctcctgtttcaattctttttctgagagatttttcctctgaaatgttttgatttgcatttctgttttcttgttacatagctttatttgaaatacatctctctctctctcttaattcctatgcatttcacgaaacgaatttctggttgggtagcatactcttctttcactacagggaagtgcagtctttttgatgtctgttctggtggtgatggggagaagtgagagttaacatgttttgcttctcttctctctctctctcttttttttttttatacggagtcttactctgtcccccaggctggagtgcagtggcaggatctcagttcactgcaagctccacctcccgggttcacgccattctcctgcctcagcctcccgagtagctgggactacaggcgcccgccacaatgcccggctaattttttgtatttttagtagagacggggtttcaccgtgttagccaggatggtctcgatctcctgacctcctgatccaccctcctcagcctcccaaagtgctgggttacaggcgtgagccaccgcgcccagccttgtttctctttaagtgctagagcatccttaatttcatttcattctgctttaatgtcaccatcaaatctgaagtggcactctaccctttacacacacacacacacacacacacacacacacacacacaaagccaaagccatttctggacactctcagatttgtaaatggtgttgataacttccaggtttccagaatttcacttgacaacttagtacttggtgctggagtttttccttctaggggatttttttttttctttttaagagacagggtctcactttctcgcccatgctggactgcagtggtgcaattgagaggtgacagcgtgctggcagccctggcagccctcactcgctgtcgcggcctcctcagcctcagtggccagaggccactctggccgtgcttgaggggcctttcagcccgccgccgcactgtgggaacccctctctgagctaaacgaggccggagccggctccctcagcttgcagggaggtgtggagggagaggtgcaggcaggaaccggggctgcacagggtgcttgcgggccagcgcgagttccgggtgggcgtgggctcagctggcacacactgagagcagctcgccggcaccacccgtcccaggcagtgaggggcttagcacctgggccagcagctgcggagggtgcaccgggtcccccagcagttctggctggccagcgctgcgctcgaattctcgtggggcctcagctgcctccctgcggggcagggctgaggacctgcagcccgccatgcctgagcctcccccacaccgcgggctcctgcgcagccccagcctcccggaggagcgccactgcctgctcctgctccacagcaccaggtcccatcaactgcccaagggctgaggagtgcaggagcagagcaggggactggcaggcagctccacctgcagccccgtgcggtatccactgggtgaagccagctgggctcctgagtctagtggggacttggagaacctttatgtctagctaagggattgtaaatacaccaattagcactctgtgtctagctcaaggtttgtaaatgcactaatcagcactctgtatctagctaatctggtggggcgttggagaacctttatgtctagctaagggattgtaaatacaccaatcagcactctgtgtctagctcaaggtctgtaaatgcaccaatcagcactctgtatctagctaatctggtggggacttggagaacctttatgtctagctaagggattgtaaatacaccaatcagcactctgtgtctagctcaaggtttgtaaatgcaccaatcagcaccctgtgtctagctcaaggtttgtaaatgcaccagtcactgctctgtctagctaatctagtgaggacttggagaacttttgtgcctagctcagggattgtaaactcaccaatcagcaccctgtcaaaacagaccaatcagctctctgtaaaatggaccaatcagcaggatgtgggtggggccagaaaagggtgaaaaagcaggctgccccagccagcagtggcaatcctctggggtaccattccactctgtggaagatttgttcttttgcgctttgcaataaatcttgctgctgctcactctttgggtgtgcactggctttatgagctgtaacactcactgtgaagatctgcaacttcactgctgaggccagcaagaccaggatcccactgggacaggacgggaggaacgaacaactccacacgtgcggccttaagagctgtaacactcactgcgaaggtctgcagcttcactcctgaagccagcaagactatgaacccaccagaaggaagaaactctgaacatgttcgaacatcagaaggaacaaactctggacacatcacctttaagaactgtaacactcacggcgagggtctgcgacttcattcttgaagtcagtgagaccaagaacccaccaattctggacacacaatcacagctcactgtagcttcaagctcctgggttcaagggctcctcttgccacagcgctaggactccccagccttttctgcattttttcttctgtccttcccatttttttgtccatggagatttttttaattagtttcccttctttttcccaatccacaaacttccagtgaacgtggagttccagtggcagctccgataacttgttattttcaaacttgccattgaaactcatgccattttctgtctctcactaattgaaggtatgagtcatgttattttgtgttctctttgttgatcttacagatttggagaaggctgtggtgagagatttagaagtaagggacaattattttcctagggctaacctgaaaatatgtctttttcaaaaaatttttggtaatctgaggggtgtgaaatggtgtttcattatgattctggatcttcctaattaattatacaattgaatatcttctacgtgttgattgaaaatttagtttttttcttactgaaatgtgtatttatactttttacccttttttaattgggtttttttttcttactgttaattatctatatattctgaatgctaatactgtgatctatgtcaaaatgtattccttgtatttgtggtgcttttaatcattctcattatgttagattctgatgaaaatattttcttaatcttaaggtcattttatcaatttttatatcaattttacaattttgtgtaccttactaaaaatttctttctttccccaatgccatagagatattctcttttattttttgtgaagttaaaattttgcctctcagatttaattcctatatctatctggaattgattttcatatatgatatgagatcagaatccatactcatttttaatccaagggtagccacttggtaccgcaccacttactgaatatgtcctcacttctcactaatgtttcttgcagctctttcaaataggatatttccatatatgagccctttttcttgtggctttctattctattctattgtcttaattactaaaagctttatatcagggtatccaatctcttggcttccctgggccacattgaaaaaagaagaagtgtcttgggccacacataaaatacactaacactaagaatagctgacgagctaaaaaaaaaaaaataacaaaaaaactcataatattttaagaaagtctatgaatttgtatgggaccacagtcaaagccatcctgggctgcgtgcctcccacaagctgcaggttggacaagtttgctttataggaagggttgctaactggaacatcaagccaccctaccatgttcctcttggccatcagctttaccagtttaattttaaaatcagctgttgatgccacaaagaagcactactaagctcttcattggcactacaataagtatatcatttgtgggaagtactgacctatcaatattactgaatctttctacacctgagaatgttcgttgtctccactctttaataactatctgtaagtcttctaattatcattacaacacaatgcacaacttgttagacttctttaccttttcttctctttggaagagcaatttttctttatattcattcccatttactacatagagtatttgcaaaaaaaagtaatatggcagttttatcctttctgatctttatctttttcttatgttattgtcttgattgtacttttcaatacaattttgaagttgctgccatttatgtctattcatgtttttaaatggaatgcttctaacaattaatgcttacagtgtatttttgagatgttctttatttagttaggatgtttcatttttcctagaattctaacagcctttcttaaattctagagaaatgttgcattttacatggaatgtttttttctgccaatactgaaataatcacctttttctttttaatcggcttatgtcctaaattatatcaacactttaaaaatcttggactaattatattactgaaacgaacctattatgatcatgttatatatgtatgtatatatggcattcaacttgagttttcaatgctttgtttataatttttatatacatttatatgagatgttgtcttgtaaatttccttgcctcgtactgttattgtttattttaatatcaaaatgttactggcctgagaaagtaagttagatagtgttccttcttttgcattccctaaatgactccatgggcctttggaaccacccaaattacatttataaacggaacactaggtttgattgaagagcatatgtcaaaactttttctgaaactcttctttcccacttaggtcttctagagtcttttgccaaagcattttgtttctctttattgttctgtgtcttatcctgtgtttccaataaaatgagtaaaaaaaaaaattttgtccaaggctacaccaacctccaaaataagtaaacaatattttgttaggtaagaactaaattttaattattgctatgagttgagttgtgttcccatgaaaagatattaacatggggaagtactgccccccagtatctgctaatatggtaatactatttggaggtaggatctttgctgatgtgatcaagttaagattaggtcattagggtggaccctgatccaatatgactggtgtctttatttatttatttatttatttatttatttatttatttatttatttttgagacagagtctcactctgtcgcccaggctagagtgcagtggtgcaatctcggctactgaaagctccacctcccgggttcatgccattctcctgtctcagcctcccgagtagctgggactataggcacccgtccccacgcccagctaattttttttttttgaccagaggcccaaaagatatgatttaataagaaaaatagaaacactaatgacaggttaactgctaaattatggctactgctgactttaactttcataacaatagtgaatttttttattattattatactttaagttttagggtacatgtgcaagaacgtgcaggtttgttacatatgtatacatgtgcagagacggggtttcaccatgttaacccaggatggtctcgatctcctgaccttgtgatctgcccgccttggcctcccaaagtgctgggattacgtgtgtgagccaccgctccgggccatggtgtccttatctttaaaagggcagtttgaacaaagaccgagagtgagaatgctgtcctacagcagaggcagggactgaggcactgcagctgcaagccagggaaaccaagggttgccgggaaaccaccagaaactaggaaaagcaaaggattctctcctccaaggtcctgaggaagcgtggccctgctgacaccttgattccagacttccagactccagaactgtgggatgataaacttctgatgtcttaagccacccagtgtgtggtctgttgttacaacagcctagaaaactaatataattatgaccttccattgactttatgctaaattcactcctaatttttaaaacagtttgcctgccaaaaatgagactattgtcctaaaccttacacctgcttatttttagtataatgtaattttaatgtatctttgaagagaccattcaattaattttttaataggcttgattttgtacagcagttttaggttcacagcaaaactgagtgaaaggtacagagacttatcatacacccctgcattacttctttaaaataagttaaaaaaaaagatatattgatctctgaatggttagaattaaattatgcagaatatgagaaataataataatggaaatcagaaagttacatagggtcagatttatgtctatgaactataagagtccagaaaaaaatagtacttagaagttttagaagttagaacattgaactttcccagagagtataatcctggctttgttaatttcagttcttcatcattgatctttttctcatgtcttaaataattcagctaaacattaactattcctatccttattgttccatattactttaccatggctcaccacagcagctccaagaaatgttgggagtcttcgtgcatatcctatataagtaacttattaatcatgtagagcctatgtttggaaaaataaatcctctccactttccttagagggaagtctgagatccataagctctcaaaacatttcttattaattcatctgcattactctggagaatgtcaattctattttttttaactttttcaatcgtagacattgtagctcttcttttgtggttataattggtcattagtaagattataaagcagcttctgtattaatagctttggtatgtcatttcacttgtcaactttcgcccccaaaccatttgttccatatcttaaaatgataatccaatacaaagcggcatggttttatgacagcaaagacatctgtaatctgagatggcatccgagggcattgtccctgaaagtgagaatgacaatacacaccaagcccctttctgttgtgtgcagcagcaaatacaaagggcgctggtaactttggccagaattcccctaaatgcagacaacatgagagagtaccgcccaaagcagggctgcaaactgccatcataaaatctcctggctttgttaatgtaccatctaactgtgtttaaatttaccttttaaccttttccatgattgcaaaccaaaaacacacatggaataataagagtaaacagtctagctatattttaaaaaaagtggtgcttttgtcggtattttgatatacagagagttgaaagaaaagatttgcagaccttgaaatgaactatttcttgccacagagaccacagtgtcaagccatatctaatttcataatgacagtttgacttaaagttggctttagaaggaaggataataataataacaactttcattcagctggatcattcacagagacacaagggcagaggtcctgtatggaatcttttcagggttatacatgctcacctgattgagagagtgcaagatagatatgcagcaatgtatggtgttaatgaaacaaataaaaatccttccccaaaacacaaaggaaaggtgctttgtgataaagtgtccttgtggaaaagctttctgagagacatctggattttcagagcaaatatgatcatttagtagcttttagagaaaaaatatatttgaaacatgtcctttggcaaaaaaggcaaaatgcccttgtgtactctcacacagaacaaaatttcctctgcctcaggatgactgcatcaatttaagggaagtaaatgacattttacatcagagaaattaaaacaatgaaaacatcctaccccactagcatgattagtcagatcagacacatggtacaaaataatcttatggttaccagcactgaaataaaggtgaatgacaaaaaaaaaaaatcttatggttaatttgtcattaacaacaccagacagaaaaattgtttctttacttgaaagaaaattttcccagaatactttttattaaaagctatctcgggactctagatatctaatttcctcaaaaatcttaaggacatcacatttttgtaaaaataaattcttctacaattaaaaagtatgcattttagaaaactatatataaagctctatgttaacaaacatctctgtaacagaaatagcacagaaaagtaaacaaatgggaaaaataactcaagcgacttttgtttttaaacaagtatataatactattcattttttgcttttatgggaggaggaacttttctttctactactactttaaaggaggaaaataatctaagctatttatataagattttacatagaactaaaatgtgatagtcatcaaattttcaaaagcagagtacagaatatagaactctgtaattatgtctagtaataaaaataatcatctatactttgttttttgattagaggaaaaaggaaagaagggatataaatataaggaaaaaattaagaaacagaataaaatcaaagaaggcagagacatcaacaataagacagagataagtccaggcagtcattgagactgagatagacttccacataagaaaagagacaggtccatatccaataaaaattcacatgtattgaacaatagcatgtttgaacaatacttacagcatgacagctattaacaattatatcattttttaactccagtggagaaatttgctttctccactggttacatacagtaaccctttgaaatcctgggcctgagacatattccccttttatttaaaagattgactaaataaacatcaagtgttaaagacacacagtctccaggtgagactccctacatcataaccacagaagcagaaaaatagctaaaaaggaaaaaaaaaaaacactttccactgtgtaggacaatgtcattaaatgttatgtttacacactacataagattagttagcatacattctggggtaagtaatctacagtaataaatcatgcttttaatttctgattgagaaattaaagattaactttccattcaatccacatattcctaaggattccctgagttttctagccaccaatctagactaaaaaacgactaattaacagcccctgatttaaagagcataggccagtcagaaggcataaacagatatttaaaacataaactacgtttttataccatgtgatatggtttggctgtgtccttgcccaaatctcatcttgaattgtagctcccataattcccatgtgttgtggaggggatctggtggaagataactgaatcatagggtggtttccccatactgttctcctggtactgagtaagtctcacaagagctaatggttttataaggggtttctcctttcacttggctctcattctctcttgcctgccaccaggtaagacatgcctttcaccttccaccatgattgtgaggcctcccagccgagtggaactgtaagttcattaaacctctttttctttataaattacccaatctccagtatgtgtttatcaagcagcatgaaaatggactaatagaccatggtattgatataaaagcagataacgaataaaagaatagctctccattggtggaattcaagacatttaacagaaatgttgggtgattcattcttttttttttttgacataagactcttgctctgtcacccaggctagagtgcagtggcgtgatctcagctcaccacaacctctgcctcccaggttcaagcaattcttctgcctcagcctccggagtagctgggactacaggcacgtgccaccatgcccggctaatttttgtatttttagtagagatggggtttcaccatatcggccaggctggtctcgaactcctgacctcgtgatccgcctgcctcggcctcccaaagtgctgggattacaggcgtgagccactgtgcccggccaggtgatttattctaagcttcagaaatcacacccctatgtcatgatactggcagtagtaagatagatagatgactgatagaaaaagagataaagatagatacagagagatgacagagaattagaagcaagtgatagatgactgataaagagaggtagagatgatatagatagataagagataaagagagataatagaaatagataatatatatataggtagttaagtggataaatagatgatagatggaaacgtcgtctctactaaaaatacaaaaattagccaagcatggtggcacgcacctgtagtcccagctactagggaggctgaggcagaaaaattgcttgaacccaggaggtggaggttgtagtgagccaagatagcaccactgcactccagcctgagtgacagatgacagagcaagacttcatcttgaaaaaaaaaaaaagaaagagtcttttctacatgtcagccaagtgacaagcattttatttctattattctatttaatcaactgtatacacttgatttataaatttcatttatgtcctcaaaactgcaaaactattttggcttgatgctctgactttttttccagtcttatgaagtccattacgatgtgagagcttctccactcaaatctgatttcccactgttctactctttcacagtcagagatgaactaagcttatccttcattcagcaaaggaagcctatagttaagacctcctcaactgtccacaacaaaccatgccactgcatagatctcataattaccacccactcttacaattctcccttttagacaacattctaaactgatgaaaattatgcagttataaaaatgagcagtcttcatttcgtttctccagctcataagtcccaatagggcctgctgcactgaaatttaaaagcaatgttaactatggtaatagagccatgttttgtttccaggtgggcatgctccagtgaggggctataaggaggtctcattttgtatgccaggtcccatcaagtagagtaactgctggctgtcatgagagccatgtctagaagaagtcagagattgcctctatgttcggtaggaaaaaatcctgagagagtttagtagtgtttgtcacagatgcagtaggggagactggtctcacaattgctagatttttgccggttctaagccagtgagtgcttcatcattcactacagtatcagttgcataccttttattaaggaaataggtggaataaagtagatataatacatatttatgaattaacgtaattactaattgaatgaatacatgaatattacggtaaaaagatgtttctatttcaaaaccgctaaaaatgtttttgttgtttttattttcaccttaaatatgttttcaagttttaccaaatgtcattttggtatactctgagatgactgaatgggttttataactgtatattctaatataatgccctatattgatactaactcagttttatattctggacttatattaattattcctccttaatcatgttgcactattcttaaactattcatgatttgactgacaagcattttttaatgttattccctgtaaaaaatgacttcagggttaacattacagatcctttcttaaggtttataccagaggcatgctaatttcagctaataaatcaagtaggttatcatctttttatatattccataatactgtataatgtgctctttaaaatttgaaatattttgtctagctagaactcagaaactattaaaagtaatttttcaatgatttcaaattgatgtaggctctgttttgatattggctttcttattattcgaagaccaaatagaaaattattcaattactattattttcaagctatctttataaaaacacaaacagtaacttcttagaaatctggtttttttatgtttttgtaacttaactttcagtttgggaatatattaatcagtctttttttcaactttttactttattaactttcgcttttctatttattctttccaacttgagttagacacttaatgtaagtgaaaaatatctgctatgctcatcctgtgagatttttggttgttgattaccataatctcgcatatctagactgatacaggtttcaaatacatacattctacttcctaagtgagatgttctgcagatgagtacattggtactggttctgttcattaaatgtgaggactcaagtctttcttcaattttataactcttctattgctaacccttcaaactgggtctctctctctcattcctgttttctacctcttggaacttctataaatatttgatgttttcaatcttttctccctatctctaaatctcccttattatttattattctcatctgtctgtactacacactgagtgaattcttcagatttatcttccagttcactatttttttaattcagctatttctagtatgctgtttcactagctactgagatcttaatttaaattatatatatcatgtcttgaaattcagtttttcaaatacctgtatttttaccttttccttttaacatggtttctattcattctcttacttaatttaatgttaaatgcacagagtctctcctattgttttaatctccctaagttccattttaattttgttttgttttgttgcttttcatttattctcattgctgactatcttgcagctacatatttgctgaaatgaattttaacttgcatgtgtgagaaggagagaacttcttgggagtttggtttgtcattcccgtgattgtctgtatgcaccaggtcgtaaaagaatgcctagagagtgatttgacatgtgcttgtgcgaggatttcaggggtttcatgtgcccctgggctgtttttcatgttaatttatcttcttttctttccagcaccatgatgtttgagtaaattcagattcttttcctgtgtaacacaggctgggattcgaatttcaaaaattttcctgtttcatttcagcctcggtccctgatgtttacttgagaaaccatattgctgcttcctctttcctgatgggaaggcattttctagttcccttcatccttgcagagatgaggcaggatttcaggctttctgcagagaactctgtttcaggcctctgactaggtggattctgtatccccttaccctgtgtgggtactaaaacctcaacttctgatccctcagagcaatgtctatgactgataatcatgggccaagaaagcacattcattcctgatttctccctggcttttaagtttccttgtcctttgtgacatataagaattgcccatttgtttgagcttctttatgtttaaagccattctttatagttttactttttgttcaatggttctatgtattttttagcaaaaaggaagctcattttactgaacttattatttgccaagaaattctcaaactgccagtgaaaagaggctattagtcaaatgccttataaaacacatcattctctgtttaaagtagcttttatgtcacatttccccataatggaacaggcaagaaaaacaaagaaaaggttttaatattatatatagcacaaatgtttatatattttaattcattttcaattattatttcaggtaattaaaaatacaaaataagctaatgacttcactggctatggaagccatgccccccccaccaaaaaaaaattccattctagctaaaaaatgttatgaagtaccaatcattgttaatgagaaaatgaggatataggccaaactatccaaatgttgcaaagaacatctggcattatgcaaaatgaaagtaaatgttgactcaattcactctttaaaaacattctaaactgattcaaactagtttttgtctgccttaggctcataagtatttgcaaaggagaatattttagagccatttaaaagcattcagtaagtttcctgtggcaaccaatgaataatatgcccagggaagtggaaactcagatagatcatgcaatttgcctaagatcacaaagttaattactaggaacccaaaaaagcacctaggtagtattttcagcacattttctgaaattctccgccttctccatattaattctggatgaaataagtacaaatattaattcataaatatctttattataatttataaagcctttaaaatattttctgggtattctataaatttgcatgataacagttatggctctcttcacacaaaaacataaagcacattgactgctttcctcatttctagccaagaagtgatgtggattcaggttctctgaggatcgctatttgtttaatgaggtgacaagccgacctcactaaatggcataaagcacagattttcttttttttttattttattattattatactttaagttttagggtacatgtgcacaatgtgcaggttagttacatatgtatacatgtgccatgctggtgtgctgcacccattaactcgtcatttagcattaggtatatgtcctaatgctatccctcccccctcctccgaccccacaacagtccccagagtgtgatgttccccttcctgtgtccatgtgttctcactgttcaattcccacctatgagtgagaacatgcggtgtttggttttttgtccttgcgatagtttactgagaatgatgatttccaatttcatccatgtccttacaaaggacatgaactcatcatttgttatggctgcatagtattccatggtgtatatgtgccacattttcttaatccagtctatgttggacatttgggttggttccaagtctttgatattgtgaatagtgccgcaataaacatatgtgtgcgtgtgtctttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgatcgtcattctaactggtgtgagatggtatctcattgtggttttgatttgcatttctctgatggcaagtgatggtgagcattttttcatgtgttttttggctacataaatgtcttcttttgagaagtgtctgttcgtgtccttcacccactttttgatggggttgtttgtttttttcttgtaaatttgagttcattgtagattctggatattggccctctgtcagatgagcaggttgcgaaaattttctcccattttgtatgttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctaggatttttatggttttaggtctaatgtttaagtctttaatccatcttgaattaatttttgtataaggtgtaaggaagggatccactttcagctttctacatatgactagccagttttcccagcaccatttatgaaatagggaatcctttccccattgcttgtttttctcaggcttgtcaaagatcagatagttgtagatatgtgacgttatttctaagggctctgttctgttccattgatctatatctctgttttggtaccagtaccatgctgttttggttactgtggccttgtagtatagtttgaagtcaggtagtgtgatgcctccagctttgttcttttggcttaggattgacttggtgatgtgggctcttttttggttccatatgaactttaaaatagttttttccacttctgtgaagaaagtcattggtagcttgatggggatggcgttgaatctataaattaccttgagcagtatggccattttcacgatattgattcttcctatccatgagcatggaatgttcttccatttctttgtatcctcttttatttcattgagcagtggtttatagttctccttgaagaggtccttcacgtcccttgtaagttggatttctaggtattttattctctttgaagcaattgtgaatgggagttcactcatgatttggctctctgtttgtctgttattggtgtacaagaatgtttgtgatttttgtacattgattttgtatcctgagacttcactgaagttgcttatcagcttaaggatattttgggctgagacaatggggttttctagatatacaatcatgtcatctgcaaacaggaacaatttgacttcctcttttcctaattgaataccctttatttccttctcctgcctaattgccctggccagaacttccaacactatgttgaataggagtggtgagagagggcatacctgtcttgaaagcacagattttcaacagcaacagtggtgccatttctattgtgaggttaggagaaattgattggcataaaaattaatatcaaaattcctcaattttaatgtaaagagaagattagagagtacactattgggagtagtctcacttacagccatttgaaaatatatttcctgagcaaaagaaaatactgagttacatgtcactgaccatgaattttacttaatttaaagccagtctcctgtgttttcattctgaagtatacattttatgtgaatgtcatgccgctctgaaatgaaaaggaaagaattgctacctatagaaagacaggtttccacctttacttagagaatgttttttctttaattttcctgaattttaatttcctaaatttccataattggagaccaatgcagattcacttacacatggcactcagatgtgtgcatagacttagcatccaggcagtctgctaagttcttgacatactttaaattatttcatcttctcagtaaactgatgagacacatacaatgatcgtcatattcgggatgagaagtatgagactaagaacaagtacaaaaggctccacagtgagaaggaaatgaagagagcacgtgtaacaccatggtctgacatcagagcctttattgctgtattgccaagtgctgggttatgctgtttctcatagtctccttctatgctaaagctgaagcaaaacagaaaataaaaacaaacattggcagttgcgtaatagcagtgcaccacccttcaaagatgtccatggcctaatctttggaacctgtgaatatgtcaccttacgtggcaaaagagattttgccaatgtgattcaccaaaggatatcaagaggggaagaccattgtgcattatctgggtgggcccaatgtaatcacaagagttcttaaaagtggaaaagggaataggagagtgaaaagaaggggccccagcgaaggagtgtgggcagcctctagaagggggaaagacagggaaacaaatcatcccatgaagcctcctgaaagggcacagccctgattttagcccagcaagaccaatttccgactcctgacctctgaagtacaagacattaaatctgtctttttttaaggcatctattttatggtaattcattacagcagtcgcaggaaataatatagtggctaaaagcatcaactttggaatcatatagattcagattaaaacctgcattctccagttgacaactccgtgtccttgggaaagttaacaccagctcatgagataacaaaagtgttaatgaaaagtgtgaatgtgcccagggcatatacagaagagatttgcctcaaactattctatatatgttggagcatgaataattattttaaaaaatagcacttcatgtaataaattgtcttacagaatgagaggtgatatatgtcacaaaacactcctttttgtgcaacaaacgccagccaaatatgaaggaaatattattactattagagtaaagctatcccatccataaaacctaagaggttaacaagaaaaatatggcttccatttggggacttttttgatttgactgtctcatattgaggtgagaaaattataactctgaagaggaacagtatcattcctaagtcctgagacatattagaaaaactcatcaaagaatatccttcttcaatcgtgctttgattctgtaacagtaggcatcggcaaactattcttaaagggtggctagtatacccttggacttttcaagccatacaatctttgttccaactattccactctgccaggtagtgggacatagggaatgttaagtaaatgtgtctgactatgtaacaaactattcataagaacaacggccagcctgcatgctgtggtttgccaaaccctgtgttaaagtggcatcttgacctgaaggatgttcactctaactagcattcatagtgccctcttttattctcaaaaatgccctggggtacatagcgctggtcctgtggccacataggcctagaagtctctgctctgcccaggatccaacaaaggcacttgattgtggaatacaaggtgtatttattcaccttggaagaccccaagtgtagatagggactgtcctagacatgtggtacaatggtcatcccacatctgcctcacatttcacaaagatgagcacattcagcaaccccatgagatataacctgctcaaaggaagggaaaggatgtgtcatgggtctgtatttgctgagtaactacccagaggcagagttcccaggaagcaagtgaagatgactctgcagagccctaaccacaagggccactcccaagaccctagagagggcctgcagggtattcacacagtcacaagtgtgcataaagtgtgtgtgcatataagcatcaggccctccttgactttgtagacactattccagatgctgggtgaacacactcaacaaaagagctctcagaggactgggatggggctcaaccaattcagaactatcacctgctcactcaccctccagaaatcatcgatgcaggtatggtgttcaattcacttgtgctgcctctccctcaaattctggtttataacagtgacttaataaatgtctgtgaaatgtagatatcaatgcattcaatgcaagagaagaggtaagtcattctaaaagaaaatatttttaaaaaatggtttagggagttaaagagattagaaaaaagggaattcaaattatgagacaaaagaaacaaccaatattttttaagtatatattgaattgaaaaataaagggtgaagctgtgaaagagaggatctagaaagattaaaagatgatataatttggtttcaaagaggatacgaaatgttatagaggaactgaaaaagcagtagaagactggacactgagaagagatacatagaaaaacaggaaataaatggctatgttccttcttgcttgcttgcttttgttttggcagaggataaaagagctttccaaaactttaaaaaatctattactgcctaatgagacccatacttaactccaatttactctcagggcagttagcccaccacccccaactctgccagcagaactccactgagtaatgggactgtcacaggacaatcccacagctccccactgctcctttcttgtttttctaaaggaagattatctaagattatagctaatttatgactacttacacctctcttgctacaggtactgacactaatggatcttagctgcacttggctgagaaataaatcggttctatagatcggcaataaacacagctacagcagggaacgcagcttcagcagtccacctatgcctgcgagaagaaagggatgggctagacggggaatgggaatttgactgcagattcatgtgtgtatgatgtgtgatttggatggatggctaaactgagttttttctctttccacacgccaacgccagatacctggttgcaggcctctggctgcaggaaccatatgtgctgctggatggggtagtgcagcacagggacgtgggaagacccactgtccccagaggccttcccgaccagagtgcagagcgcctgtgtctccacatgactcagcaatgactgtggcctgagaatgcctggctgcacagaaacatcaatctgggatttaaaaataaacaggctgggtgcagtggctcatgcctgtaatcccagcactttgggaggccaaggcaggtggatcacctgaggtcgggagttccagaccagcctgaccaacatggagaaactccatctctactaaaaatacaaaaattagccgggcatagtggtgcatgcctgtaatcccagatactcgggaggctgagggcaggagaaacgcttgaacgtgggaggcaaaggttgaggtgagctgagattgcaccattgcattccagcctgggcaacaagaatgaaactccgtctcaaaaataacggtaataataataataataaacaaataaaccattcatactgtagtccagatattctttccaatcagccctgctacaagatcttgtgttggaagcaattttcaagcttttcctcatggaaggaaaaaaggacttacttatatttttagcctctaaacagtcactttgcacttgaaacctgtaaacttatttgctatactttatttttgaatattttgatggctgtctctgccatagccactcaactgtggtcttcacacgtctgtcataaatgaacccatatatacattaggtctgatacaaaaccaaaatatgttattaagggtttgggcagatatataaaaagttgaacacattttagtttactgctgttcttaaagtgattaccaactgcggaccattcttgtacttatgaaataaaatataagcatgcctgctaacaattccaattttagtaccttagctagaaatgggttttgaatcagttctaatgtttatattcatgttacaattatgaccaaattatactattacttttaaagattttggaactgttgtttaaatttctggtttgctatttaggtatgttaaaaatgcaaattgtttacatagttcaaatccctaatctaaggccacaggaaatataatacctcaaaaacaaaaaactaaaccaacaaaacttatgagatccatccattaatccttctgcttgtttaacaaatactaagaatcaggcattgttagacatttaaggagataagccatactcctccagaatgttcacattttaatatggaggttgcacacataaatagttgcaatgtactgtaagtattttaatattaataagtgcaaagtcctgcaatattactaaagaaaaaatagctctgcaggggtaacaatattaggtgccatagaaaagaagaaatgcattgcaggaggacataaagagagctgctgtgaacactcaggtctaagtagggagaggcctttttttttattattatactttaagttctagggtacatgtgcacaacgtgcatgtttgttacatatgtatacatgtgccatgttggtgtgctgcacccattaactcgtcttttagcattacatatatctcctaatgctatccctcccccctccacccaccccacaacaggccccggtgtgaagacacatagttaattatggtaaaaatctttcatttaaacaattgctcaggagctaaaattgtaggggaaaaatataatttagaatgaatgtaagcttctgtttctggctatggtgtgatggaaaggagactagttttcccattataaacaatcacaaaagaggacaacatgtgtgagcccacagcttccaaacactggacaacaagcagcctaagactggggagcctgagaagagggaaactcatgacagtggcctcagtttcccttcgggagaaatctcgcccacactgcacagggcactagaatcccagcacagcaaggtgcagctgcactcgaggctgccatcccagttccggaaagctgaagcagctgggaacaggtggcgggacctgcggtggggagtgggcagacatttaccttggggccccccacagtcctggggatggctggctgacacctgagcaagaggaactgcatgaggtatacacagggcaactgctgcaggaagttgaatcagaacacggtgatggctgtaacacctcagtaatacccagagagcagccagacagcagcttgccaagtcttaacagaataacttctatccttataaggataaactctactcaacagagctgaaaaccaagccctgccaagattagcatggccaacagcatttggaagttcagccaccccacatcagcggagcttaggcaacattcctggggtttctacattcccacccaaatgaagcataaagcaaaacctatgcaaatgcaaggcggaatcacagtaattgatatgcatttagaaattacgagacagagaaggaagcaaaattggaattcacacttaggaaagtaatgaacccctgaatgatggctgtgatgtttaatttatcagaaaaggacattaaagccactattatacatgtatttaacaaattaaagaaggtatgctcttattgaattaacatttaaacaaatgtagaaagaaaattaagaatcataaaaatgtaaattctagaactagtacaataatcaaaatgaaaatttcacttgatatatataagaggagattgaagatgacagtagaaagtctgtgaactagcaagaaaaatcaatagaatatttccaaccagaagaacagacaggagaaaaaaattaagcaaatataaagtcttctacactgccagtgggagtgaataatattacaaccactttgggtaacaatttggcagtttcttataaagttaaatacagagttactaagtgacctagaaattatactgttaggttttttattcaagaaaaatggaatcataggcccacaaaaagacgtgcatgtaagagttcatcgcagttattcagaagagataaatacgggaaacaacccaaatggctgcttcaaatggaagagtaaacaaatatttgtatattcatacaaacaataccactcacaatgaacaaaatatatgatctacaggtgcacttcacaatataggtgaactccaaaaacattccaagcaaaataagcttaaaacaatacatacggtgtgattcaatttatgtgaagttctagaagagacaaaatgaatgtacagtgagaggaatccaatatgtggttgctgggaagggtctggaagagaagacagactgcaaagaccatgagctatgcttctggaatgatgacaatgctctttgtcttcactggggtaatgattacagaggtatgaatattgttcaaaggcatcaaattgtacacttaaaatgtgtgcattgtaccacatgccacttttgatacatgatgttaactgaaaatttagtttagtttagtcagattttggggatttaaagacgaaatgcattaaattgcattcagatgtatactctggtggtaaaatagaatttagaagtgaaataaagcataaagttttctataaaatatttgctatgattttgtatggcatataatgaggaacaactgaatgtctttatttctgtaagtgttagattttgataatataatggtaaagatttcttcagttgaatatttataattgtaaaataatctatcatagtactaaacaattttcaaaggcaggaataaaaagcagattctaaaagtgaagaatttacatacaggttgtgagtatcccttatccagcttgggatcagcaatgtttcagatttagaatcttttcagatttgggaatacatgcacatacataatgagatatcatgggaatggaacccaactctaaacaccaaattcatttatgtttcacacacaccttaaaagatatattgcagctgaagggggctgtggaagtcttttttcccttgaggatgcttttgtgcacctgttttaactgaaactggtcacatgagttcaggatggaattttccacttgtggcatcatgatagtactaaaaaattttggatttttgatttttgagcatttcaggaattttgaatttttggattggtgatgctcaacctgtttataacttctaaaacgcgttactaagactcaccactgtctacacaactgatgttaaattaatgtcatactttaaggcgttaaattattttgcactctgtttttgctagacaaatagagctgcacgccttctaagaaatggaccttggaggataattgactgaccaccttatttttaatatggccttgtcactttttatttgctcaggcatgtgtgtcttctgtgttgcaggtctatagtgttgacagaatgagttttgattggttaagtgtgtgcatttttaactttttgaaattggggttaaggtcatgtaagaatcaaatgtgttgttctctgttgtaacttctcattcctttgtacaaaagattataatacatcatagttcattgatgccactcaatagttgatgaaaaaataaattggtaggaataagtgtaaaaatctagttttcacctaagaaaatttgtcttgtcaaaggtgttcaagcaaagaataattttcaaatcaaagcctcttggaaaattaaaatgagtctcacccaagcatgtcccacttcccctaatgaaatatctagagagcagctgctttgtgctaggccctggactgaactctggggattcaaagataaattagacaatttatttgcaaccaaggagtacatactcttggaacctgtcattcaactaatatgttctctagaaaagcagaaatactgtgcaatgaaaatgaccaggggtagcaaggctctaaaactggcatttagagtcaaacaacaggacttggtctaattgtacaatacccttataaaagtattgtttagaaaaaaaatgtgatactcaaaacccttgtgctagctttaccataaaagactatgtaaacctgggagctaggagagagccttcatcagtgcaccatatgcataagtaaggagataggagatctgagggagaagggaataaaacgctgaacagaaagcagcagagactagagatgaagacaagacgctggtcctccagaggcccagctatgtttgagcagctcagtacccttctgtgacgtaaagaacaaagtcactgcctccaaatgggataggagaaaaggactggtccttgactaagagcgcatggtagtcacaaatctgggggctgctttttggccaagagagcagccatttgaaggcatatgggagagaagcacccttttcctatgtctgagatgccagcgaggaagagacactacatcagtgaaggaatagggggcacccaggaatctgtgagtcttctgaaaatacacacagatttgggtctatttttctctctttgctgtatcttcctgcaaaaggaggttcatagattctactagatttgggaaatggtcttacatgaaatggtcaacaatcactgttttacagcaattaaagttgctcctgggcctactaaacactcaggaaaggtgacggggtggtgtcgatgcaaggtctttaaaggctgacatgaatatgaaagttgataaatatttagcagaggaatgacagctgaacatgcagaagaaggaaaagccaagcccacaggaaaggggcaaccttttcgggcaaaggaagacaaagacagagaatgcaagtttttgggaaggaatcatgcggtttgatctcctgaaacccaagagtagaaagaggaaagaaattaagaattttttgttaatttgtctatttttaatatagagtgaagctatcataaaataggtacatatactgaatacaagttacttaattggtgaaatatgagctattcttttaaggagcggaggcagggctgggcacgatggctcacatctgtaatcccagtactttgggaggctgaagcagatcacatgtggtcaggagtttgagaccggcctggctaacatggtgagacccaatctctaccaaatatacaaccaggcatggtggcatgcacctgtaatcccagctactcgggaggctgaggcaggagaatcacttgaatcttggaggtggacgctgcagcaagccgagatcgcaccactgcactccagcgtgggtgacagagaaagactccgtctcaaaataaataaataaataaagccgaggcagttacacatccctgtgattatgagtgacaaataaacttatacttactcaaaaccaaaagtaaccgtatccacaaaaaattacacacagtattatattttcaaaagaggattcaaaaatagctttcaaaatggcccatggcctctctggaaatttatgttcaccattcagtgaataactgatcttcaccttctgctcattaaatgttttagaaacaataaaaagaaacagagtggccaggcgtggtgtaatcacgcctgtaatcccagcactttgggaggctgaggcgggtggatcacgaggtcaggagatcgagaccatcctggctaacatggtaaaaccccgtctctactaaaaatacacacacacacacacacacacacacacacacaaaattagccgggcgaggtggccggcgcctatagtcccagctactggggaggctgaggcaggagaatggcgtgaacccgggaggtggagcttgcagtaagctgagatcgccactgcacttcagcctaggcgatagagccaaactccctctccaaaaaaaaaaaaaaagaaaaagaaaaagaaaaaaaaagaaacagtgtgattcttgagagcaagaataatcttataaaaagaaaataattcattttcatatgatcctggaataaaataagctctttaaaaaataataaaacacttttgaccaagaaaaaaatgaaaaaaagatttcctgagctcttggtactgaaggaggcaggatatttgtacatgtcacaaatccttctggcaaatgctgtggtctgtggatctgacagcagtgaactctgaggagtagatgccaaggaaccacacccagcccccacccacctctcccggaactcctctgctgtcctcccctctaaggggcagtgttccatgtacaattccacttagaaaaaagtgtcagcttccctggcgcatcttaatgttttgggggtgagatgagtccgatgctaattctaggattggactccttggtgcagcaagacccatggctttacacgtctcacacatatcacacgggccctggtgccagtctttaccctacttctcatgtatctcaaatgtccttcttggcactcacagccaggtctttcacagacagctgccatctgctttaggattgggtttccgcaccgctatgatctaaatgtgtctacccaaaattcaaatgtggaagcttcatctccgatgttatggtattaataagcggggccttaggtggtgattaggtcatgatgtgttcggaattggtgaggtctcggtctcactgacttcaagaatgaacttgcggaccctcacggtgagtgttacaggtcttaaaggtggtgtgtccggagtttgttccttctgatgttcggacgtgttcagagtttcttccttctggtgggttcgtggtctcactggcttcaagagtgaaattgcagaccttcgcagtgagtgttacagctcttaaggccacatgtctggagttactagatcctcctgtctgggcttgttcattcttcctggtgggttcatggtctcgctggcctcaggaatgaagctgcatacccttggggtgagtgtttcagctcataaaggcagtgtgaacccaaagagtaagcagcagcaatatttatcgcaaagagcgaaagaacaaagcttccacactgtcgaaagagaccggagtggattgccactgttggctcaggcagcctgcttttattcccttatctggctccacccacatcctgctgattggtccattttacagagagctgattggtctggtttgacagggtgctgattggtgtgtttacaatccctgagctagacacagagtcctgattggtgcatttataatcccctagctagacataaaagttctccaagtccccaccagattagccacatacagagtgctgattggtgcatttacaaaccttgagctagacacagagtgctgattggtgtgtttacaatcccatagctagacataaaggttctccaagtccccaccagattagccaggtacagagtgctaattggtgcattcacaaaccttgcgctagacacagggtgctgattggtgcatttacaaaccttgagctagacacagagtgctgattggtgtatctacaatcccttagctagacataaaggtcctccaagtccccactagactcaggagcccagctggcttcacccagtggatcctgcaccagggtggcaggcagagctgcccaccagtcccacgcagtgcgccggcactcctcagcccttgggcggtcgatgggactgggtgccccagagcaggggacggtgatcgtcagggaggctcgggctgcacaggagcccacggcaagggttgggggaggctcgggcatggtgggctgcaggtccgagtcctgccccgcagggaggcagctgaggccctgggagaattcgagctcagcaccgggacccagcgcaccctccgcagctgctggcccgggtgctaagcccctcactgcctggggccggcagccccggccagccactgggagtgcggggcccactgagcccacgcccacccagaactggcgctggcccgcccgcgcctctccttccacacctcctggcaagcagagggagccggcttccgcctgggccagcccagaaaggggctcccacagtgcaaccgcggggtgaagggctcctcaacagcggcctgagtgggtaccgaggccgaggaggtgcccagagcgagggattgctgcgagggctgccagcatgccgtcacctctcaatgagggtgaagtcctcattaaagttattaatgaattataaaagaggcttcacacgacatttgctccttttgtcttccctccacttggccatgtgaggatgcggggctcaagatacatcttagaggcagagacaagggcctccacccagtggactgaagtgatttaaaaacaaagtcctaaaaccacacttgtaaattaatacaaaaaggaaaagaagtaataagataaagaaatactttgtaaattaaactacttaaagctatatcatcttcagcagctcctgagaaattgcaatctacatatttgagaactgaccgtaaaaaccattttattttgcactcatagttgaatgagtatatgtttcatattttacaaatttgccgttaatgaaaggggaaagtcaggcatctgtgacagcctaagcaaaaagcatctggcttctactgacttctggcaacccacccatgccagtcagcaatgctctctcctcctctggctgatgccaagcaccaggctgcatagagttccactagttcaaacattctcccaggcaaggataatgactcaatgtttaggctgcacagactcttggggccaatatcccataggcatgaaaggaacaaatagaaaggctactgagtgaatgctcaatgaagtctccccagctgctgtccgtctgaaaggccactcatacttcacatcagccactgtaaggatggacagtggccgacagtggaggctaacacagctaacactagaaccacatgatttaggaggaatttgggacaggaaatttgtaagaagaaacattccgggtactctaatttgtggtgaatttacaagttagctgccaattgagaagtgagactcaaattgcacaagacgtcatacccctaactttttccaatccagataatctacccacaggaaacatttaaaattctgataggattgcatacatggccacaagcctatctgtgccatctttgagcttctcctggatgactctagcagctgttggattcttggctcctatgctagtctctcctccttgcaatacaccttccagatgcctgccagttaccatgtcagggaagagtctctcttcaggtcactctcttgctttagagttaaatacggagtgaagatcagattcccttgcatggcacacagcctctttaaaacccgtcccctattacctctttgttctctcctcctgacactcaaccccatgccttcctgcttccagtccctcaccccagatgccacctggtgttcccccatcatctagcctcttacacttaaacttctaagaccagatcaaatgacatctcttatcagtggcttgctgtgagccttccatttctcagctctgtgtgctcacagcatttaatcgcgacttctaccaagccctttccacactggtcacagcagctccccggctcccccgcacgctgtcaggctttccctggtggatgctgttcagtcatctcggctcccacgcctaccacagggctacatctgagcagatgtgcaatatcgtaatgtccctgacaactgaaatgatcatgttataataaaacatctacggctaacatttattgattgcctgtgatgcaggaggaatggggccaagtatctgatgcattttatgtaatttaatctttaaacaattctgagaagaaggtgctactttctcattttataggtatcctgagattgaaaactgtttacttttcacaggctctcggtactattgggtggtagaacagagatttaaaccaggtcttcgtgaatccaaatcaatgtcctttccaaaagaaatgtgcaaattcaatctgcagggtactctgatttcttttaaatacattacacattttcacagtttgagattccacatatgtgacaaattctattgacacagaagtatttatagccttagttttgcaaagaaaggcctaatcttgacaattggctatagaacttataattttaaacttctttgaaatatttcacagaaatataccttaaaatattaataaatattagtctcctatatttaacctactacagacaaaacttctttgtgaaactgtttttaaaaaaatatttttaaaggaggaatgttggtgaccatgaggaacagttgaatctcattcctggaaatgtatacttgtagttttaatgaaacttcaaatcccgtatgtagaaaaagttaacagtaatactttaccgaaagacattaaggatgcagtgaaaaagccctaacttaaattccgaccatgaatttagaactaccacaaaaaataatttgtttttattatcactacttttctctccctaagaaggcctatgtgatcggccagtttattttatgaatttatatcgaatgtatggcctcatatcaacaaaagggccttgcttggattaccgcagaacacgaatgggctagatatgcttacctcacctctcctaactgaaatgcaagttaataggaggcagcaatatttgcatttccaaggaggtggatagaaaaaggagcagaaagggggatttcggtttctggtgaatccttcctttaatattaaacctctccaacaataacaagtactaaaagctctgcagcacccccagggaaccaaattccagccacacaaaatgacctttaacacttttacctctcctaagaaatgtttaaatccaggcagcatttgcatacttactttctcagtttttgtctaatctctgaatctttaatttcattttgaagatcctcaaagttcttaactgaagtcaaattacagaaaactctgaagtcaacatatggtgggatcccgtggtctctacccctttgaatgatggtggcagccgaatccacggccgcagaataagccgcggagaagagcctctgggtcagctcaggactgagaaggtaggagggtgcccgccatttagcagccacgccaaacagcccccggagaaccgggtctatcccaccttccttgattattctggacggtgaaaagagcgctttatggaacggaaggtggccttcggaaatttcacctaaggtggcattcagtcggtaaagaataggattgattaatgtgtggccaaatctaaaggctgcagtagcaaaagagttaatgatgcctgcattcacgttggggttgtagcctcggtaacccctcagcatcctagtgccagggtcccccaggaccttaggcagccagtggctgtaggtgatgtgctgcagctccgcgcccacgatcttcctggcttcctggtaaaccgtgtttccctcccagtgggggttcagggcggacagctccgtggccatcctgttgtgttcccggaaccacagggtgtgcatggcggccagagccagatgctcgttggcccggtggtccccggccaggaaacaggggctctcctgctcctgtcgcgcgcactcggtgggtgggcctgtagaaaagggcaataagggctttccggagggaggccaaggaaagcctgtcttcaggagaccccgaggcaccgaagggtctctgagagcctgggattcccgctccgagctcccgtaaacgttggagccatcgatgtaggctgtttgctggttgatctgctctcgtgcatagactgaatccaccgtcgcagagggacggccgctggcacacgcggggctggagcgcgcgaagagcatgcagggcgcgtgggtgccccgggggtcggcgtgccgggtgttcatggggaaacaaggagggtcgttggtgcagacggagctgcacggccgcccatccgagaagcgggctgtgctcagcgcaggcactgtgtggtccaagtcgtgctctagaaaccagccccagtgcatgagcatgcgcgtgtagctgtggtcgggggtgacggccgccgcgcgcgcccacactgtggcgaccagccggggcggcgggaggggctggcgggagcccacaggaaggccgagcccgcggggcgcgcggatgccgtcccggtaggctggctgcagcaggcgcgcgaaggcggtcagcgccgcgccccacgtgggctgctgcaggttgttgcacgtgccgtcgtgggcgcggtacttcgcatggaaacaccggttggagcagtttggcagaggcctgcgagctgtgcatccagataaattggcgatgaggctgagggagcgcggggacaccaagtcattgtaccggaattctgaaaggcaagcggcgaaagccgtgaggagggcgggcctgggagggcgcgggcaacttggaactccagatgctgcgggaaccacctcccaccccgcccgccctgagtgaaaagaggcctttcttacttccaaaaacatttcgttagctcacaacaaaaggggggatcattctataacactaaaagatgtttccagaagatcccgggattacttttgagcgttcatcctgtaaacaatggctagctgctagaaggagcaaaatggaaggagagcagatgccagccagacactaaaagatgtttccagaagacccgggattacttttgtgctgttcatcctgtaaacaatggctagctgctagaagaagcaaaatggaaagagaacaggtgccagccagctcctaacttctactctgtgcctttacaagaacgatgttggcaaggatttgttcttccacatcccagaattgttttgttgatttttgtttgtttcatttcagaattttttctctcaagttttgtgcttctagagaacaaggtcaaagaaatatcaatatggatcatgtgaatattaacccacatgatacttgacaaggagggattaagcaacaactttctgaactactataagctgtcattccctggcaaacgggcaaaataataagggacatgcttggagctctaccttttaacagggcttaaacttccagcattctcccagtgctacaaagattgttcactaatcatactaaaagttaccatccttatttaatcttcagaaactggcaagcaataatgggaccatttgcactttatccatgttagccagtccctggctggatcctgagatatcttaatcttgggtatctggatattttgcctcaggaagctttgaaaacccatcatactgggtgaccagggacagtcaaatgccagttagttagagaaattgtacagagctctaagggctgaggcaagctcacagataggccttctgcaccacgtctcggttgatttcctaaaggagaataaagaaagggtaagccaatagaaattgatgctgtactcacagcacaaatagtatatagcaaagaatcacattcacttatttcatttgaaagagaacaacttagaaaatctgaaagctttctatatcatctcatttgacatctactaactagatgtctggttttaaaaagaaatacacaagaacttggatataccaaaaaacaaaacaacaacaacaaaaaaacaaaaatcaaaagaactggggaggtattataaatattataagtggtagaagaaatttcaagtaaattcactgaatgattcaggtgattgaaaggataagtggaagaatatccccctggtaataaagcatttctctataagacacaataatatcttttacatttgaaacacaagttcacttaatgtaggttccctagatttgttctctatacatataacttaaaagttgagacaagtttgaatatatatttatcatccttactttggaattacagttcctatgagaaacatctgcatttatttggtaaaagtagtgagtaaattaatttctaaatcccatgatattctggagattaaaagttcagtgtcctttgctaaggtggtggtcagtttttctgtgggcagtaggctgagaataaaatggctttgtggctgacctttgccttccaagtccacagtgagcccctgcttcacacgttcccgtatcagctgcagcgtgtgctcaaaaatctcccctgctcttgccatttccacaatcagtgggtcacgcgggtaatgaaattgagccagcaggtcactggaggtgtgaggttttctgcaaatgacaaaacacatgattctttacaaggcaaaacagcagagtccatgaagcttgcaaatactgtgcatttaaaaaggcatttcccaaacattcgagaagaatgaaagctccaccactacaatagaggctctacagaggagctgtgggttcttttcctattttgctaacaacttattccaaatgttagtcccagtgctgaactcaaaaatatatatttttaatgaatggatgatttaaacaatagttttaggaaacaacatctatggtggggttctaaactgggggggtcggttgatgaatggattataggaggctcagtaaaccttctgaagtactatgcaatactctcggtctgcaggacttggcattttgtgtcttctctttccctgagtgtaatctcctagaaattcctccttgcctttagaatcctcctcaggcctcactctccctgtagagtttcactgagagctctgacaagctatcactccatcttctctagtactcctgtatccttaaatatgtgtcttatatactcagtaaaatgtacttgaattgctgacatattgtctcctctgctaaagaaagaactaggttgctgatgagatgttgacctattatttatcttgtatcccaaataccaagcccactgaccagcacataatagcagtttatgcacatttgtagaactgaaccaaatatgttaaaaagaaatttaaaagcactgagaatgtgaagcaaactgttttagagactttgatcaactgaggcacatctcatcctctatgtcttgaatcttaactacttgaggtcacagaataataataatgatgctaatagttcactttggttaagcactttctattctccaggcactgttgaagcactttttacatattatcttattttttcttcctagcaagcacatccatgaagtagatcctactgttatcccaactttagagagcaaggagcctgaggtacaaagatgttaagtcacttgctcaaggtcacccagacagaaagtaatgaagtgaggaatcaggaagagaatataaatctaaatcggctgcgtggttctagaacacacatgcatgatcacaaagccattctatttatggatgtgcaggaagccagaagagactcaatttgggattttacgatgtccctttttgaccactaactgcaaatactgaatatatactttatccgattatgatgaaatcaacaatcatttttttgttaatgcatcctgatgttacaaacacagagaagttaatgggattggaaggtttcactagtccatgaacattccaattcaaattaaaataatgtaaaatgccaaatatcctaaacataatgtttgtcgtaggctcccagtttataccaaggtgtgttcaacttgataatcattctcaattcacacattgcaggagcactgcatctgacactgtttggtggatgctgaggtaacccagcccattgcctagtgtctattgtcagcctgtatagcatggacctttggcataaattaatgccatttagattctatggggaagaagtttccccttttttagggtgaactgataatgatggctagcccagatggggatgcatacacaaggactaaagaaagcactctattgcatatgcactataatgtgacttatggagatgataaaaactaagtagaacagaaatgaaaacaaggtttcaatctgtgtaaaataaattcttactgtgaaaacaaatgtcttcgtgtggagttaattgcactgtcaactctctgtacagcatcaagaatggaagattcaacaaagtcatcgccagcttgtctaccctgtatagctttgaaaatcaattccatgattaaaaatatcaaacagaccttgaagttaggcatgatattatatgaatggcattacatttttaaatgtaatgccattacatttaaaacctctaagacaatgaaaatgttatacaatatctacatgataatgcccattgcagagaggtaggtaattatcttgaagcaaggcttcatctaacaataataatgttatttagggaattaaagtattccaaaatctagtaaagctatgtaaaatatttccttttgaacaatgctgattcacacaggatccaagtatgtcagcaatttgtcatcttggagaaggtatgaaatacctatctcttcagccaccttgctttaatgttaaacattaaagcaaagtaaatattctcccatcccatagaggcttcttaaggcaagaattgaactctcaataagatttatgggaaaattaatttatgctttttttatagctctctaacatgtgaaaatactgcaaagttgaatcctgtagacaaaggaagctatttacttacagctgatcatttccaggctattgaatcttcttcaaataatggtttaagaagtttaacagtaaaggaacaaatactaaataaaaataattacgaatgaatatttacagttcatatcagagaaataatcagcacagtatctagttcatttttgagatactaaaagtacagtaacattttatgtgacacaggcaatgaaaacaataactttttggcactgctaaatattgaaagcaaaagtcaatatagctttaaatgttgagtttgaaaataatgtcatttaggggaagtaaaagtgattaaaaacttgaatagtaataggaaggtattgtatgtattatccaaaagaactcccaatgaagtaactaatataagcttaagtcaaggtgttaccacaatatagtatgatagatatatacatattatatgtatatatctatatatgtgtttctatacatatttaagcatatatatttgacaatagatgggcccatatagcattctccatctagatattacaggaaaattcctgtatattatgaccatctatatagcctagattttattgtcttaaaaagaccaccaacataaaataattttaagaaaaaaaataccaatggtatggaaatattgtaaggaaagaataaaattcaggaccatactgaaaattcttcttggcaaactagattatgtgcagcaattctgagtaagtagggtggctccactgtcaagtcattgcagcctttatgatgaccacaagattgaggctctaaatggccaatgttgcctttcctagtccaaaaaatacatgggattgatttagctaaagataattgaaagaaaaaaagacaaaaattgattaattcaattggatgaaattaacaatttcaagaacatgaacaaaataactaataaatgacacaaatagctgacaatatttgcaatctcaaactctgaggcagaaatgatattctgtttcatacaaagaaacgttataatacactaagaaacaaatatataggcaagttataaaagaggaaagctcaaaagttaataaggatataacatgctcaaaatcacttgtaacctcagaaatgaaaaagtgtcaatgaactaccattttatgcttattctagcaaaaaataaaaagctgattaaagccaaattttgacaggagtgagagttcctataaatcctcaggcagactgataggactgtggaattgacacctattttggggattgtatttagagccttctttggcgggggggagatggcagttgttactttgtaatattgcatatgcacacatcctctcatccagtaatttcaatcccatgcatatatgcagaaaaattataattgaaatccacaagggtatgtatgagaatgtttattgcaactttgtgcagtaggaattgtagaaaattggttgtacaacagtggaagtatgggtgtattagtctgttctcgcattgctataaagaactacctgagactgtgtaatttacaaagaaaagaggtttaattggcttacagttcctcgggctgtacaggaaggatcactggggaggccttaggaagcttacagtagtggtagatgaagaggaaggaagcacatgttacatggctggaacaggagagagagcaaagggagagaggctacacaattttaaacaaccagatctcatgagaattcactcattatcacaagaacagcaagagggaaactcaccccaatcacctcccaccaggcccctcctccaacactggggattacaactggacatgagatatggacagggacacaaatctaaaccataccagtgtgcaaggaaaatgtggtggatgttcaacgtggaatgtcatgcaacagttagaattgtctgggcatacatggatggacacttaaaagatgcttaaggtaaaaattcgaaaactagaaagagataaccataaaatgatcgaattaaaatatataatacttagatgtagtatagttgttacatatatagcaatgatgatgaaagcagagtatggacataaaaggtaatgaattaattagttaaccaattgaggaatcaatcaatataattactgtgattataagaaaacaatactataaacatagctacattagtctgcttatgtgttcaaaaaaagtcagtaggaatgagcctacttaatttacttttatcttagaaataaagaaactaaaatcaatcaaatcaatctgcactggcatgtatgacttgattatttaatcaacatattagctttttctttgtcccttttactccttcacttttggacctcaaatatagaaagcagcattaattacatgcttctgtttgtgacaagtattgtcattgggctactgcatctgggacaaaatatgttatcaaaggtctacgtggatttggaagtaagaagattgtgtgctaggactgagttaccgtacaggacatagtgctattgagatgccaaaacttaaaaggctattcacaatggtggacagaagttgatataaagtataaatttcaggaaaccatcatttaatatgtgaatgtgaattggattgatgtttttgcttttattctgtttataaaattgttttgctgttatagttgtataagatttacaagcatagggattttgcagcacttgtcttcatctgttagctcatccattaaatggagagagaaagccttgctcagcacagagctcagggctgatgtgtttatcagatagcaaagatacgcaaaattcttttaaaactgcatgttgcaatgcacatataaggtggctttcacgattaatgtgttttaaaacctataggcaatctgtatcctcacatgattatcaattgatactgtgttatactgtcaatatgatttgctatttatttatatgaatcagaagtcaaccagtgtgtaaaagtgaaaaggagaagaaaattttaaaaatggaattgtatgcaaatattttttgaaatatttaagctctaaactacacaaatagaaaacacataaagttgttcagattcttaaaagcacattaaatacgtgatatagtcaaacaaaaacattcttgataataaagctttctcgtttttatgtcagttatgattttttaagtttatgtggtttaagagtaaactaaaactaactcttttattattcatttgatttcagtgttgttttgtttgatttggtacaaactgcaaaaatatttttataaatttctttagaacagcactgtgttatgtaagcaaatccaatgtgttggggacacattagaattaatcaatactgttgtagttatttgtctcaaaaatcatctcagttaatggcttaaggaatagaacaatcagaaaattctgagcatattctccatctttttatgcaaaattttacaggagtagagggacaactagatcatttttctttgttaagtctcagggtaataaaaatgagaaaaaggcttcagtatatttacaaaataaacatgtttaaagttattgatgcacatctatttgcaatcctatccctgcatctatgaggctatcactactattgatggtaaaatccaatggtaatattgagtcctttcagaaaagggggagcttaggccacgtggccactcactgctctgcatgaaaggcctggctctgggtgacttggggactggacctagagatgggatgcagaaacaaaacagctgtgctcctctgtcacccttgctaaaaaatgcctagacctcaataaaggctgagattttttcacaattaccaattgggttttgagtattttttatcctccccctttttccccctggggaagaaaattagcagataatgtaactatcgtaaccaaataggtcttatcatactcagtctttccctataaagagtgatgctaaaactgacacatgtgagggctgtcccaggacaccagagacaggtccacattaccatacacactgatggtaatgactgcctttatgaaatcattttgtttaaacagcagagaatctgtcttactcatcactttgcatcattaaacatggaaaccaattcattgccctggagagctccactgttttttcagagactggaaaaggaaaggcaccatctactttgtttaaggttatggtgcttagattaagacgttttatttgttttctttataatgtttaaactattcaaacactacaacaccaaaaatctggaaatgctacttacacatattaaaatgtatatgttaaaattttgagagcatttatctcaggatagaagtatgtggtcactgtatattttatgtataaaatggatgagaaatgtgttacctttaacataaagctaatacaaacatacgtgtatgtatactaggtagatgctgttgtttacaaaaatatttccccactcattgtattattaaagtttgacaaaaataaaatagaaaacaaaattaaaagcttggcaagatagcaaagattgtcatgtatctcttaattagtttgtaaactaatttataccctattcagagtaaattttaaaatgtagtaaaatagcaatttaaaactcttcagttaccaatttcacttcattaatgtttgaataaatataactaatgaaaatattttgatactttattgtccacttataactctgcaacaacttcagtggcttagaaattgatgtttgtctaccccatgacaaatattgggattaaaatgtcaaataattcaaatagtgaattgtttatacagagttttggaaaataactagaactcacaagaactgaacaggttaattaatgtatagcatttggaacacatggtaaatgctcaataaatgttaactgtttatttttactactgatattcctatgagtttagtataggttatttcattaacttcaaagaaaaggtcccactaacctaaagtcagctaacgtagccttaaatcttcaatcagtttagtttgataataatttattgggttaaggatacagttgaagtagcaaatattatgggtgggaggataatttggaaagttatttccaaacctacgttcaaaatgatgaaaggctgagccatagaacaggagtcacataaagaagagaagtggaaaagaagcaattttagggaaggaaagacgagggaggctttgagttggagtaagggagctggggaggaagataaatcgtgagggctcagcttcctgcttctgctatgaaggcatgctaggaggagacaaggtcctcggggaaagaccaggggttcagattcgaatatgttcaaaatcagtttttaacatgaggaattgcaaggactgtgggtccaccaaaatgaggtgccacacagacaattagacacttacctaggaatttcagaggagataacattgcctagcattattttcatacaatttgaaccagtatatgcatgttacatggtccaagtttttcatttaataaattctgggtcacctttgcatttttcactttgtccatatattagttcaatgtctcaatggtaagaattttatcacagacatgctataaagtgtttcctcattactgttgtactattttcataactattgtttgaattctatcatggaaacatagaaattctatgccaagaaatactcttgagagagttcaggtccatctttttaaaaaataagaaaatcaattccagttatgggtaaggaagttatccaaagtggccgagatcagtgaagtctgatggcttaacccagggttttcttctcactatctcacacttctaatgtttcatataaatgtgttttgtgccttcagtcaaaccgaatcattttcacgaggacgaaatgagtctatacttcacagcacttaccagcactttgtagttaatataatatagggagtgttacagtaagttattattaaatattttttaaaaacaataaatatataaacattttatctaaataaaatgtgtagcatttggatacaaaatattatctagaaaaaaagagagaagtgggcaaatagaattaatatttgctgatataaaatacattgacaacatcctaaacaaaaggatagattcccaggaaatactgtatcagtcttacaggttatttatgtaaactgtttacaaatctattagctctaaagggaaaatgagctttctgaaaaaattacaactgtggaaatctttttgttcttttgctatcatagatgccctgctataaacatcagtcagtaaaaggtaaattttatataatgcgtagatggttgtgtacttttcattattgtgcattactttctatggctgtaattcccaaggtaaattagaaactcaaaagtcatgatcacttacttgtgtcatttattccacaaatggaattacaacattctacaataactaagtgggggcatcaagattggaaaatcctcctgtaaggtatgaacttttccttttagttataatgacctggtgaatgaaagggtctcagtcataaaacattcagcaaatgttactttagtttgccatatttccccttattctgctaatttgggttttataaacacatacacactccttgtcttggatcttaaatttacccaaaacttttaaatttgtattctttcatctttcttttactttattaaaaaatatttctaacattatgaaatttatttggtataaattacttttccctcatattgacatataaatgtcccagagacaaaaaagtttttctttgtggaataacatttattttactgtattattatctccttatagcctgtttcaacaccatagaacagaatatcattgaatgctatcactattctaaaatctggtaaataaagtgattaatacattttactgaatgttttacttttgttttgtttttgagatgaagtctcactctgtcatccaggctggagtgcagtggtgtgatcttgacactgcaacatccacctcccaggttcaagtgattctcttgcctcggcctcccaagtagctgggactacaggtaagcgccaccatgtctagttaattttttgtatttttagtagagacagggtttcactatgttggccaggctggtctcgaactcctgacattgtgatctgcctgcctcagcttcccaaagtgctgggattacaggcatgagccactgcacccagcctgaatgttttacttttaatatgtatgtataattacaattagttaaatttctgttaaagaagatgaaattcttgtgttggagattctgaaatgttttttcactgagattacagtgcttctgtgtatgtggaagagcaagacagaggggcaatacagagagagaggatgtttgtttgtatgtgtgtttgtttaatggtaaagatttttagcatttctaaaacatggtgatattaatataaattctgtaataattttttcccaaactatctcaagggcatttttccacaggtctcataaatagttgaatagcaaaatgtgaactccataaatttataggaagcacaactaccacagattttaaatcaggaaaatcatgaactcatagagaatagcagagtgagactaagattttgtaacgttaagaaactttaggtcaggcgaagtggctctggcttgtaatcccagcactttgggaggctaaggtgggcagatcacctgaggtcaggagttcaagacaggcctggcctacatggtgaaaccacatctctactaaaaatacaaaaattagcctggcgtgtgataggcacctgtaaccccagcaactcgggaggctggggcaggagaattgcttgaacccgagagtcggaagttgcagtgagccgagattgtgcccctgcactccagcctgggcaacagagtgagactccgtctcaaaaaaaataaaaagcaattttaaacaacctctgacattattaggacaaatatttgccggttactaaactacattgttaaaattttaagaatattattctacaaaagacatttttacaatatggatacattttatttaaaatacctagaccaggggttcccaaccccagcgccttcagaataaatccgtgctcctcactgaggttcgaagatcctatgacagaggtccccaacccccaatactggtcacagcctgttagtaacacagcaggaggcgagcagcaggcaagcgagcattactgcctgagctccacctcctgtcagatcagcaggggcactagattctaataggagcacaaaccctattgtgaactgcacatgtgagggatctaggttgtgcactccttatgagaatctaatgcctgatgatctgtcactgtctcccatcacccccagatgggaccatctagttgcagaaaaacaaggtcagggctcccactgattctacattatggtgagttgtataattatttcattatatgttacaatgtaataataatagatataaagtgcacaataaatgtaatgcacttgaatcatcccaaagccatctccccaccccggtcagtggaaaaattgtcttcaacaaaaccagttcctggtgccaaaaaggttggggaccactgacctaggcaaaataaatgctcagaagtttgatatttcagaatatgtaagtggaagaatgtgaaagtattcatatgataggaaaatggcaaatctttataaatatgagttgataagctaaatctatttttagtgaggcctgtgttatgaaatattattgtacgtaatgaaacagttacccaatctcttctataaacccataaggcgtggaaaaactaaaaggtaaaaaagaatctgcgaaaccatatttatgaaatttgttcatttttaaggaaactgaaagctgagcaaagcccaaaatagcactccagatgcttgtagctaaactcatttatttcaactgtggattgtcaatacagcaaaaactcctgaacccatttgcaaaaaaagcaacactaatgtgaactcccacatgcagacatgctgtgctttccttcaatgcctctccgtgtagagaacacaccaggcaatcttaacagcctgtgtccacttgtaaataacctcagctgagtttcagtacagtctactcaagtctgcctacaaatggactctcccatgtcccttgtgaactgaataatcaaaaaaagaaaaaatatattttttataagactacagtaaacagtattttaaacagtcattatatataatcaacctgcagagggttccagctatataaccagattggtgatagaatgtaaaaagctatgtcaattatgttggccaattataaatgcctggaaacactgagatatttgttctagtggttgtaaagtttacttgggagtttgatggattgatttctaattttaaactgggattaaatatactaggctagagtatgtagtacatgttgaattccatattatgcttccacctccggctccacattttggctataaatacatcttgcattctattatttttggtttgtaagaaaacatgatatatatttgcaaatctttgctatttatgttctttttttaatttgttatttttcactttatatcctttaagattgtttatatttaaatttttttattttaaaaagaataaaacagctttgactataaacacacttgaccagaaagaaagtataagagagcatgattagtgagatcagtcaaataggattggggtagaagctgttcaaagacagttatttggatgttgtaaatggagctatagacacctacccgtgactgtaagaaacatgttggtcacagcaaggccaaaagaattccgagccacacattcatatcttccctggtcagggaaccctgcgtcgtagatagtcagcgtgccttcatcatccacatggaatttaccactctcagtaatctgcacaccttcctagggagcaaaaaagagttgccactgaatgagtgtggttccttaaaaaatcatttatttactttttaaaatgtgggttcatttattcaacagatatctattgcacgtttgctgtgtgtcaagtactggaggagatacatgaatctagtggagagaaggaagagaggaaaagaggtttctaggaagtgtggtttttctctctctctaattattaaatatgataaccaaaagttcaatcatgtaattatttaacataataataattttaaaattatcactccaatgaatggatagacacaattgattcatatattgcttactgctaaagataattctgacaactacatttggtcgggcacagtggctcatgcctataatcccagcactttggaaggctgaggcaggaggatcacttgagctcaggagttcaagaccagcctgggtgacatagcaagaccccatccctacaaaaaaaaatagaacaaaagtcagccaggcatggtagtgtgtgcctgtagttctagctactcaggaggctgaagcaaaagggttgcttgagtccagaagtgtgaatctgtaatgaactatgatcatgccactgtactgtagcctgggcaacatagcaagatcccatatctaaaataaaaaaaataaaaattaacgaggagaagtatgctcacaaatccatcatctaaaaacatcaaaatatttttattaatgtatttctaatttcccttctatttctaccttgtatgtactcatatgttttgtatagctacactgatatgtgtattatatatatatatatacacaattaaaaatataagaagataaaaataactacattttatatgagctattattaaagtgcatttacttttaattaatatagacttacatacattttcattattatggatttaattttaaaaagtaaaaggaaatggccttatgaaattgcagttaaaatggtgtgcctctgccctgcctctccacaaaagactcacaggaaacagaggatgggagatattttttcaaaagaactcacactccagctatggccaataggccagagtgtaaccatgaacgtttagagtgaaaataacatttcacaggtcttcggattctcacagctgactttaccccatgcttgaaaacaagtccaggtgattggtagctggtaactcagagtagggagtgagaagttgcagggccccaccaggtgagagggcggatgagagagaccagacataaggcatggatgaggcaaccaggtgcacaggtcacagggcctagtaggtccttccttcagaaccacaccttctctgcctcaggttgggccacttctaaattttctttcaaagttgctcccttctcctcacctattgccagaactccagaccaaatgtattgctctgaaatattcgcttggagtctcagcaatcagatggctttccagcacattccttatctgcttatggtagggcgtttctatcgctggtagcaaagtatgctaactcataccttttccaaacttgtgagctgaagaggactgttatgaagagtaaatgtgatagtgtgtgtaaaatgtctggcatagagtcagcactcaatcagtttgtgattaaaagctaccttttacaaagtagacgctgagatagtctgctgatgtgattacataatgatgcatgtcgtacagtgtcgaataaggctttagagactgcccaaaatgtatatttttcacactttctatttttagcataaaaatattttaatatataatatcaaattaaaagggggttataaaaatattcagactaggctgggcgtggtggctcacacttgtaatcccagcacgttgggaggccgaggcaggaggatcatgaggtcaggggatcgagaccacagtgaaaccccgtctctactaaaaatacaaaaacttagtcgggcgtggtggcgggcgcctgtagtcccagctactcggagaggctgaggcaggacaatggcgtgaacccaggaggcagaacttgtagtgagccgagatcgcgccactgcactccagcctgggcgacaaagcgagactccgtctcaaaaaaaaaaaacaaaaaaattcagactactgagaggacatgaaccgaaagacacctaaacttactcttcatagagactggcatgtgagacttgctacagcacaaaagaaggccttgttaatatatggtagcaataaaaataagccaagtggttttggaaaacagttttgtaacctttcacagattttatattttgtcaaaatgtttcaaaaactgacattcaagtgtgcaaatttgtagatttttaagaacactgaaatctgagaccgaccattttgttttgatgaaaaacttaaaacagaagaagcagttatgttggaagaatatggcttccaaaagatgtaagatatataaataaggagctattgtttttttaaagccattcaggttttgaaacttcagaactactttttcttgtttaacaccaagcttttcattcctttcctgtttcagccaatgacctacttttaatccacttctgagttattaacttaaaatggtttcttattagccactaaactcttaatttatatgtgtcaaaaccaattttccttagaggaattcagttatgcttatgaagtgttcatcaccaggcaaattagaaaggataaaccttatcaaaacactgaaccaaaatcagatagagtcacttaaaaaaaaaaaagaagaaacaggaagtaaacctgctgcaatgtaaaaggtattatttgctagcaaaagtcgcaacagtaaaaaatcaatatgagaatcattacctccatttcagtgggtcgatacatctgtcagtgtttttaatattactgtacttttagttgagatcttaccttattccaagtaattatgggctgtggttctccttgagcatgacatgaaatgtttatattctttccaacctcgacacttgtatcctgaggaagttgagtaaacactgcaagagctgtggaaacaaaccaaaataacatcatgtcaaataatatcatttttgtcaacatatgccagctgagtcaaaggtatgaacctgaatgccatattggttaagcacactagttttttaaaaatcaattacttggacgtctaggggaataacaagcatcacacccaggctggcggcaagtacagcagaggccggagcaggtattaggcaaaaggaatgcactgaaactttaactacatttgtatttttaacatgcatctcttcagctgagctgtgggtacaggactttcattattctttctcagtactttttgttaagcgtgaaataaaactatacggtaacatcaaaatttatttgtagctaagataaaaagatccagctcttcagtgagcatctcatttcctcaaaaaacacaaactaccataacacacctaatatgaaatagataattgagatagctctgtaactattaaaaaaatgaattcctaatccttaaaactccccaaataagaaatccccaggaaggaattaaaattattttactggagaatttgacccagtgtttaaaaaatttaacaggatttttatagactctcctctgtaaaataacagaggagggaatacttcccaactccttttggaaggctcaccctaatatcaaaaccagaagataactacaaacaaagaaaaaaaaagactacagtcaaatacttcttatgaacatatatacaaaaatcattaacaaaatatcagcaaatagaatttatcaatatgaaaaggtttatacaccatgagcaagtaaggtttattcccaggatgcaatactggttcaatatttgaaaataaataaatgtaatccatcatattaatggctaaagaagaaaagccacataatagtatcaatacataaaaagtgtttgcctatattcaacgctcattatgagttacagacctctcagaaagaaaataaaagtagaggggaacttccacaacttggaaaagaacatatacaaaagccctagagtaattaaacacagtgaatacttttcacatagaaaataaggcagggatatctgttctctctagtcttattcaacacagtgctgcaagttctagcctgtgcaccatggcaggaaaaggacatagaaagcaaacagaatggaaaagaagagataaaactgtccctatttgcagatgaaattattgtctatgtagaaaatcccaatatatatcaaaaatactccaaagtgagttcaccaaggtctctggatacaagacaaatgtattaatatatagatagtatttattttatatgcaatcaacgaacatatggacatagatctttttaaaaaatacaatttacaattgctcaaaagcatgaaataattaggtataaatttaacaaaacatctacagtacttataaactaaaaactacaaaatactgaagtacaaaatcaaagatttaaaaaaatgaataagcatatatgcatggattgaaagtctaaagacagtaaagatgtcatttctttacaaattgatatacaggtttaatacaattctcattaaatcccagcaagattttttcataaatatagatcagattattctaaaatttatgcagaaatgcaaaggaactagaatagctaaatgtttttgacaaaaaagaataaagtgagagcaactgatctacttgattttaagacgggtcatatagctgcagtaatcaagactgtgtggtattgaggaatacgggagacacagacacaaatatcaatgggacacagcagacagcccagtaatagacccatacaatatgctccattgattttaatgaaagagcagaagcagttcactggaagcctttcaaccaacggtaaaatagcaaatggataaccataggcagaaaaataaacctttacctaagtctcatactttataaaaaattaactcgaaatggacaacaaacttaaatataaaatgtaaaactattattcaaaaaaataggagaaaatctttgatatttaagccaaaagttctttgactttgcataaaaaattgatctattaaagaaaaaaaatgataatcaggatttcaccaaaataaaaaattctgtgctgtgaacaccatgctgagagtatcaaagggcaagttatagacggagaaaatatttgcaaaccacatatgcagaaaggaatagtgtctaaaatatataaagaacccaaaaattcaacagtaaaataccaaacacttcagagaatgggcaaaaggcatgacattgtactgtagaggatatacagatggcaagtcagcatatgaaaaggtgctaaagatcagaagtcattagggacatgcaaattaaaaccacaatgtgatattactacacacctatgaaaatggtgaaaatacaaaataatgacattacaaattgcaggcaaggatgcaggtaaactgaattactcatacattgttggtgggaatgtaagatggtacagacactctggaaaagagtttggaaacttctttaaaaatttaaacatgtggccgggtgcagtggctcatgcctataatcccagcactttgtgaggccgaggttgacggatcacctgaggtcaagagtttgaaactagcctggccagcatggtgaaaccctgtctctactaaaaatacaataaattagccaggcgtggaggtgtgagcctttaattccaactacttgggaggctgaggcaggagaattgcttgaactggggaggtggaggttgcggtgagccactgcactccagcctgggcgacagagtgagactccatctcaaaacaaaataaagcaaaaaaagtccaaaagtgcacaagctaagtcctgtggtagtaaaatatgtagcattttaggaaagctaccaaactgtcttcctcgtgttctttttttcctttctttttttttttttttttttatgagacatggtctcactctgtcacccaggctggatcttcgactaaggaaataagagctttcatcatatctttcttgtatgtttctgtatttctgaaaaaaattatagtaaacatgaaacatttattgctgagaaagataaaaaggttcagttcctctgttggaatcttatttttcttatgtatttaaatcacatggtatattctaagttaacacatgcatttcagaatgctgagaccatggctgattgatgcctgacaatgcataatggacatctcatgagaaccagggtcagcctacgtgccagtgatgctcctgatccaatcaagaagtctccagtgtctcactcttcacatcatagcctcctttgtctgatgtcctttatcgccagctgctttcacctcctgacacaacagttgctcattaccacaagctgtgccatcacttataatattttggaaatatctaacaccacactctaaagcaaagctcttctcactatgcccttgcatctcctcatttggactttatctagacttggaaggcgatctgcttctttcctgttgaccaacaatcttctagtctcattccctttccttttcagccaagctcctgtgaataaacagaagcttaaaagatccaatccttcaggatgaatcccaagcggctaactgggcttaaatttaaaatagagccaaacagccatttcctgactagaggtgacacacatgccctgagttccctgaaaacacacacctttttaacttcaagaccttcagagcttacctgaaccaaccaatcagaactcagcaagtttgaatccttcatttgcataaatggacctgattgggaacatgggtggaaacttttgctacagaacttgaactctctctttgttttctggaacgcacctttgttttacactaggggctgtgtctctccagtttgcaaactgttcgctggaataaagtctctgcttcaaattcctttgcaaagaacttttgttcaagatcccaagttttgtcacctttaccacttttcttccaaaatgctaaactcctttaccccattattatttcattcaacaactctccaccattttcttgcatttcttctcacaaaatatctgcagtaaaaatagagtgattctatgtcctggattgtcaggaacaaactgcccttgtcaattcagatcctatttcacatcaacagcaacgaatttcaagcatttacttctctttcaagtcacctacttcatctcttggaatacccttctcctacacaatattgacttctccacaaagaaaacagaagccatcagactataaattcctcaactcctatactcttctcccacagaggtatcattcaatccatacaaccattcttacctcccctcctatcctcatctaaactgaaaaaaataactcttctcttaaaggtcaattggatcattagagttgcaaatctcaccccatcttgccacctgagtgatcttaaattatttaatgctcatgctcttccatcttttcagcctctccttcctttagaaaatacctaggaaaaacaggcccttccacttatttctgcatgacccagccccatctccactgctgtctctttactgtttccctcttcacttgtttccaagaaacttattggtttcttcgaaaacaaaaacattctctgctcatggcacttctataccctttattccacagcccacttcattaaggcttcgatttccttgactgtatgaaactgcctttgttcaggcccttaaacaaaattccagtctttattgaatgcacctttttgtggcttttgacacatttgattctctccttctgggaataactttttcttagctgctaagactcttgtctcctcagggtttttgtgtaacccagaggctgggaattcctctataatatcgctcatagctttttcttctctctacattccaagggggtccaattcttggtcctctcaccttctcactcaatgcaccaccttagttctaaattagttcattaataaccatggactctacatcttaggtccacgctcagaaaccaaccatttcatggacatctacattaattctcagcaagcataccgatttaactttttcccaagctgtattgactgtgttttcccatttgttaattgaattctttttattaaatttgggaattctctatatattacagatatcaaaacacacttgccagttatatatattgcaaatatcttctatttctgacttgtgaatagaatatccaaattttaatgtagataagattatcatcttttctgataggctaatagttttctgtaatttgttttgcaaatctttctatactatcataatgattttacttcttattgaaaaagagttaaatgttttaaatattaaaacttttttatctggaattgattttggtgtgtagggtgatgtaaagatgtaatttcaccttctccctgtggataatgagttgcccaggactattactgagaagccatagtttctgcagccatgagcaatgacactgcttatacatacgggttttttgtctctttggtaagttgttaatccttgagccaaccatacaatatgttatccctgagcagtatacagtaataccatcttgctatttggatgatctaggttatttctggatttttgttattccatatgccttccagaatcatcctttcagtttccatcaagaactcttctagggttttgattggaattgcattgatctataaatcaatgttggaagaattagcatctttacaatagtaagtctgtcttcttcaatttctttcaatgacattttatttttcttctacacaattcttgcacatcttttgttagatttatttttaacttatactttcttgtcattttaaggagctttgcttttaaaataaaattaggcattttgttgctggcatgtagaacgaaaaacagtttttacttgttaatgtcatatccaatgatcttgctgaactcttaggtctgatagtttatttgtagatgtttttggattgtgtttgaggataatcctattatatacaaataaaattgtacgtatttcttctaaagtcataacatttgttttctatgtcttgcctttccgtaaaggctaggaccttccattacaacattgagtacatgcaatcttcttcctaattttaaaaggaatatttcggccaggcgcagtggctcatgcctgtaatcccagcactttgggaggccaaggcgggtggggaacacttgagcccaggactttgagaccagcctggccaacatggtaaaaacctgtctctattaaaatacaaaaattagctggatgtggcagggcgcccctgtagtcccagctactgaggaagctgagccaggagaatcacttgaatctgagaggcagagattgcggtgagcggaggtcgcaccacagcactccagcctgggtgacagagtaagactctatctcaaataataataataataataataataataataataataatagaaatatttctaacatttcatctttaaaaatgtaattttctattgttttatttctaaaaaaagggtttttttgtagaaaatattttatttctatgttgctaagatcttctcttaataattagttaataaatttgatcgaatgttttccctgcatctgttaaaatgatttgtcctccattaatctagcaatgtcagtggagtcagtggggcaatattttgtacagagattaagttttttgtccataatttcctttattagttaatttgtaatgtatttcctcttatattatctgcaaaactttgtttaagactgggttgacttttagaacatttacagaattcatctgtaaatttgctgccacttctcctttcttagcttttatttaaacaattaatttgctggtttcctaattcatcattttcacttttccaatttgaaacttataatcgtatttttatactttactatttacccttagtatctgtggcatttatacttacgagcctgaaattaacagattaaccaacctattaaccaacacctcatctcagatatataagaatattataaaactttaacttcaataaacatttttccaacatatattccattgtaagtcagtatttaattgtataattttattcaatgtcacaccttaatgattacaattattattattgcatatagaaaatattttaatattatctatatgttcatcaggttcttttattcactattgaatttctttttttgaatctcagctcttttaagattttgtccttcttcaagaagataatctttagccctcattcttgaacactttgatggatatacaatactatattctcagttttattttctgaaaatatctttacttagctcctatccatgaaggagttgatgcttatataatattagatttacagttatttttgtcgaaacactttgaagaatcgattccagcgtcttttggcttctgttgctactgacataaagcctgttgttagtttaaatgctctaagtgatttgccttttttctctgactgtcacttcactcagctctctgctcaaatgtcatgtccttctagaggtatcccctgacctctctttttaaatgacatgtcctggtacatttttctggccctatgccttgttgcttcttcatcacacttaacactctctggaatacacgatatttacttcattttttccctttagatgaggagcatcttttccaagagaacagagattcttctgctgtatttactgctaagtcaccagtgagtaaaatagtgataccacatggtttgtactcaatatacattaaatgtattttctaccatgtaacaaatggttccagaatgtttgctaataatctttttggaactactaggaaataagaaggttaaaaatactagaattaagacactatgaattctagtatgctctactgaagattaatggcattgatattattacccccaaattatgataatcatgagcatttattagatgaggaaactgagtcacagaattatgacagaatgtaacacagatcagtttgccatagacacaatatatcttgattttagcattctatagattgcctctttacagagatgaggtagtaaaaacaggtagaaaggagctcttaaggatatataatgattgaacatctatacccaagaaataacaattaatatatcaatgtcacccagataaagtgctctgtcctttccacatttcatcaaatacatggacataaacacacacaagagtcttcattggccggatgcgatggctcaggcctgtagtcacagcactttgggaggccgaggcgggcagatcacaaggtcaggagatcggagaccatcctggctaacatggtgaaactccttctctactaaaaacacaaaaaaaattagccaggcatggtggcacatgcttgtaatcccagctactcaggaggcggaggcaggagaatcacttgaacccgggaagtgaaggttgcagtgagccacgatcacgccactgcactccagcctgggtgatagagcgagactctgtctcaaaaaactaaaaaaaaaaagtcctcatcagtgttttttgtttgcttgtttttgtttgtttgtttgttttttagatgcaacatatttggaagagaaaataattacactggactccagtcaagaatggaaaggtatcgttgcagcctggtagaatggctgaaataaacaagttaaaatttttaaaaaaagtaataaatttggggaatttttcagattaaataaaattttctttacaaatagaagatgtagataatgagaacaaataattaatgtggaggcaagatggcggcaaccaagaggaaacagcatggaggcgtggcagttcaggcgaagaacccagaaagaagcgaaaaagaggcggagcagccagctaagctgggcaccaccgcagaggaggtggaagaagaagatagagactggatcccaggccccgtttgcaagggggagtgaaaaaacaaggaatggattttcatcttttcttccagaggaataaataaatttcagaacaagacattttatgcaggacttgagaatgttgatgcctcattctaaagcagatactaaaatggatcgtaagcataaataatttgagattagtgagttctgtgaaatgaaaaactgtaataaatgcatctactttgaagctaagaaaaaaacaggatctctttatgtagctttcaaattcacctcatggaccatctgctaaattccttgttcaaaatagtcatagcctagctgaactacagatgactggaaaccttttgaaaggttcttgccccttttgtcttgacccagcttttgatgaattactacattatgctttgttaaaagaactcttaattcagatctttagtacaccgtggtatcatcccaaaagccaaccattcgtgggccatgtgttgactttcaccattttggataataggatatggtttcagaagttttatatcatagaagaaggtgttgctcttgtagaaataggaccttgttttgtcttaaatctcataaacattattcagggaagttttggaggaccaactttatataaaaattctcactaccaggcaccaaaaatgcattgccatgtcataagatccatcacacctgcaaaatacagagagaatcagcaagcgaaagatgtgcagaaactgagaaagaaagagccaaagatccttcttccatgtgatcccactgttcagaccacagtggaataaaattgaaaatcaactccaaaaggatccctcaaaaccatgcaaatacatggaaattaaacaatctgctcctgaatgatcactgggtcaacagtgaaatcaagatggaaatttcagattgtttgagctgaacaataatacccaacctattaaaacctctgggataaagcaaacacagcgctaagagggaagttcatagccttaaatgcctacaccatgaagtctgaaagggcacaaacagacaatctaaggtcacacctcaaggaactagagaaagaagaacaaaccaaatataaacccagcagaataaaagaaataacaaagaccagagcagaactacatgaaattgaagcaaacaaattacaaaagataaatgaaaaaaaagctggttctttgaaaagataaataaaattcataggtcattagcaagattaaccaagaagagaaaagaaccaaataagctcaattagaaatgaaacaggagatattacaaccaataccacagaaatgcaaaagatcattcaaggctactatgcaaaccttcatgtgcacaaactagaaaacctagaggagatggatatattcctggaaatatacaaccttcctagattaaaccaggaagaaatagaaactctgaacagaccaacagtaagtagtgagattaacacagtaataaaaaatttgtcaacaaaaaagtctagaattcatagctgaattctatcagacattcaaagaagaattggtatcactcttattgacactattccacaagacagagacgggggaattttccctaaatcattctatgaagccagtatcatcctaataccaaaaaccaggaaaggacataacagaaaaagaaaactacagaccaatatccctgatgaatatagatgcaaaaatccttaacaaaatactagctaaccaaattcaacagcatatcaaaatgataatccaccatgatcaagtgggttttataccagggatgcacagatggtttaacatatgcaaatcaataagtgtgatacaccacataaacagaattaaaaacataaatcacatgatcatatcaatagatgcagaaaaagcatttgacaaaatccagcatctctttatgactaaaaccctcaccaaaatttgcatagaagggaaatatcctaaggtaataaaagccatctatgataaacccacaaccaacataatactgaatggagaaaagttgacggcactatccctcagaactacttctattcaacatagtactggaagtcctagacagagcagttggacaagagaaagaaataagggccatccaaatgagtaaagaggaaatcaaactcactgtttgctgatgatatgattgtatacctagaaaaccctaaaggctcctcaaaaaagttcctagaactgataaatgtattcagcaaagtttcagaatacaaaattaatgtacacaaatcagtagcactggtatatacaggagcaaccaaattgagaatcaaatcaggaactcaactccttttacaatagctgcaaaaaataaaataaaataaactacttagaagtatacctaatcaaggaggtgaaagagctctataatgaaaacttcaaaacactgctgaaagaaatcatagatgacacaaatgaattgaaacacatcctgtgctcatgaatggggagaatcaatattgtgaaaatgaccatactgacaaaagcagtctaaaaattcatgcaattcccatcaaaataccaccatcattcttcacagaactaaaaaaagcaattctaaaattcatatggaagcaaaaaaagcccacataaccaaagcaagactaagcaaaaagagcaaatctagaggcatctcattacctgacttcaaactatactataaggtcatagtcaccaataaagcatggaactgttataaaaataggcacatatttgggaggccaaagcaggcggatcatgaggtcaggagatcgagaccatcctggctaacatggtgaaaccctgtctccactaaaaatacaaaaaattagccaggcatggtggcgggtgcctatagtcccagctactcaggaggctgaggcaggagaatggcgtgaacctgggagatggagcttgcagtgagccgagattgtgccactgcactccagcctgggcaacagagcaagactccatcaaaaaaaaatggcacataaaccaatggaacagaatagagaacccagaaattaagccaaatacttatggcccactgatcttcaacaaggcaaacaaaaacgtaaagtggggaaaggataccctattcaacaaatggtgctgggataattggcaagccacatggagaagaatgaaactggatcctcatctttcaccttatacaaaaatcaacacgagattgatcaaggacttaaatctaagacctgaaagcataaaaactgtagaagatgacatcgggaaaaacccttctagacattggcttgggcaaggacttcatgaccaagaatccaaaagcaaatgcaaaacaaacaaagataaataaatggttgttaattaaaataacaagcttctgcatagtaaaagaaataatcagcagagtaaacagacaacccacagaatagaagaaaatctttgcaatctatgcatccagtgaggactaatatccagaatctacaaggaaatcaaacaaatcagcaagaaaaaaacaaacaatccatcaaaaagtggtctaaggacatgaatagacaattctcaaaagaagatatacaaagggccaacaaacatatgaaaaaatgctcaatatcacaaatgatcagagagatgcaaatcaaagcaaaaatgtgataccaccttactcctgcaagaatggccataatcaaaaaaataaaaaaataatagatgttggcatggatatagtggaaagggaacacttttacactgctggtgggaatgtaaactagtataaccactatggaaaagagtgtggagattccttaaagaattaacagtacaggttgggtgtggtggcttacgcttgtaatcccaacactttgggaggctgaggtaggtggatcacttgaggccaagagttcaagaccagcctggccaacagggcgaaaaactgtctctactaaaaatataaatattagcaaggcatgttaacacacacctgtaatcccagctacttgggaggctgaggcaggagaattgcttgaaccctggaggcagaggttgcagtaagccaagatcgcaccactgcactccagcctaggtgacaaagtcagactccatctcaaaaaaaaaaaaaaaaaaagaattaaaactagaactaccatttgatccaacaattcccctactggatatttacccagaggaaaagaagtcattgcaccaaaaagatacttgcacatgcaggtttataacagcacaatttgcaattgcaaaaatatgaaaccagcccaaatgcccatcaatcaacaagtgggtgaagaaattgtgagacagatatacatatatatatatgtatatatacacacacacacacacaccatggaatactactcagccataaaagggaatgaaataatggcatttgcagcaacctggatggaattgaagactattattctaagtgaagtaactcaggaatggaaaaccaaatatcttacattctcactcataagtgggagccaagctatgaggatgaaaagagataataatgatacaatggactttggggattcgggggaaaggatgggagggtggtgagggatgaaagactacacattgggtacaatgtacactgcttgggtaatgggtgcaccaaaatctcagaaatcaccactaaagaacttattcatgtaaccaaacaccacctattcccccaaaacctactgaaatttaaaaaaatccattgaaaaataataataataataataattcatgtggcagtgacctttggggatattaccagtgaaacatcatgaatgagtccacaccatccatgaaagctctcccacattgcagctatcccacaacactctacatagctcacaacacatgttacccttacttactgatggtgcaaatttattcaatatttaccttctgcttacaaaatatattttaaaattaaaaaatagctaaagtatctatctaggaaggaaattacacatttgagtctgaattgggacacagagaaatacctgagaccaggaagggcctgaaaacacagcagggtattaagggggcttttccagctgtcttagtgttgctgctagggcctatggcacagggagaagagtgagatgtgtcccagccatgaggtgcagagggccagcaggattgcactgcctctcccctgtggggcttactgagcagatccagagcctgtccaggtgactgtgggagagagggacccatgtttttgggcagtgcagtgctgaggggaagagacttcatatggtttggttctgtgtccccacccacatctcactttgaattgtaataattcccacgtgtcaagggctggactgggtggagataattgaatcatgggggtggtttctgccatactgttctagtaatattgagttctcacgagatctgatggttttataaggggcttccccctctgctcggcactcattctctctcctgccaccgtgtgaagaggtgtcttctgccacaattgtaagtttcctgaggcctccccagccatacagaactgtgagccaattaaacctcttttctttataaattacccagtctcaggtatttcttcatggtagcaggagaacagactaatacaaggtccttcattttcttgtatatggagaagagagttgcctcccttcaaattgaaagtgtcacacagaagcggagactagcaattacttccctagttagatgtctgcttggtcagtggacttgatgacatggtagaggtgaacagcagcagagaactagaaagcaaaggcagagctgagagacagagcagcatggcaatgtgacatgctataacaagtcagtgccaatttattttagtgcaaaaaaaattgaaatcaatgcacagttttttcctaatatacattctccatgaactttctgaagtccctcagtactggtacacagatagatcactgtgatgattacagcttgatcactgtgatggttagtggtatccatagaaaatggtgacttaagctatctttcaagtaataaatgccctgtaggactgtccattgaatgaggaaaccctattagctggggttggttctaagaggaggtaagattggctgaaagaccaaatgctggagctggatgtcccacatcagggaatagagtactgggaggacttcaatatggcctctgaataatacacacatgaagcctgggggctggccacgcagagcaccctgatgaccaaataaggccacaaagcaacagaaggagaggtcgccacactgctggcttccagtcagcaggcttttcttctccttttttctgtacccttattgggaaggacacctccagaacaaaacccatgtgacatggacccagggtcactcttccatatgtctactgagttattattcccaactcttttattattgagttgctttctttactgacagaaaatgataccttcttcccacattaattcccagataaaatggaacaaatttgtgggttacatattgttttctaatatactgtctgggtacattttaattattgtaggtttatcatgtgtttcagtatctagtatgattagccctccttgattctggttctttttcagaattttcttggttattctttcttgcatatcttacctaatgttgatgacttatcactcaactctatgttaaatgacagtgatgacagtagaaatctttggtctgttcctttctttatgaaaatattatctcatttattgattaagcaagattctagctaatgagttcagtagacctattttatcatgttaaagaaatatctattcagacctatgttatgaagagtttttgatgagaatgaatgttgaatgtttaacaaatgcctttttagtagctatggaaatactcatgattcttcttcctaaatctattaatataaaatatgttaattaataaaatatattcttttctactactcttttgttcttaaatttctggaataaataccactaatgtttttaatgtgctactggattctttgatatctatgattacatttatttattttcattttgtattttcgtgtggatacgcaagggctttgctttttttatttttaattaattcttagagttttattatcaagattatgcttgtttttaaaaaataccttatggcattaattattttctaattctctaagcaatttaagtaacattggaaatgttatttaaaggaatgatagttcctcctggaaaagcacctgaccacatgatttagtaaaggtagctcttccacaggtttaacacgtggaataattaacaacctctacagccatgccagagagtcataatttgagtatctgttctgttctgatctctggcaacttgttttctccttgtaacattctgtttagatttctctctcttttgacataaattttcattagttacatttttctgtaaaattactaattttattcattgcttacaaatatttgcatataattatccaaaatactagtggaaaaaataaaatgcataagtaagggttagaagcatctctggagtgaaaagacactgtcaaaaacacatgagggatatgaagacagatacgaaaaaagccagctcttttttcattatgttttcataatgctctgaaaacaaagagctaaaagggattgaagagaaagagagagagctagaaattgggcaaagaagatcaacagatgagtggcacccaatcattttggcctcaggaaccctttacttttaaaaattattgacaagcactaagagcttttatttacatggcttacatgtagctatgcttactgcattgggaactaaaactgagaatttaaaaatttatgtgttcattttaaaattacaattataaactcatggcatttttaaataacatgtttttatgaaaattaattatattttctacaaaaaagtagtgagtagagtagcattgttttacaaatctcagtagtagaagaactgctttcaaattcaatctcttacaattagttgttttggttgaagtctatgaataaaatattacctcacaaagacatgttttcaaaagtataggagtatttttaaagatttttcagataactgtaaacattcctttatgctataccaaaatttgacaattggtagcttcttttttttattatcctttaagttttagggtatatgtgcacaatgtgcaggttagttacaaatgtatacatgtgccatgttggtgtgctgcacccagtaactcatcatttaactttacttatcatttaactttaggtagcttcttttgacatttcctttatcacacaaactactgaaagtatacgtatgtaaaggtcaagatttaataaaagtaatatttccccctgtttcatcaataacagcatcaagtaaaattacttttcttttttactttctgctacaaacaaaggatataatgatatactcctaccatttggcaccctctgtcttggttcaggctgaggctccagcagatttacccaccatgacttttgcaccatcagcgcaaatttcaacccagtgaagaggcaaattactgatactattatgagaaagttttaacctaggaaaccccctcaagggtctctggatctccctcaaccagcaaccacagaacacactttgagaagtactgcaacatacacaaaatgtggaggttccccaaaaagaaacaaataatgagacagaagtgatattaaaagaattaattcaagagaacattccttaaataaaatagtatctgattcttcatagtaaaaaaatcacctaatacccgaaggaaattcaaaactaagacaccttaggcagaataagactgtcatagcacatgaaattcatgtgcaatatgcccaaaatatagttaaggaagctgattccttagctggaaacagatgaaggttctgcaaagtattactgggaacaggtactggggggaaaaatattcctcataatctcagagataaaatgattcaacctgctatactttttcttgaattaattcactcttccattcccaccactgtgatcctagtttatagatctcataacgtgtcacttggtgacagtagtagctcccgtggtttctgactttcatttttctccactccaacctatcctatcctctttaggttaacaaatattatttttctattttttttttcaacatggagtcttgctttgttgcccaggctggagtgcggtggcatgatcttgactcactgaaacctccacctcccaggttcaaacgattctccctcctcagcctcccacctcagcctcccgagtagctgggactacaggcacatgccaccatgcctggctaatttttgtatttttagtagagacagggtttcaccatgttggccaggctggtctcgaacacctgatctcaggtgatccactagcctcagcctctcaaagtgttgggattacaggtgtgagcaaccaccacgctcgccccaggttaatgaatattctgaataatcgatctgatcaagactttcaatagttctatagtctgaagtctagatctggtgtgttccaactcaaccaacaatcccaactaactccttccatatggctctcacctgccaccattcacaaaatctggtgccacacttagggctctttgttctctaaaacacttgtttgcttccatattcatgccaattgctagtggtattttctcacctacggatatgtagtagatttatcaaattcttctacatatgtcaactcctagattaaatggtgtattctaacactaatttcaacaggggcaacttacagtggtcttagagagtcgacgaagcctccatagggaagtgaagtggcttctagattgagatctaaagcatcaacaggagcaagtcaagtgaaaggatttggcaacagggaaaaatcaagatgaggctctttagtgtccttacctcatatttggttttaataatatgtgtggacttactattggtcccattttaaaagatataatgtaaataccacctaatttttggattttagttgaacaccaattcaaaagtagtttgaaacattctgcagacaagcttttggtatttcctcttagacagaaaggtttgccagggcacgtcatagcctgacacctttccacaattgtattttcaaatcttcccactcgtttgagttgctattttcatatcttccctacaatcctttttcccccccgtagaacctcaacttcctttaaaaaaaaaaaaaatttagtatgtctaaaatataagggaacctcaacttcttttttaaaaaaaacatttaatatgtctaaaatataaggggaaagtaattgctaacagaccatatgtagacagtagctcagtgtaggccttcatctgtgttcaggcatcatgaacatgtcagcattcccagtgcttcttctcacacctacgttgatgcatgcagcagagctttgcttttccttctcctatgctctcatcaatatatgttacctctgaattgagatctaatacgtcagaacaaattgtagcaaattgtggagagacttaggaaattatatcaaaatgtaaagcagtgctgaaaacgcagtttaggtgctatgcattttgtaattaagttccatcatttcaccataagccagaaactaagaaaaaatttcagcagtaattaataacaaccatttttcatttttatattggaattatctttaaaaattcaaatcttgatttttttccctttttatatatcagttgacaataaattatggatgaataacacaatctcattccacaatatatattatgtaggataaacctaagtacagttgtcacatgaagagtctgaaggggagtgtcttcactgtattcctaataccactcagcataaaacatacttcagtgtcagagtgagattcagcacgtcaggccgagaagctgcattcttttgtaagacagtctaggcaagtaggactaattaatcatagtaattgtaaaaaattttgtaagaaaacctgaaatggcatttttaaggaaaacataatcataattagtatgaatgaaaatagaattctaaaaactgaagttatataaaagactgattggaagaagatatcaaatttgcatttcttagatcatatgactatatatatatatatagtcatatatgtcataagatccctgtcaggtgtgttaaagacacaggcagaaggcacacttcagaatgtgaatatgaatcacagtatatattacctttgggttttacagtcagctgcacagacacctttttcacccccaacgaactgactgcttgacattcatattggccttgatcgtgctgtgctgcacggtcaattctcaaagtgccagaggagagaactgtatgctggccttccacagggagctgccctcctgcaaaaagaggtaaagaaagtattcttcatggcccagagcactgaaagccagagctgctggctgtcctggctaaagggtgaggcctgtctttcaggaaattctcggtgctagggtgtactgtgtgcgttgtgccctaggattgcaaccccagaaacacagcacccccatgccgcttgtccccgaaactctgccactgtatcataaggaattctcatctgtcaccagaacagcccagcctcctaatgaatttttaatcttcatgtttgtgcccctcggccttactataatcagaaagcaaatttcaaaaccaatctgattcttaaatttgattttcagatatcttcgtgacagttgtttatcatgtgtatgcaatatttggaatacaataacgtgattaaaatacatttaaaatgcagaggcagcatatcgaaaatggtgattttgtgacattcatgctgttatctacacagtcaaccagaggccattgtactttgcactgctgagcttatatgagcctctgaatccttcttaacactttactcttatggtcattaacaattaaatgagattataattttcaactagttcagtgaaaacttgtatcttattgaatgtcttgttacagatggaaaaaggaatagctaaccctattgagcgtacacacactgtgccatcaactattctaaatgttgaagagtataaattattcaaatcaaaccccacaaccaccctatgatgtaggaaacgtcatcacccccaacacagcaacaaagactctggcaaacagcagttaacaggtttgctcaaggtcacatgataagcaaatggaggagtggagatgtgagccaaggctttatggttccaaagtctacctcctatcaactaatctcataaagaatagagcaaaaatgttaagacaagaaattcataaatgtagattttgaattttatttcgtacctgaactaatatggaaagtaggattcccaagcccggaggaaccttagacaagctctcatccagccaatcgtcaatcctgttctgttatgtgcccagattccctgtaagtgtctggcgccttggtggggcatagggggttagatcctgcctgccaggcccacgccccaccacccacacttcaggaacagcagctcttttttggagcttcacttcggatttcatttcacttgtgatttcattttgtactagaagaaaattatcccactgaaaaaagaaatgtctaaaactgctacacttgcggccgggcgcggtggctcactcctgcaatcccagaactttgggaggccgaggcgggcggatcacgagatcagcagattgagaccatcctggctaacacggtgaaaccccgtctctattaaaaatacagaaaaagtagccgggcgtggtggcgggcacctgtagtcccagctacaggctgaggcagaagaatggcgtgaacccgggaggcggagcttgcagtgagccgagattgcaccactgcactccagcctgggcgacagaacaagactctgtctcaaaacaaacaaacaaacaaacaaacaaacaaaacaactgtacgctttccagtaattttattttaaaaatcaggaaaccgagtcccagaggggatgatctcaggaaggccacacactcaaatgccaaaactcaaaacaccacgaaaattatgatgatgtcatatttagatcaaagattattttctgtgtaattttttcatgtccatgatacaccttcgataattaatttaaactatttttttttactatccacaaaagaaggcacttatttttccccacaattacctgcagatgttctaatacctgtttttgtccagacaataacaggaggtgggttgccgtcagcttcacagagccactctacagcatgttcttccagcaccacttgatccttgggggttactgtaaattgtggaggagctaaagagaatgaaacatacatcaaaattgaaaattattttacaaattttcagtgccaatagaaaaaagaaaatgtcttcaaatatgtcatgtgatcagaatttgtttacaattatatataaacaaggttataaagagtgtggaggtgcttctgtatgtttgtgcctgtttgcaaggaagccagaaatacacacatctggtctgcaaagcaaaacagcagtagccaacaagaagaaaccatttctaaatcttacggcagctgtttcccatgattgaatcatattggttatcattttagtagatgtgataaacatatttaaagctacaaattgtactttaaactattaacaaaaccgtcttctccaaactttcacatgcacaataaaatttgaaacgagttgatctttcgatttcagaaagaaaaataagctccttaagattaatgttcctgcaacacttgaaattatacttttgaaaaagtcatatttatgtcaaaattcagagttccaaatattcagattttgtattattgcttttgtataaataagaaatagctaatagctgcatatgccattcctgaaaagggattctgtccgtgactctttgattgaataaaaaaataaatcaatgtggccatttaagaagagcgcaatgatccccagtaacgcctaagtgatcaaaagaactttcgcagatgactttgtaactggaaaggtgtcccaatccagatcccaaaaaaggattcttggactttgtgcaaaaaagaatatgaggcaaatccatacagtaaagtgaaagcaggtttattaggaaagtaaaggaatcaagaatggctactccacaggcagagaagcagtataggctgctgggctgagtatacttacagttatttctcgattatgtgctaaacatggggtggattatttacgagttttctggaaagcggtgggcaattcccagcacttagagttcctccccattttagaccataaaaggcaacttcctgacattgccatggcatttgtaaactgtcctggtgctggtaggagtgttttgtaacatgctaatgcattataattagcataaaatgagcagtgagaacaaccaggggtcactgtcatcgccatcttgcttttggcaggtttttgccagctcctttactgcatcatgttttatcagcagggtctttgtgccctgtatattgtgccaacctcctatctcatcctgtgactaaaaatactaaacctgctaggaatccagcccagcaggtctcatcctcattttacccagccctcattcaagatggagtcactctggttcaaatgcctttaacaacttgacaaatcatttctctgccttgttagatttttgcacaattcctactacccccttcttttcacctgcatctggaaatacaagaaacatgataaagtaaataatatttggcaaagtgtatttgttgcaagtttcatactgtgtgcaagtactaaagagttttttaaagtcttcatccattctaagtaaggtgctggactaaatatggtataaaataaatttccaagtcacacaaattcatggaaaccctcaggaatgcctgcaagctatttgtaatagagttctagaaaagtcaagctggaaaacagcccacaaatcagcaatctcaggctcctcactgcacagatgagaaaattcagactctgggaggtaggattgaatttctctcggtcagaactaataagtagaaaagatagtagagaatctgggccgctcaacccccagcctgatgttctttccagaacattacactaactcccaaaattactaggaacaacttaaaaagaacaaaaatatttctacattaaaaaatagattcatgacacagtaaaagagctatataacaaaagatggtagtagttaagagaaataatgtagtcctggttctagtgttgggaaatttgatttcaacttttgaataataataactttaataattattaacatattaaaatttaattttattttaattattaaaaatattaacatttaataactttaataataattaaagttcacggttagccaagtctgtgtgaaaagaattgttaaacttcacgtgttctcacttttaacagaacccaagatccacatcttagcaaagcatagaaaacatttaagaaaatagtcaatttacatttgtttctaacactaaaatgagcagcttgctaggtcgatgaagaaattatgaacatcaccaaagcaggcagagaaggtggaataattagacaggaatgatgaagctgacatctttgggctttccatttaaaatgatggccttctgagtcccacctccagtgctaaaatagcacatgccgagatgaagtgttttgctattttattaaaatctaaaattctggctactcattaaggtgctgcctcacacacaaagcattttgacttacactgttgatgaccataggcctttttacctatatgtccacactgtgattcatatctttcattgaagcttttttgtgtcattttatttgtgttattttattttagtcagtctaaaaaaggaagtttatctgtggataactgtgatctcagtttaaatagacattaaaagatcaagaacatggatagaaacctgttaaaatgacacaaaaggatacatcttaaaatgtttcatctatgattaggcaaataaaatcagccttttaaataaatgtatagaatgattaatggaccgtttcaaaatcaattaaaaatctgggcacacagatccaaaagtgacacaagtagatggtcacaaataacaaaggacaagcagatggccatttcagtgcaaactcactggcaacaagaaatcattagcatattgtggtagaagaaataggcaggatggtaaaggttaccagagttctgttaagcaatgactgacgcagatgggcagatggaagcatagaaaggaagtacatggaaaaagctgagaaacaaaagcctagcacagtgtggaatacaggcaaccactaaagtgtgaaagtgatcaggcgttaggtttctaaaaaacagacattgaacacaaaatgatgtaagcaaaacaaaacccaaacacagtttctttgaaggtatttttcaatctcaacatattaaaagtttaaaaataacgtttgggtcctttaaaagtaatttcccccagaagttaccaaagacctcaagaaaatatttcatttctgtgccttcttattagagcaaggaaagtatttttgggatattagcagttctagggaaaaacacaattttttttcctgagacatgtaaataggaataagaaagtattgatctattgctattaaaggagttgatgctaaacagttcaatttagaaaacattctctgaatgcaggaagactaggctggaggaagccttgtgctttgtgggggccaagatcactcttggggccactggggctcactgttctgaagccctcccaacccaggcactgcactaggctggccacttccctttttctctgttctgtgtttcacacggttcagtgttttggtagataacatcctatgcaaatcttaaaataatgaaacttaactcaatcaaaatatgcacatatcaggaagcccctaaaacggatcatgtaaattaccgtactctcatcaactgatgaaaaactagtttagaaaaaactggacctttgatatgactccaatagcacttatattctgctgtttactaaactctaaccctacaggaagatggcatgcaggcacacatgcacacacacacaaacgcacacacacaaacacacacacacacacacacatgcacgcacacacaccagaaaggggccaccccaggctgagaaccaaagtacaaagaagaatgtgccttctttataacacgattgcatgcccatgcatataaattaatttctggattcagaatagttttactattgctgttgttacgcagtctggcctcgtaggagccttcagcatgtcctcaagctctgttgagtagacagtttggtaagtgactatgaacacagggcacagccttttcactttcatatctgtactgtctttcctgtatctgtgaaatattctgaagcacaaatatctcttgacagtttccttccagattaatgactccatctcttttgttgctaatggttgagtctgacctttggataaagattgaagtaggaaagaaaaaaaacaacttttaacttgaaacagattagctttgaaaatcttattgtgtcaaaaaataattggcaaataaaaatatttctccactgatgtacatgacattatttaagttgaaaaataattttctgagtgtggcaggaggaacatttcaatcatgaccttctgctcccataccttgtacaattatgtttgctgcagcttgaacagtgccgtggctattgttggcatgacaggtaaatcgaccatgatcccgttgtgtgatgttctgtaagtaaagtccactggacgttgccacgtgcctggatccatccagctccaatccattgtccctggtccaagtgataagagggtgtgggtggcctgtggccatacattccaaagttgtgctggtgccaattaaaacctctgtgtcctgaggctggattacaaagcttggtttggctgatggtaaagggggaacaaaacgaaatccagcaagtagcagttaggaagatttatttattctgcattgtggttttaagattattgtcattttcaaaattcctttaaactaaaatattacacatatatatatatacacatttaattcccagaaaattaaatctaaaataatgaaatgtggatttgctgtaagtacatacttttttaaaaagattgcttgccttgatatcacgatgtgttatagatactgcaaagcacctacacaatacatattccttattttaggggttaaatgtttaaacattccttcttaagaatactcacatttttttaaacacagtttaggcacatgtcactgggaataaataaaagtgctaagtttaagtagtcatttcttcctcctgtttgctacctggaattcgggcaggaatgcctttgggttacaggagccactttgtgattaagaggtgaaaattatgaggaataaagaaacctatgtgcaaagcagatcaaaaagcagaaagaagaatattattggctcactataggtaatgtggcagctctgtgacagattacccttgtcctacttgtggcatacaattaaaatatgcacagacacaaacacacacacatagaagctatgcatttaagccatatctagccaagctttcagttactttcagctaaacgtattataaattgattcatcaagtatacatgtaaatagaaaatttagactttcatataaggagttccactcttacaaattcataggagtttctcttttctgggaatctcaagcaaaaattaaatatttgctaaggtgttaaaaatgcctaatgattgattctaagtttggggaagggggatcaaccattcctgagatgaacatattctggaaagtggaaataaattaaattaatccaattcaacaataaatgtttaatttaattcctaacaatatcgaatgtcttaagtatattagtaacatactggatgttggaaagatacagagatgaacaaacacactcctccttgtgtgctcctactctagctgcatgaacagaggacagaacacatcatctgtaaaaccacaacatgcctcggaaagaattgtctcagagttaggtgtaaatgtgataggagaacattctggcaagaggtaagggaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaagaggtaagggaaagtatagggaaagttattataataattgaaataaatgttccgaggtaagtcagtggcagtagaactggaaaaggagataatctgatgcatgcatggaactaaatttttagagaattgtggaagaaggagtagcactagagggtgaatcagaggttactggaggagagtaatgataccaatagagatagcaaacacaggatgctgtgggtttgtgtgggcaaatgtgtttgacagatgtaaagatttacatgtgaagataaaaacaaagtcctggcaatgtccattgaaatctcaggaaggatctcagcaataaagactataaattttacatgaagtatgaaagctgaaggtttgggaagagctcagatggaagaggaaaaaaatgtgattagggcacgggggactagagaaagggaggggaggacagcgctataaggaacaccacattttaggcaggcaaaagagatttaaaaagagaattgaggacattaggaaaggatcaagaggaagtcgtgttctcaaagtagaaatgctcctgtgtgcagggtcagacttgacctagaggcagaagggaaggaggctttggaaggagacagtggtgtttcaatcagaaattacttggtgtaatcccagcactttgggaggcctaggcaggaggatcacttaaggacaggagtttcagtctgcagtgagctatgatcatgccactgcactccagcctgggtgacagagtgagaccttgtctctacaaacatttttttaaataaattacttggaaactatgtgaggaattatcatattcaatcaatcgctaactcaagtgtctttttttcctggaaaacctcttgattcactgcaatttcctccattcactttgccactaccctatccatgccaccaccaactctcttctgccctgtggcaattgccgctgctgacttcctcatcctgacatgcctatcttaccatgccctcctgtttgttctctgaactgccaccagagacatttttctaaaagaaaaatctaattttaatcatctcagtgtagcgtcatgaataccctgagtgatctgaccccactttatacctcaccaaatctcgtgtcattcccagcctctcctctgtatgctccaggatctccatctcttgaatgtgccttgctctgtcttccctatgctgtcttttctcctgaaatgatgcttcaaccctacttctctggctctctcccacttgttgttgctttcaacttaaaggtcaatgctcttgggaagacctgaatgaatgcaatcctccgaggctgctgcttcaagtgctcccctccactgggatgggctggagccggctctggagagccagttgtcaaattttcagtattctgcaagctgactgctacacaaagccattcttaaaattttaactaaataaacttacaatcaaataaattttattagcatcaaaactaacaaattcatccctattttttactacattttattattatcttcggtctcagggttattatgcctactgtgtctgcacgctagaagtgctatattatgatgaacttctgtgcatctcttcccaactccacattcagtgatatcatttcggtaactaggaattggccatggtgagattatttatagaacagatactgacaaatgctgcaaatcagggctccctgctcctcagagccaatttacaaacatttaccagcacacaactgtcctttatgcttctctccctctccttacacatcataaaacttatttcttgaattatggctatcatctaatagatgatgggctcagtaaggtgagagacaatgtatttccaccatgtcaacatgctattaatgaaaatttgttgcagtcattatgtctggtttatataagccactgaaattatgacaaagcaaagcccctggaaagttgaataaggaacgtggttgataaccatgcaatcttcaacagctagctcagtgggcattcaataaatatgtgttggattaattcatgatgaatgaatgattgaatgaatttttgaaaagagtaatattcctgcctaagtaacactggttcactctgcataaggatgctggatagctggatggggaatcaaaaggagaatagaaaagtcttggaaccacaatgtgctgtaccagaaaggaactaaggcaggaaattaaaataaacttcaagagaaaaaaattcaagtttctctaaaacaaaatttaaaaaatcacagtcaatgggaatagtttcactttgaagtattacatactctaaagcagcaatattagatcattttccagtgcagataattgatagaactagaaaataatagttttacctggaagactggagtatctgagcatggcactctgtgtcttggcttccccagcggaatttctggccatgcactgatagacaccttggtctgactctctggtgtttcggatcatgagtgtgccatcatcaaacacattaagtcgagtatcatcttccaaatccaatgagtggctggaaatataggttatacatgtatattatttaatcccattcatgtttaaaactcttaacaagactgagaatatagtactatatagctatgtttcatgtctaccaaatttgttaaatttattttatctgaataattttaattatttcactttaaatcctagttatcttgttcctatttcaagaatacaccctgaacaaaggctctgagtcaacatttgatagagggaaatgaggttgagatgttctgccttcctgagtggcatgaatttagacactgaagcaagcgctcccatatgacagacacttcagcacatttttatatatttgaatgcccacttttcagaaaagaaatcaccagatggtaatatgtaatccttttacctccttccatgagtcattcagtattctttcatattttgttaaagtgtaaaaaaaatattcctattcaaaccagcacgggctcaaagccaagtataattatatgactaagcaataaataacaaacctaacctaccaagttgttgaatattaggcccccttctctgaggtgcaccatttggatatactaggaaagtcccatttatcaattaagtgcataatccattgagtgcaagtaggttcagatgtgcaacaccatatcacatcaataatcataagaaagggagggcctgcatgagttatttttaacaataaatgcaaagctactgacacagaaacatatgttagaaatgtttacagattttttttctggcaaagatttttttcctttaaaaatatttaatgattatgtatgagaaggtatatagattttcacatgtgtacacttagtactaatgaacgttttaggcatagataaaggaaatctactctcctccatcttcatcactcaatacatattttctaaacaccgatgttttgtcacccataaaaacatcattcccagaaaagaaaaagtgcattaggagaattccatagttctccctttaactcatgtatttgttttataaagccaggtaaacattttcccactaatttcaaaatgtacccacactaaagaataacagcctattcccacataggtaaaaacagtaaagtttgttaaagagatgaataaattgtcattcttatctaaccattttttgttgtgaaagataagaaagaaacagacaatggccatatttgacttttatgttttagagcggaatcacagagtgaaggcaggaaagatgaagacaatctgatcttcttcagctattgggtataaaaacccaatgtgaagaagtaccaattagccaaaaaagaaattcgagttgtcatttttgaacagattagtttcagaaaaaacaggcatgcttttgaaaagccagcaatgcaagacaaaggcaagaaaaggagaaactggatgctcctatccatatcacccgtgaagtttctcagtgtaagtagcatgaaacgaacatcagaaagaatgttttttcaaggccaggtgcagtgcctcatgcctgtaatcccagcactttgggaggccaaggcaggcagatcgcctgaggtcaggagttcaagaaataatattttttcttaaagttccccattcaaggggctcatttagtattaagcaatttaattattttaaatgcaattctaaaattatctaacactgaacccaaataagactacttgcaaaggaatatgacaaatgatgaaatcacatttttcagaaggtgatttaagttcctggaattttgttccaaaactttgcagcccaaaatttcaaaggctaccagatgtgtatgtgctatctatcatctggctacacaatgcaatagaattcaccaggattcattatgttaaaaatgatataaaacaggcagtagcacatcacacccataaattcaaaatgcatcattccttttcctagtaatttccctctttgtccataacctcttcgttatgctcataaaacttgtttgctcatgaatcatgatgttccttcccaaaaaatcaaagtcttcatgtttcaatatattccattcacattgtcagtttgatgcaaatagcaatcatatgtaaaaacacaaaggtttgcagaggtagaatatatctgaatatattctatttttccttgaaaatgtacaaataaacatatttgatttaatgaagacatacaaataacttctattaaggtgtttcattacaacagtcatttgttaagtgctttctaagaactaggtgctgtagctagataccagaaatattgacaaacaagttatcaccacacaaattaaaactatcttctatggtcacgcacagtgactcacacctgtgatgccagcactatgggaggctgaggtgggaggattgcttgaggccaggagcttgagacaagcctgggcaacacagtgagaccctgtctctacaaaaaaaatctaaaaattagccagatatggtggcataagcctgtagtcccagctacttggaggctgaggtaggaggattgcttgagctcagaagttcaagcctgcagtgaactataattgtgccactgaactccagcctgggcaacagagtgagactgtctgtctcaaaaaaaaaaaaaatcttccatatacaaaaccaccatcaaccacaaattatagtatagttgtaaagtttgcttataatctactggaactgtcaatcatatttaccatgtttactagaatatgaatttatttagaatggcctaaatttccatagctaaacctcaacattatgaaaagtgtggaagacagccaactagatgcagccaggaagcccttctcccaccaagagaagccaaaatactgaaaaagccatcacactttaaacagatcttttgagggaaaacactgagagttgctagaggggaaacacagccactgaggctgaataggatggaagctgggaagcctgcacagagtcgccaagtgccaagacccgttcctagtcctgatcaggtcctaaagaagaggtgagtgaaggaaactgcagggcaccacacccccacaatggacctctgggatcctagctgcaagagatcccacgacccccatagacattttaattggtggaggatctgccggagagaaggcagaggcagagcatgagcctgcatggagcccaggttttacacacggggcaactccagcaaaatgtgaccataggtgcccatgccccaaggctctccatcttgctctgagtcactccagcccctgctgactgctgggctgggatagagcagggctgcctttcctacaggactgggaccaatctgatctgcatgctcccttgtctctggaccctcccaaggcacccacccagctgctcccataaaagcatgcacactacacagcctccactacccagggtgagtgctttgccagcagcctgagagcactacagcctccccagcacagccagtgctagaccccaaagggctaaaggacaaaaccacaggcccaatcccaccctcccagggtctaggcacacagctgaaggatatcaagctgagatctgtgactagagattgagcagaggaggaactgccaatctcagaacactgagaagagtgaaatgcagatttgtgttctggcacaggagctgggtgtgcttccccgccacagggctagtatgggaagggtgtgacctttctgctagccacagcctctgcctgagggagctccatggcctgaaacacctgacagcccagcgatctgggtgcagaaggcttgggataaaaccagcagatggagtaagctagagggcagccaccaggagacctagtcaaaggagcacaggctgggcagtccctgcagccatctgctgggcaaaaaacccaagccgtgggcactacaccaactgcatagccaaaacaactccaccatgcctggggtcctctgccattgacctcctacacaaacacaccacccatagacatatcacaaagcacagaggaccagtgggcccctagggagctgcaagtctcgtgataagctatcctttggctcgggtttcccctaagagtgagggtagaacagcctgtcagggcccctttgggcctaagaaaatgtaggtgtgtcaacagtgattggaggagggtcttccaaggcccaggaatagacttggcaaggaagtatatctctcacttcctgtctcccccacccctagagcactgtagcaaataagaacaagctgaaatacaaaagaagtgcatagctgaggaagagtctgtcagcccttactcttaagcaccatctactcaattgcagcctgaaatacaccaccaaacaaaaattctttcagcacatatcacccatgaaacacgatgcaaaaatctagccacaaattaagttcccacacagggccttgatatttagaaagcacacagaagcaaagtcattcaatgatattcaacatacaccacagtcaaaacctcaagggaaataacataaaaacaaaaagccccatacaactgacagcaacttcaaagagataaaggaacaccagccctctcaaatgagtaagaatcagtgcaaaaactcaggcaattaaaaaagtcagagcatcttattacttccaaatgactgtactgactccccagcaatggatcctaaccagattgaaatggctgaaatgacagacataaaattcagaatctggatggcaaggaagctcaatgagataaggagaaagttgaaacctaatccaaggaagccaatagaatgactcaatagttgaaagataatgtagacattttaagaaagaaccaaattgaacttctggaattgaaaaaatcactacaggaatttcataatacagttagaagcattaacaacagaacagaccaagctgaggcaagaatctcagagctcaaaaactggttctttgaatcaacccagtcagacaaaaagagagaaaaaagaattaaaaagaaggaataaaatctctgagaaatatgggattacataaggagaccaaacctacaattcattggcattcctgagagaaaatgaagaagagtaaacaactgggaaaacatatctgagaatatagtccacaaaaatttccccaatattgctagagacatcagcatgcaaattcaagaaattcagagaatccctgcaagatattacacaagatgcccccaagacacacagtcatcagattctgtgaggtcaacatgaaaaaaaaacctaaaagggttagatttcttacaaagggagccccatagggctaacagcagacttctcagcagaaaccttgcaagccagaagagattttggaccttttctcaaaatacttaaagaaaagaaattccaaccaagaatttcatatccagccaaactaaactttataagtgaaggataaataaaattcttcccagacaagcaaatgttaagagaattagttaacactagaacagccttataagaggaccttaagggagttctaaacatggaaacaaaagaatgatgcctactatcaccaagacatatttaagtacataccccatagatagaccctataaagcaactacacagtcaagcctaccaaacaacaagctaaacaagaagatcaaaacatcacatatcaatattaaccttgaatgtaaatagtctaaatggtccattaaaaaggcacagagtggcaagttggatttttaaaaagacccaatcttttgctgtcttcaacagactcatctcacatgtaatgacactcaaaggctcaaagtaaaaggatggagaaagatttctcatgtaattggaaaacaaaaaagggtaggaggttgctattcttacataagataaaatgactttaaaccaccaattataaaaaaaggacaaataagggcactacataatgataattagttcaattcaacaagaaggcaaagaaattctgaattaaatttgacacttgaccaaccagacttgatagatagctacagaacactttatccaataataacagaatatactttcttctcatctgtacatggaagatgaccatgtacttagccataaagcaagtctcaataaatgcaaaaacatcaaaatcataccaaccatactctcagacacagtgtaataaaaataaaaaatgaataccaagaatatctctcaaaatacggaaattgaacaacttaatcctgaatgacttttgggtaaacaacaaaattaaaacaaatcaaaaaattctttgaaattcattaaaatagaaacacaacataccaaaatctctagaatgcagcaaaagcaatgttaagaggagagtttataaagctaaaagcctacatgaagttaagaaagatctcaaattaacaatctaaaggaactaaaaaaaaaaaaaacctaaaataaactaacccaaaagtgaagcagaagaaaaaatataactgactgggcacagtggctcatgcctgtaataccagcactttgggaggctgaggcaggaggactttttaagcccaggagtttgagaccagcctaggcaatgcagcaagaccctgtatctacaaaaaatgaaaatattagctgggtgtgctggcatgtgcctgtagtctcagctactcaggagcctgaggtggaatgattgtttgagcccgggaggtcaaggctgcagtaagccatggttgcaccattacaatttagcctgggtgacagagtgagaccccatctctaaatcagagcagaactacatgaaactgagacacaagatccatacaaaagatcaatgaaaccaaaagttggtcattggaaaggataaagaggattgctagaacattggctagattaacaaagaaaaaaagagagatgtttcaaataagcacaatcagaaatgacaaagatgatactacaacaattcccacagaaatacaaaagaccagagagtctattaagaggaaatggacaattcccataaacacacaacctcccaaattaaaccaggaagaagctgaaaccctgaatagataaataatgagttctgatacatgggcacagggagggtaacatcacacaccagggcctgtcgcggggtggggagctaggggagggatagcattaggagaaatacctaatgtagatgacaggttgatgggtgcagaaaccaccaaggcacatgtatacttatgtaacaaacctgcacgttctgcacatgtatcccagaacttaaagtataataataacaataataatgataatgagttctgaaattgaatctgtaataaaaatcctaccaatcaaaaaaggcttggactacatggagtcacagccaaattttacctgacatacaaagaagagcttgtgcgaattctactttacctattctaaaaagtcaaggaagaaggatcctccctcgctcattctatgaagtgaatatcatcctgatactaaaatctggcagagacacaacaaaaaaggaaaccatgggccagtatccctgataaacataaatcccaaaatcctcaacaaaatgctagcaaactgaatccagcagtacatcagaaagttgatttaccatgaccaagtaggctttattcctgagatacaaagttgtttcaacatatgcaaatcaatacatgtcattcaccacataaacagaattttaaaaaattatatgatcatctcaatagatgtggagaaagctttctataaaatccaacattccttcatgataaaaaaaaaacctcaacaaactaggcgtcaaagcaacatacctcaaaataataaaagccatcaattacaaacccacagccaatatcatactgaatgggcaaaagctggaagcattccccttgagaaccaaaacaagacaagaatgtccactttcaccattcctattcaacatagtactggaagtcctagccagagcaatcaggtaagagaaggaaataaatgacatccaaatagaagaaaagtcaaactatctctatttgctgataatatgattctataccatgaaaaccctacactccaccaaagcctcctagaactgataaaggatttcagtaaattttcaggatacaaaatcaatgtgtaaaaaatagtagcatttctgtacaccaataatgttcaagctgagagccacatcaaatatgtaatctcacttacaatagccacaaaaagaaaaaatatctagaactacatctaaccaagtaagtgaaatattgctgcaaggagaactcaaaacattgttgaaagaaaccacagatgacaccaataaataagaaagcatttcatgctcataaattggaagaatcaatattgttcaaatggccatactgcccaaggcaatttacaaattcaatgctattcctatcaaaacaccaatgtcatttttcacagatttagaaaaaaaaaacctattctaaaattcatatgaaacagaaaaagagcctgagtagccaaagcaattctaagcaaaaagaacaaagctggaagcatcacattatccaacatcaaactattctacaaggctacactaaacaaaacatggtgctagtacaaaaacagaaacatagacaaacagaacagaatagagaacccagaaataaaactgcacctctacatccatctgatcttcaacaaagtcaacaaaactaagcaatggaaaaggattccctattcaataaatggtgctgggagaactggctatccatatgcagaaagatgaaacgagacccctatatatcaccatatacaaaaatcaactcaggatggattaaagacttaaatataagacctcaaactgtaaaaattttagaaaacctaagaaatacccttctcaccatcagtcttggcaaagaatttatggctaagtcctcaaagcaattgcaatgaaaacaaaaattgacaagtgggacctaattaaactaaagagcttctgcacagcaagataaactatcaacagaataaatagacaacttacagtctgggagaaagtatccacaaactacacatctgacaaaagcctaatatcctgaatctacaaggaacttaaacaaatcaacaaacaaaacacaaataaccttattaataagcaggcgaactacaagaacagacacttcccacaggaaggcacacaggcagccaacaaacttatgaaaaaatgttcattatcacaaatcatcagataaatgcaaatcaaaaccacagtaatatgccatctagcacctgccagaatggctttcattaaaaagtcaaaaaataacaggtcttgttggggctgcagagaaaagctaatgcttccacactgttggaaatgtagattagtttagccactgcagagagcagtttgaagatttctcaaagaagtaaaagttgagctaccatccaacacagcaaccccattactggatacccaaagaaaaataaatccttctaccaaaaagacccatgtgtctgtatgttaattacagcaccgttagcaatagcaaaaacatagaatcaacacaggttcctatcaatggtggactggataaagaaaatgtactacatacacaccttggaatactgtgcagccataaaaaagaatggaatcatgtcctttgcaacaacttgaatgcagttgaaggccattatgctaagtgaactaatgcaggaacaacaacgacaacaaacaaattctgtttgtctttacaaacttacaaatattctcattgtaagtgagagctaaatattgtaagtctacagacctacaaatattcccacttgtaagtgggcactaaatattgggtacatatggacataaagatgggaatattagacactggggaatacatgatggagaggtagggagggacataagtgttgaaaaactacctatttgttactatgctcacttcttgggtagtggttctgtcatattccaaacctcagcatcatgtagtatacctttgtaacaaacctgcacttgtacctccagaatgtgcaataaaagttgaaaaagaaacagaaaagtctggttggcttttaaatctctttcatcaagtcattgtcttgctcaacatcttctaatgggtctcaaagtttataaactgaaagcccaagtcattagttttgccattattatgcaatctttttctatttctccccaaggtaaaaccttaattctcacaaatttgctctacacactttcctgaaactaaccttcgttctgagcttttaattattcttccttcagcctggcaggtttctctcatctttgaatctattcaattattctaaaactacttattaagtgctggtaatcatttcatttttctactgagagacgtaaagaatctctaaaattatcttgacaaatggctgttttctaaaacttgtttaaattgtaataaaagaaagggatttttatgaaattgattcttggctatgagttgagattttgtatctttgcatgtgatcaatcttgataagtgttccataactgcttgaaaagatagtaaggtttagctttgtatgtagtagatatcatcagtgttttaagctatgtttagatattgctgctaatttttgttcctaatcgttctgggaaagcagtattaaaatttcttgctataattggatttccgtaaatacatccttataattctctcaatcttgttttattcttcatcagctattttgttaggtatataaaggttcatgaattttaaattcaggtgaattacatcttttatcattaagtatgatctaatgatttgtgattacactataatagtcttacatcatccttatcttgatcagtataacttggttgatatatttgtttacctatcgactttccacctctcagtgtcataatgtttcagatacacctcttataaatagcatatagctggattttaaaattcaatattatgtcttccaatagactactgttttcacgaatgtatttaaatttatttctgatgagttattttatattttctctttcccaagccttttctctgcctttttaatccatccctgcttcccttttgtggattgatccagttttctttatccactttttttctcctcctagtctggaaggatctttctatttgttaatattccatcttaattgttaatatgcactcttgacttaacagaattcacagtatcactcttcacctcaaaaatgaggcatgtaaaataatttaactatgttctctctccttataactcttctattaatattgtctaacgttctacttttttcttactttaaagttgttcagtccttaataatctaagtgtattcatatttatcaacatgtttaaaactttctttgttcaactttgctttttgcaaatcacatctttcttattggatcaaactcctacttactgaaacacaaccacttgaagctctttcagcaaatactcctgaataaagctctattctttgcctgaaaatgtttttatttcaccttgtcagataatttacctggatgtaaaactgaaggaaatcagttatttttccttaacactctaaatatatttcattgtcgtctgtctgatgtaaagtttaccgcaaatataactgctgtacatttgaaggtaatctgcagattacttgggaatgaaagattttgtctctgactttcaatgttgtgatcacagtgaagagtatagatttattttttaaatcctattttggaagcaatataattctcattctgaaattttctgatttttttatttctggataattctatcattaccttttcaaatgttgcgtttagctcattctttcctacctgtctttctggaactcctactggatagacaccagacctttgcattgtagtctcgatgtctcttaaccacacttaaatctggttattcccacatacctactttctaatcctccatttctacctctggttgtgtctaatcagtttttaatccactcctctaaggaccctaaatccaggtcctctccaggggagtagaaaaggataatgataatgaaaggaaacatgggtagcttctgagttggggtattttttcttagcctggttcatgttgaacagatgtttgtttaaaataatttgctataccacactttatgctccatgcactttcaggatatatattatctttctataaaaaatactcaacagtaaataatcagtaagttaatagttactcatgttaaacatttcttgtcataaactcttctctttcatctttaattttttggtataaaatgattaacattttgacagacatttttacccatacttttctttattctattctttctttttagatttctttgttttcctttcaaatacatcttagcttctttagtcactatatttgaaacttttatgtcataagttaaaacaggcaatgtgattttttcacttgtttctttctaaatactagtgagtatctttgtaaccttgaacacaccattttaaaatttaaattgtaagaaagcagaaaaagcagttttaagacattacaagcagcgatttctgtttatcaagtgcacttgagcaatctaaagaaggaaataaattgaacacttctatcaattgaagtctttctcgtgggctagtttccagatttaatagtattcataattgccttctatacaagctatttttaacctacacttactagactttttacaagaatttaaaacacatggctgagtttctggctacaattataaatccaaattacacacaaaaagcaaaaaagttgtataatatattttagaatgttttatacaaacaagcaaaaaaaatcagagttgattatacacgtgacaaaagaaagtcagtgaaagtctgtgcaagaatggaagggacacatgaaaaccatggtaattatcattaccataactaatgataatataattgtccaagtgctatcgttgaattgtattaggtatatagtgcacttaatgtttctattttatgttaactaccagttcagttttaaaacagatatacaaaccaatggaacagaacagaggcctcggaaatagtgccatacatctacaaatatctgatctttgacaaacctgacaaaaacaagaaatgggaaaaggattctctatttaataaatggtattgggaaaactggctagccatattcagaaaactgaaactggaccccttccttacaccttatacaaaaattaactcgagatggattgaagacttcaatgtaagacctaaaaccataaaaaccctagaagaaaagctaggtaataccattcaggacataggcacgggcaaaggcttcatgacgaaaacatgaaaagcaatggcaacaaaagccaaaattgacaaatgggatctagttaaactaaagagcttctgcacagcaaaaaaaaaaactgtcatcagagtgaacaggcaacctacagaatgggagaagatttttgcaatctatccgtctgacaaagggctaatatccagaatctacaaggaacttaaacaaatttacaaaaaaaaaaaaaaaagcatcaaaaagtgagcaaaggatatgaacagacacttctcaaaagaagacatttatgcagccaacaaacatgaaaaaaagctcttcatcactggtcattagagaaaagcaaatcaaaactacaacgagataccatctcacgccagttagaatggtgatcacatttaacttttttaacatttgttattactatttaattttatgctcacaggtttttggactcattggttttatgttttatcaaacagtaccatgggcataaaataaatgactagccatttaaataattttgcatgtcatttttgccagtttgcttaaataatcctatactgatttaccataggaaagttgcaatgtcaaatacgaactatcagtttaaatctgaaacaacttagatgtggctacatcaaattatattcagctttaaaacaaactagtttgttattaatcccaacatttccttctagaaataacacagaattattttagtcagtttcagaatcactgaggtctggaaatgcataatttttttttttggttttttttttttgagatggagtcttgctctgttgcccaggctggagtgcagtggcacgatctcagctcactgcaagctccgcctcccgggttcacgccattctcctgcctcagcctcccgagtagctgggactacaggcgctcaccaccacgcccagctaattttttgtatttttagtagagacggggtttcaccgtgttagccaggatggtctcgatctcctgaccttgtgtgtgatccgcccacctcggcctcccaaagtgctgggattacaggcatgagccaccgcgcccggccggaaatgtgtaagttttaagaaaaaggccttaacatagcttgagtaagtcaacagataaaagttaaaaggcattttatctttaagaaactctgaaaattttagtaatttcttctctagataaaggagttaaattgagttaaaaagattgctggaatcagaaggagaatcacaacccatgtccatgctcagtatttacttgttgtgtatccaaataatctcaggtttggggtttccttccgcccggcaggtgaagtagacggtatttcctgatggtacctccacatcctgcggctcaaaagtaattcgggggctctctgcaacaaaagaattattgatgtatttttcagagatacaaaattatggccttccaagatgctgagaaagagatataggcaatttaaatttatttctacattaaagttttacacatcgaactgcatttacccggtaatacatgtaccaggttagagattagacatatatttgacttatactttagaagtttgaaaaattcactgcacaaagggatctccaatgaagtaaattaagtaaattttcctgtgcttttatttctaggagctcaatacaaccatatttatggaaggagtttgattttatgggtcaatttttcaaaccaagtacttaaactgagcttgcagttttgcaggcactcttcctagacaattagctatctaagcacccaaccacccactttacacaatttacaacaagtgatatgtctagacctcaaaactggttgagcaaaattcttatctatataaatgaatgattccatcttccaataataattgagtggtaaaacatgaaaacacttaaattatttcaataagaagatggagtgattgattttgtaatgaatcaggtagtattattgaacttaaattataaagaacaatgtacaaaagggacttttagttttctatagtttcacctaattctctttaaacctttctaaataataaaactcttccttttataagtgccttatctgaaatttcctgtcattaaccatgactattatgtctgtagaacattccgtagatctttagtaatcttgcttacttcattaaaactccatataattaatatcttggctttattctttttagataaatgattttattcatttgtgtaatttaaaaaaaaattcaacgtcagttatgtgccagacaaggcgctaggactagtgatgaagcagtgttcaaaatagacaaggtctctgtaccaaggggtttacagtttcattgaagcagtagaaaataaacacacacacacacacacacacacacacacacacacaaatacatattaacatatgcggcaaatgcttagatggaaaataaacgatgttttgatggattataaaaagggacctgattcagtatggagggataggtaggtcagtgggaagggggtttgaatgaaggctttccatgtaattcatatttaaaaggaggaccattaaaagaagtagaatcagaatattgtaggcaggaaagacagcatgtaaaaagtccttgggttgaagaaaggcttaagaacttccaagaatggagaacactgagttggctacaacactgagaaaagagtaagtgactggagggatagcattaggagatatacctaatgttaaatgatgagttaatgggtgcagcacaccaacatggcacatgtatacatatgtaactaacctgcgcactgagcacacataccctaaaacttaatgtctaatttaaaaaaaaaaaaaaaaaacagtaagtgactggaggagcagagtgtagccagcaaggaccgtacaaaaagaatcaaccatgttaagaattttgtgctttattttaaggtaggaacctgtataaggattatagatgaagaaatgatgtattaagatgtgtttttaaacaattttcccaaacataaaggagcaagaaaaatgaaagctgggatatcagttaagatgtgaagcaatccagccaaacttgactgtggtttgaactggaagttagtagtaaagatgggagctatggacaagcttgagaattttttggcagtaaagaccaagtcaattttcttgtcaatttgaatataaattaattatattgatatgatttttaattacttgtttagagaaattcaaaaaatggcttgccagcgagggagtggaaagcaaatttttgctgtaattacagcagtcatgtgagtgaatctccaagacacgaattatcacacacatgcacacacacacacgaaggtattcatttatttctatttaaaccgaaatataggaatagagatacatagagacatattcttatattcacatgaaaagctttaaatgaaaatcaaataatattgtaagcagccgtaataaattatttaggtaaagcttattgctttagtaaggttgtcagaatataaccatatgcttattaaatccaaggtttccattatttaaaaatttacaaagagatggtaaaactgattttcattattttagtcgtattcatggtcccattatacatttaaaaaatcaattactgaatttgttgagggctttctcagcaatgaatattagcaattatttgatttaaagttgaaacccctaaattactgattattaacactaagtcataccaaggaataagtggagattttaacgttggacaccacttctggtgaccttgttgaaaatcagttttctcaatatttctcctctgaaattacggaaattagattaaatcttcctcaaagactctctcagctcttaattttatgttgataaaaacttctttaaatgaaaatgcagatgatggaaaggaaattggccatacttttaccacattccttaaaaacactttctgataacacgttcttctaaaatgcaatattatataataaacctttacaaaaagagagcaaatgagagacagttctatcttatgtacacattgaaatttacgtacggcaattgaattcctctactgttactgaagcaactgcacgcccatggagtctcctgggatattcgcaggtagccgcagcctgggtgtggccgtgttgggcaaagccttgtaaaagctcccccagccacatcagatcacagtcacaaaccagggcgttggaatccagacgcctaggcatgcaggcaagaagtacaactgttaaaagggactattaatttctatgatgaatcttttgagtggtaatatttaatttcccctgatttaccttgtctgttacatttttgactccaggattctattaaccaataaacagattttaagaatcacttaactcattgcatatcttgcacagagtagacacattttcaaattaaccatgtttttgagaagccactttaaaactggaaaagtggttttcccttaatgtgcactatgtctattataaataaatgtgaggtgaaatgaatccttatttgtttcagagaaatgtagaattaaaactgtaagtatggccaggtgcagtagctcatgcctgtaattcaagtgctttgggaggcctaggcaaaaggatcactcgaggccaggagtttgagaccagcctgggcattctagcaaggctccctctccaaagataaaaattttctttaatttctttatagtttcaacttttattctagattcagggggtacatatgcagtttgttacctgggtatattgcataatgctgaggtttgcggtcctattgatctcatcaccaaagtactgaacatagtacccaatagttttgcaaccctcacccccctccctcccttccctcaccagtagtccccagtgtctatcgttgtcatttttataactatgagtacccaatatttagatcccacttataagtgagaacatatggtgtttggtttactgttcctgcattaattcattacttcattcttttttatggctgtgtctacaattttttagttagccaagcatggtggcacccacctatagtcccagccacttgggaggctgaggtgggagaatcacttgagcccaggagttggaggctgcagtgagctatgaaggcaccactgcactccagcctgggtgacagagtgtgaccctgtcccaaaagcaaaaacaaacaaacaaaaaagctgtaagcactgaagtgttccagtttgctttgtttatgtgttacagaacaaggaagctgtaatgtggtggtggtatttcaatatttttggattactcaaaagagtggtagaagctttgctgcccaaaggaggcttataaatgtgacgtgtgatccacgcagctcccccaggagttggcttttttcttttgtaaactccttggcatcaatatggataggcatgtgttctctgtgttttccacttgctctaaaggacagaagccaagctttccttttttataatgctcaaagtcccagttagaaggtccccctctggaattgctacatgtagactgtaacaggaaggcgatggctcttttcatttctttatggtgtttcctaagataggcacacaagttattcatttttgccaagttatactatacttcactaatttttctgtcacatttttcctcatgaaataaaatagatcaccaaagagatttatgatatacctccattcttgccaaaagatgcgtggcaaaaaggcgcagaaatgattaatactttttttcatttctcccaatgggttaaaaagggagcttttgctaagtagaattcacaagtctgtctatggtggcagttggatcacactctatgcaaggaagtccagcaataaaagggtaatgtgaacatattttatgataggtgttagattgcttatacctgattgtaagaagtagtgtccaatgtgactggaggagaatacaaaatgccataaatttaataacttttaatcaaaattattcatgcacaaaaagtccttacaaacatggaaaaacaaatacacaaacacaaattaaatctaaagataccaatttgcaaataaaaaaatcacttcattgtattaatttggaaatttgcatcaatatcacgttactggaagagacaaacctgaaagtaaagaaattgtgctattctctggatttagaaactaaaacacttcctaaaacaactgtatacattttaataaattaagaaagttttattatctgacagttttgtaaaatgttttgtagatacccaattcataagactaatttttataactgtatctaaattttattatattaccctgaaaatgatagctatgtttagtagctttaaattgctaaagggaaaacatttgcacttattgaaaagttagttaaccatacacatattatttgcttaatgtttccaacaagacttcacactaacgtgagaatataaagccatggctaaagtagggaattctgtcagccttgtcgggagtgaggtgtaagtcataaaagtcaactagcccttgttcaggacagcgctgttggttcagtgggcctcggctgttccttgtcactgactgacttattgtaccagctacgtggctataaaacaaatctagttcaacagtattgtgttcgaagttcacatttatattttgagtttaatttctcgtaattttatcaaaaaggaacatgcaagaacttactcctctaaatataaaggagtaagttctcacttcagcatcaccatgacgttcctctgacttgaacataagcaaggatgtgaatacacatcccctgggagcatcccgagcatggcagcctcaccatgcaattgccccatcttccagaggtcatcactgcttgctcatcaccttccctcagtcataccttcccttaacgcaacctcatgcttatgtgttttggtaataactgagcacaagatttcatttctttctaattattattttcaacttaagatatcaatagtggggatgcaaaacatgaagaaaacaacaaaaggatatagattttcacttgccagtcgaaaaactccttttatgttcagaaaataaaagtatacttttagtatagtatagtataaaagtatagtaaaagtatacttttatatgataatctgagtaatctttataaataattttcaaatttatcatgagaaaacgttttcaaaattttgcctgtaatttagagccatgaatattgaaaaccaaggagcaatagagtcaatcaataagaaagatggttcttatgaatctttattagactatactaaatattgaatacactatgtttaaaatcattatcattttactgttctccattttgaaagtactcttacatcaaatatcataccaagtataataaataaaagccctctgatggtatgcagtcaagaaccacagcactaaaataattactcacttggaatatattctctgctcaatgaaaaatttcaaaggaaataagtggtgctaggtaaattaatcttttctatttgaaaacagtaacacctcacttgtacttacacaatccctttcacttaaagatccaaaaacacttttaaacaaaacaaaatcaaaaacattttattgatttttacagtccacttgtgaggagtgtagttgtcatgagttagaaatggcatggtacagatggagaacccagtgtcgggtgatccttcaaagtgccacgcccagagtcaagggcagaattcccgctggtttctctgccctcacaagctatcagtgaatggacactcctcagttgaaaaactttattgttgaaggtggaattcatttaatagtaggtgtagccctctattgctctcctgtattctgttgttctcatctaaattgtagccaaaataggacaggagttgaggatttggaataaacaggtgcccagtttccaccccgtcttggacccatcgggacttcatggaccctgagcaggttgctcaaatcatctgtatatcagtttcccataaaataaattcataacataaagatagtttgtcaaaataacaaaccaaaaaaatcatcttaaaacatttggaataagcacagtgcatgcatgtaaggtgcatactggcacatcactgtaaggagaactccctcagcctctttattggcagttatttttgcatgtgtgttccagcaattgagtgaatgctgtttcagtaaatgtaagaggaggctagaacaaaaaagctgctactaagatttaacatgaaagaataataaaaagagattagaaaagactaaggaatttggcacttcaagactttctctgagtcacagaaggcaagaatgacccagatagaaatttatgtagacaagaaacactgcatgggaattataattgcaaatatacaaagacagtgactctaaccataactgatgtaacaaatccaaaaaaggagagaaaacagacaagtagaaaataatacacaatatttctcccaccaccaaaatggaacatcctatgaccctgttacaaaatgtcttggcattttgcatatcccacataggattgaaaaacaagaataaatggatgtgttattccaaatggctgttgcagccagttctgacaagtaagaaaactttggcaaaaagcagagtcatcatggatggaactggaagccattatctttagtgaaatagaaagaggaagtcaaatgtctcatgttttcaagcttacaagtgggagctaaataatgcatgcacacggacgtagggagtgaaataatagacactggacactcaaaaaagtggaagggtggggtgggagtgagggatgagaaattatctaatgggtgcagtgcacactattaaggtgatggttacactaaaaacccagacttcaccactatgttatatatccatgtaacaaatctgtacttgtacccctttacagatagattagatagacagatagatatggtcagttgatgaccatatccaagacttttgagggcttggatacaatcaaagaacaccaagaagactgggaagcagcattatgtgtgtctgacatgagaattaccaagaaagaaggaaataaagacttgaagaaaaggattaggagtgggtgaaatgcctccttgattaaactcaaagattacaagcattatttctgggcacaaataggggcctggatttattttcctcagggctctgatttttacttaatcataacattcttttgctcatggacctgtgtctaggaacacaatattagaagagcaaccacaacaaaagtggcctctgtattaggccattcttgcattgccataaagaaatacctaagacagggtaatttataagaaaagagatttaattggctcatggttctgtagactgtacaggaagcatagtgccagcattagctctgggggaggcctcaggaagcttttactcatggcggaaggaggagcagaagcaggcacttcacatagtgaaagcaggagaaaaggtggaggatgccacactttataatgaccagatctcaagaaaacacactcaatattgggaggacagcacccagccaggaaggatctgcccccatgaacctcccatcacgccccacgactgacattagggattacaattgcacatgagatttagaggggagaacatccaaactatatcagcctctgatatggtttggctgtgtccccacccaaatctcaccttgaattgtaaaaatccctacatgtcaagggtggggccagctgaagataattgaatcatgggggtggtttcccccatactgttctcatggtagtgaataagtctcacaagatctgatggttttataaatgggagttcccctgcgcaggctctcttgcctgctgccatgtaagatattcctttgctctttcttcattttctgccatgattgtgaggcctccctagccatgtggaaatgtgagtccattaaacctctttttctttataaattacccagtctcatgtatgtctttattaacagtataagaacagactaatataataaattggtactgggagtggggcactgctgtaaagatacccaaaaatgtggaagggactttggaactgcataacaggcagatgttggaacagtttagagggctcagaagcagatagaaaaatgtttgaaagtttggaacttcctagagacttggagggctcagaagacaggcagatgtgggaaagcttggaacctccgagagacttgtttaatggctttgaccaaaatgctgatagtgacatggacaataaaattcagactgagggagtctcagatggagataaggaacttgttgggaactggagtgaaggtcactcttcctatgcaaagagactggtggcattttgccccgccctagagatctgtggaaatttgaacttcagagagatgatttcaggtatctggtagaagaaatttctagttagcaaagaattcaagaggtgacgaggcataaaaattttggaaatttgcagcctcatgatgcagtagaaaataaaaacccattttctgggaagaaattcaagctggctgcagaaatatgcaaaagtcatgagggaccaaaggctaatcaccaagacaatggggaaaatgtctccagggtatgtcagagaccttcacagcagctcctcccatcactggcctggaggcctaggagggaaaaatggtttcatggactgggcctagggcccccctgatctatgcagtttctgaacatggtgccctgcatcccagctgtttcagctctagccatgactaaaaggggccaacatacttctgaggccattgcttcagagggtgcaagtccaaagccttagaagcttacatgtggtgttgggcctgtgggtacacagaagtcaagaattgaggtttgggaacctccacctagattttacagaatgtatagaaatgcctgaatgtccaggcagaagtttgctgcaggggtggggccctcatggagaacctctgccagggcagtgtggaagggaaatgtggggttggagcccccagacagagtccctactggggtactccctgcctagtggagctgtgagaagaaggccaacgtcctccagatcccggaatggtagattcactgatagcttgtactgtgcacctggaaaagctgcatacactcaacacaccccatgaaagaaaccaggagggaagctgtgccctgcaaagccacaggagcagagctgcccaagaccatgggagcccatctcttccatcaatgtgacctggtcgtgagacatggagtcaaaggagatcattttggagctttaagatttgactgccccactggattttggacttgcaggggacttgtagccccttcattctggccaatttctgccatttggaatgactgtatttacccaacacctgtacccccactgtatctaggaagtaactaacttgcttttgattttacaggctcataggcagaagggacttgccttgtcttagatgaaactttggactgtggacttttgagttaatgctgaaatgagctaagactttgggggaccgttgggaaggcatgatttgttttcaaatgtgaggatatgagatttgggaggggccaggggcggaatgatatggtttggctgtgtccccacccaaatctcatcttgaattgtaataatccccatgtgtcaaggggactaaatcatagaggcagtttcccccatattgttctcatggtagtgaataagtctcatgagatctgatggttttataaacaggagttccctgcacaggctctcttgcctgccaccatgtaagacattcctttgctctctcttcatcttctgccatgattgtgaggcctccccagccatgaggaactgtgagtccattaaacctccttttctttataagctacccagtcatgggtacgtctttattagcagcaggagaacagactaatacagcctccaaggcccatgatggatacacctgtgtgagttttccactatgtgctctctgactgacatctgggaagcaggcatctatctttttctgataactggaacttatacttgtgtttggggttgaggattagtggagggggtgggtaaccacaaaataaagacatcaacagtgtagaaggctacacacagatgggagtgaagagacagctggaatgcaggagggtggagacacaggtggaaaaaagtgatggacatcagcccacggatgggagcagggaagctgtggagaacacagaccttgcaagcatggggatttttgttttgttttgcttaatgtaggaggaaatgagtaggaagacaactccgtacaacaagggaaaactgaagcctggcccgaggagtcagactttctttggaacttctcacatctcttatctcatgaaaaagttaaaggaaaaagaagtcttgggagcctttagatttagccagcaaggatattacagagaaacgaggaaaacgtctattttcaatactccttttgaatgtcacttctaagagaatacatgaaagcccagaagactatctgggttctctatcgctctgcagttaacaaaaccattttctccctaacatgctagaattgcaatgtctttcacaggaaaagcaggagaaggcaaccaaccattgtttgggatggattttggaggaaattataaaaggtttttgtgttaatgcacttgctttcacttacaatctttttaatgaatccagattagaaaagctcccagctggaattttagataatttgttgttatgcaaaaatctgaaaaagaaaagataaactttaatcaccatacaataataatgaatttgacaaacaaaacctttctttcacctaactgtgaatccaataccttttttgaaatatttcagtgagaaagggcaaacagaagtcagagtgtcatttatacaaccatctgttttaaagatttacatatctctatctaccactactatatgggtattttttcacatctgtgtacttttgatttttttagtttacttagttacagattacaaatgctaaagagaaatacataaaaataaatatttaagtatgaggaaatcaaagtaaatagtcaatgtattcattatcagcaggcaatgtatacatatatcaaatcagcatgttgtacaccttgaatgcatacaatttttatttgtgaactaaatattttaaatttaaatattttaaatttaaaaatacaggcgtggtggctcacgcctgtaatcccagcactttgggaggccaagctgggcggatgacttgaggccaggagttcgagaccagcctggccaacatggtgaaaccctgtctaccaaatatacaaaaattagccaggcatggtggcaggtacctgtaatcccagctactccagaggctgaggcatgagaattgcttgaactgggcaggcagaggttttagtgagccgagattgcacccctacacttcagcctgggtgacagagcaagactctgtctcgaaaaaaaaaaaaaaggcacaacaatatatgacaacagatgcctacagatgtagcatgagtaactgttgtaatcctgcaaatgtgggatcacatggagatgtgcaagctctgcctgtcgcttactggccagcacagttttgctgatccagagtcccgttgggtgctgctatggttactgctcagccagccatttctacatgtccggagctggatcacagagaggtgcacttatgaggtcatgccccatgccaggtgatggaaggtggcgggagtaggagaagatccaggcctcagtacctctccctctccctccaccctagtagtcttgcacttgctttggctccctccatgctgccttggctatacccattcccctcattatgaccagagaaattatgaccaagaaaagcaccagccagggattgtctagtcaccaggactactgaatacatatttggcaaagagcctatgtgtgaagagagaaaacacgatggtctctgcaatatagagaaaagatggagaccagttttcttaagactcaaggatatgagcataaataatcaatttatatctgaaacttaactattagctacatccagccactttatgagctgtacttcatgactagtatctctgtcacaaaattaaataaaatcatgtggccatattttcttatcagtgttttggctttatgtttttggctttattttaactgtattaagtgttaaggtcagggggagtgagctggggccaaactatttctactattttgggaacttgaatttcactgatgcacatctgagaagataaaaagttttcctgatccttcctgttttgattccctgtgcttatctttaccggccccatctaatttacccaactcagaagcagtagctagaaaagaaatgatgatgtgaagatggatattgacaaagactctcttcttgaccaaactctactcaggttctcctgagctcttttccaactagtcctgactttcggatttccatgtccatctctacattgtccgattttagcaagaaccctgctgctaagtttaaccagtacctcccaccccttgatacctgaaattcctcatccccatcatttcccaggtgatatttgatcatcaccaagatcatcaccctatcctgttaaatagggtcagcctgagcctttctcctaatgtttcctctgagtaattttccatccattggctccaccctgctcctgggctatcaactcccacttgctcatggcgtatttggagttcagcccaatctttctccctcagtgcaaaactccattgcactggtccctatacctatcaccatggtcccccttgaataacatctttcttgccatgctttaacaagtattgttgaataaccttttcttcaacagtgtgcagatggatgacacagtaattctcattctctaccacaagccctagccatatgccatttccttatcttaaggaacactggaacagagtttcatgatggagaaacagcttatagtagattgcactaaacctcgggaaaagccaaattaccaggacaatttatgcctgctttatttttgctaggtaaaatgaaagctttcttcattattttataagtggtgcagttctgcaagataaccacagtagaaagactgttgttctttctttaaacgtattttagaggctggaaattgcatccatgattgaatattgaaagatattatctattttccaatccaagcagaccagaattaattgcttaacaggcaaaacaaatcaaaagaaaagtaaaacatttccatcatcacagattttgaagcaaggtatgtaaatattgaaaaatcattcttgaatttttttaattttgtacaaatggtgacaaaatatccaaattaatgatattttacatcagtttatatcaaacatgatatatgattcccaaatcagatattactgctacttgatatttctataacaacttgctttcaagcagattaatctaagtctcagtccctttatgtataaaggaaaaattatgataataataactgtcattggttatctcctagaatactatcccagtagtattcagtaaattaaaacagtagtactgttccagcagtactgatttgcatggggtgcaaaaatgtatgcttgtagtttcctttttttctttcttctttccaactttcctgaaattaattttcaaaacagttatgcaatgtatttgttgatttctgcttgtagatgactttgattgctttactcccaacaagaagctaaaaagcacttcttcctatgttaaaaagtttatatatatatatatatatatatatatatatatatatatatatatttttttttttttttttttttttttttgagacggagtctcactcttgccaggctgcagtgcagtggcacaatcttggctcactgaaacctccgcctcctgggttcaagcaattctcctgcctcagcctcccaagtagctacaggcgcatgccaccccgcccagctaattttttgtatttttgtagagacggggtttcaccatgttggccagaatggcctccatctcttgacctcgtgatcggcccgccccggcttcccaaagtgctgggattacaggagggagccaccgcacccggccgaaaagtttatataattatttgctgctgctgtcttctgtcaaagatgcttgatcaaaaaaataatatttgagcagtatctacttttatacaaagtttatacagagtttatacaaagacttgtctccttcctgtgacagaaacatgcatattatctaaaaaagtcaagtcatgaatgagcattttcctcataaatgttctaagaaagtaaatcttctgcctaaggtttaggttaatgtttcaagatgtatcccttgaaaatccaggagacttttgagaagtagagttaaagtcatattcagctcctactccttgagaaaacttcgtgaaatggcctcagctttagtgaggtgcataccagatagagaaaacattgtccagtctggtcgactctgtgttctttaataccaaccataaatttttagccaaaaagtccaaattctgtaatgcttgacatactttaacgaaagcactcattcaattttctgccggagcaccaagctctaaagtaacttgaacattttaaaccacatggctccactaaatgtgcttggattcttttgcttggtaacgtagtagtaagaagttgattgtgtttgaagataagacttatcttttggagaaaacctaacttggtaaagtgaagattttcaaatcaatccttcttttaatagaaaagaggaagatgcaggactttcttgattgtattgagatcatgacttcattgaaaagaacattcctatccaggtgttagaggttagtacttatgaatgtaacacaaaggcgcttttgtcaaatcataacaataaagaaccattctaggcattgtgctgctcctgctgaacgcacattactcgactatgtgcagtctgcagataaagtcatggtaaatttgcttgaatttagaaatgccttaataggataattttagcactaaaaaatattatttcagcaaacaaatttcaaagttccggggaaaagaattttagtccaaaatagtgaagtagatatgcaaatcttcctcaatctcttttgaatctccattgaaataattaccaggatgcttaataagaaaaaatatatccatattcaagagggcagaatgtggaagttcaccaacagataagagtattcagcaaattctggaaaaataaaatacatgagaaaatgttgacagatgaaataggagagaaagctgcagcccagagaatcctatgaggcaggagcaatctgactgtgtgtcgcccagagaccccaaacagttacggcaggggcagaggagggagaagtgagattgcaaacaagggttcacaaagacctggatggagaaacacaataattagtagccaccatccatacagaacaccgacagctaagaggaaaatgttattgacatactgatagatgagacagacatagaaatagagattttttccaaagaaattgaacaaattgaaagaagaaaagtaacggaatttttgtggagctgaaactcaagagaaaaagccttcctcattctggaatttaggaagataaatctgcattttacatccaattgttcaaactaaaatttacaccaaagggaaaattttgtaagaaaataaacttatctaaaggagagcaggtgaaactcacactaccaattgaaatgctattaatttcaaatatcaatagacaatgaagaatcacaaggcatgggaggttaattaggaacatgaaaaagaaaggccaagattttcaaaaaggaaaacaatgccagaagaaacagggaaattccaagaactagagaaaaagagtaagaaagcattacaattattacatgtactcagagactgcaatatgtatcatacttgtaaaacaaggataagtttctatagaagacaaatcggaaacaagaaagatctcttaggaattaaactctgattaaaaaatgtttttatgtagtaaatgttaaaaagtaagtaaaacataccaggttaggaatcaaaatgacgaaataacagatattatgaaacaaaagataaaaaatacagagatccagatgatctaatattcaattaaggtatctctagaagagaagacagaaagaataaagggaaacatagtcaaataaataattaaagagaatctttcaaaattgtggatggatttgtctttacattgaaaactccaataattgaaaagtctcattccttgatgtaaatttataagatcttatttttattttaactatatgtttatttagagacaggttctcacccttcactcaggatggagtacagtggcccaatcatggttcattgcagcctcaacctcctaggctcaagcagtcctcctgcctcaccctcccaagtagctgagactacaggtgcctgccatcatgctcagctaatttatttttattttttgtagagattgggttttgctatgttgcccaggctagtctggaactcctgggctcaagcaatcctcccacttcagcctctcaaagtgcaggccattacatttgacctgtaagatttttaaaaataaagaataatcataaaattttaaacctctctgtgaaaataaaattgatttcctataaaatagaatcataataggctagaagaaatagaatggattcttcaaagatcaagggaaacttcttgaacttataattttataacagacaacctatcaactaattatgaggaaataatacatacaatttcaggcattcaaggattatcaaaactatctcccttaagccttttcatagcaagttcttcaacatgtattccagcagaacaaagaagtaacacaagaaaaaggaagaatggagaccagaaaccatggacttcactcaagcaattagtgaagggaaatcccaggtttatggcaggtgacactaatcctaatgaaaagccagttcaaattagaagacaggggtctctggtgtaaaagagaaatgacatggtttatataatttgattgtataaaaaatgtgaagatattgcaaagacacataatgcatttagaatgtccaggaaaagcaaaaattatgtaagaaaataacagttcaaatatgaaccaaagacatgacattattttaaataatttaaatcacacaagaaaatagcccttttattaagacaattatttttgaagtggccagatttataatatttacacatagagaaagaaataaaatctgagcatgtttcctgatcctacaataatttagttaaaatgatatatacttctaattgttcaaggtaatttatggtcaacagcaagaaatttcattgtagttgcaggaaaaacgttgaatatctgagtaatataaagataataacatagctaacagagtgaagatgtaaaaggtgaagaaaatgcaagtatgggattgggtagtagtttcaaaactttaaataaagaagacaggctatcaaaattaatgccacaagaattagaaggtcaattacataccaatgaatggacgaaatatgtatatgtatatatatatatttagtggactttatttatgagtcacatatatatatacatatatatacatatatatacacatatatacatatatatacatatatacacatacaaatagttcactcatcagtatgtaattgactttctagtgtgtgtgtgtgtgtgtgtgtgtgtgtgtgtgtgtatcacacaggggtagcataagcaagataaatcctcatcttcagagtgaaaattgatatctcctacagttgaaaatgaatgaaataaaaatctattacctagctgtgatggttaatactgagtgttaatttgattggattgaaggctgcaaaatattgatccttggtgtgcttgtgagggtgttgccaaaggagattaacatttgagtcagtgaactgggaaaggcagacccacccttaatctgagtaggcaccatctaatcagctgccggcgtggccagaataaaaagcaggcagaagaacgtaaaaagactagactggcttagcctcccagactacatttttctactgagctgcattcttcttgccctcaaacatcagactccaaattcttcaagtctgggacttagactggcttccttactcctcagcttgcaaatggtctattgtgggaccctgtgataatgtaagttaatatcccttaataaactcccttttttatacatctatctatcctattaattctgtccctctagagaaccctaatacactagacaattatgatggcaacaaccaaagaatataaaagagaaatacctaaaagaagctgcctctggagagagggtccaggctcgagttttctttcaggagctctattttatgatatgatttgatatcacatgtctgtactacaaggttaaaatagatgcaaatatatttagacaataggaaagaaaccagaagctaaaacttttttagttagtccattccctgccttccaagcccgctgatggatcccaagctaagaagtcccttctataaaggcaaaccccaccaccactgccatgggcctgcctgccagggcttccacacctccccaggcagcaggactctccccttcccatcttcacagttttcagggctgctgttggtgaggactttgaatcttggtggtttattggctacacgacaaaaatacaaggcttggtggtttattgctacaccacaagaacacaaggttaacaatgtgacaaagaaatttcccccaaattaaagttggagtcccatgtcttttgaagttattaaccattgtgatgctaaatcttgaacaatccatctgtcttgcaccagggctgtcctgcacagggctggctccctgctcacacaggttagagcagaaaaggagtagtataacacactttcctacctcatttcatattcatgatcacatgtctccagcacaaagcaaacaaaagcaaaccatgtgattttatgccttgcaactgctatacttctataggcaaatgaggttgcagtaactgcataagaaagtggttgactggctcttcttagcctttaattttactaatttattttgtatattaattaagggcatccttttttaaacataaatttttaattcaaattttctttaagggaaaacatttttctgcttaaggttagctatgtaattctgcattttctttcttttcagagagaaatagcatatcatcagctagatacagtaaatttattggggtggagccaagatggccaaataggaacagctccagtctacagttcccagcatgagcgacacagaagacaggtgatttctgcatttccaactgaggtaccgggttcatctcactggagagtgtcagaaagtgggtgcaggacagtgggtgcagcacactgagcatgagccaaagctgggcaaggcatcacctcacccagaaagctcaaggggtcagggaattccctttcctagtcaaagaaaggggtgacagatggcacctggaaaatcaggccactcccaccctaatactatgcttttccaatagtcttagcaaatggcacaccaggagattgtatcccgcacctggctcggagggtcctacgcccacggagcctctctcattgctagcacagcagtctcagatcaaactgcaaggaggtagtgaggctgggggaggggcgcctgcgattgcccaggcttgactacgtaaacaaagcagcccagaagctcgaactgggtggagcccaccgcagcgtaaggaggcctgcctgcctctgtagactccacctctgggggcagggcatagccaaacaaaaggcagcataatcctctgcagacttaaatgtccctgtctgacagctttgaagagagtagtggttctcccagcacccagctggagacctgagaatggacaaactgcctcctcaagtgggtctctgaaccctgagtagcctaactgggaggcaccccccagtaggggcagactgacaactcacacggccaggtactcctctgagacaaaacttccagaggaacgatcaggcagcaacatttgctgctcaccaatatccactgttctgcagactgcgctgctgatacccaggcaaacaggatctggagtggacctccagcaaactccaacagacctgcagctgagggtcctgactgttagaaggaaaactaacaaacagaaaggacatctacaccaaaaccccatctgtacgtcaccatcatcaaagaccaaaagtagataaaaccacaaagatggggaaaaaaacagagcacaaaaactggaaactctaaaaatcagagcgcctctcctcctccaaaggaaggcagctcctcaccagcaacggaacaaagctggaaggagaatgacttttgacgaattgagagaaggtgtcagatgatcaaactactccgagctaaaggaggaagttcgaacccatggcaaagaagttaaaaaccttgaaaaaaaattagacgaatggctaactagaataaccaatgcagagaagtccttaaaggacctgatggagctgaaaaccaaggcacaagaactacatgacgaatgcacaagcctcagtagccgatttgatcatgtggaagaaactgtatcagtgatggaagatcaaatgaatgaaatgaagcaagaagagaagtttagagaaaaaagaataaaaagaaatgaacaaagcctccaagaaatatgggactgtgtgaaaagaccaaatctacatctgactagtgtacctgaaagtgacagggagaatggaaccaagttggaaaacagtctgcaggatattatccaggagaacttcccaatctagcaaggcaggccaacattcaaattcaggaaatacagagaacgccacaaagatactcctcaagaagagtaactccaagacacataattgtcagattcaccaaagttgaaatgaaggaaaaaatgttaagggcagccagagagaaaggtcgggttacccacaaagggaagcccatcagactaacagcggatctctcagcagaaactctacaagccagaagagagtgggggccaatattcaacattcttaaagaaaagaattttcaacccagaatttcatatccagccaaactaagcttcataactgaaggataaataaaatactttacagacaaacaaatgctgagagactttgtcaccaccaggcctgccctaaaagagctcctgaaggaagcactaaacatggaaaggaacaaccggcaccacccactgcaaaaacatgccaaattgtaaagaccatcgagactaggaagaaactgcaccaactaatgagaaaataaccagctaacatcataatgacaggatcagattcacacataacaatattaaccttaaatgtaaatgggctaaatgctccaattaaaagacacagactggcaaattggataaagagtcaagacccatcagtgtgctgtatttagcaaacccatctcacgtgcagagacacacataggctcaaaataaagggatggaagaagatctaccaagcaaatagaaaacaacaaaaggcaggggttgcaatcctagtctatgataaaacagactttaaaccaacaaagatcaaaagagacaaagaaggccattacataatggtgaagggatcaattcaacaagaagagctaactctcctaaatatatatgcacccaatacaggagcacccagattcataaagcaagtacttagagacctacaaagagacttagaatcccacacaataataatgggagactttaacaccccactgtcaacattagacagatcaacgagacagaaagttaacaaggatatccaggaattgaactcggctctgcaccaagcagacctaatagacatctacagaactctccaccccaaatcaacagaatatacattcttttcagcaccacaccacacctattccaaaattgaccacatagttggaagtaaagcactcctcagcaaaaggaaaagaacagaaattacaacaaactgtctctcagaccacagtgcaatcaaactagaacccaggattaagaaactcactcaaaaccactcaactacatggaaactgaacaacctgctcctgaatgactactgggtacataacaaaatgaaggcagaaataaagatgttctttgaaaccaatgagaacaaagacacaacataccagaatctctgggacacattcaaagcagtgtgtagagggaaatttatagcactaaatgcccacaagagaaagcaagaaagatctaaaattgacaccctaacatcacaattaaaagaactagaaaagcaagagcaaacacattcaaaagctagcagaaggcaagaaataactaagatcagagcagaattgaaggaaatagagacacaaaaaacccttcaaaaaatcaatgaatccaggagctggtttttgaaaagatcaacaaaattgatagaccgctagcaagactaataaagaagaaaagagagaagaatcaaatagatgcaataaaaaatgataaaggggatatcaccaccgatcccacagacacacaaactaccatcagagaatactataaacacctctatgcaaataaactagaaaatctagaagaaatggataaattcctcgacacatacaccctcccaagactaaaccaggaagaagttgaatctctgaatagaccaataacaggctctgaaagtgaggcaataattaatagcttaccaaccaaaaaaaggccaggaccagaaggagtcacagccaaattctaccagaggtaccaggaggagctggtaccattccttctgaaactattccaatcaacagaaaaagagggaatcctctctaactcattttatgaggctggcatcatcctgataccaaagcctggcagagacacaacaaaaaaagagaattttagaccaatgaccctgatgaacatcgatgcaaaaatcctcaataaaatactggcaaaccgaatccagcagcacatcaaaaagcttatccaccatgatcaagtgggcttcatccctgggatgcaaggctggttcaacatatggaaatcaataaatgtaatccagcatataaacagaaccaatgacaaaaaccatatgattatctcaatagatgcagaaaaggcctttgacaaaattcaacaaccttcatgctaaaaactctcaataaattaggtattgatgagatgtatctcaaaataataagaactatctatgacaaacctacagccaatatcatactgaatgggcaaaaactggaagcattccctttgaaaatgggcacaagacagggatgccctctctcaccactcctattcaacatagtgctggaagttctggccagggcaattaggcaggagaaggaaataaagggtattcaatcaggaaaagaggaagtcaaattgtccctgtttgcagatgacatgattgtatatttagaaaaccccgtcgtctcagcccaaaatcttcttaagctgataggcaacttcagcaaagtctcaagatacaggatacaaaatcaatgtgcaaaaatcacaagcattcttatacaccaataacagacaaacagagagccaaatcatgagtgaaatcccattcacaattgcttcaaagagaatgaaatacctaggaatccaacttgcaagggacgtgaaggacccccaaggagaactacaaaccactgctcaatgaaataaaagaggatacaaacaaatggaagaacattccatgctcatgggtaggaagaatcaatgtcatgaaaatggccaactgcccaaggtaatttatagattcaatgccatccccatcaagctaccaatgactttcttcacagaattggaaaaaactactttaaagttcatatagaaccaaaaaagagcccggattgccaagtcaatcctaagccaaaagaacaaagctggaggcatcaccctacctgacttcaaactatactacaaggctacagtaaccaaaacagcatggtactggcaccaaaacagagacagagacctatggaacagaacagagccctcagaaataatgccgcatatctacaaccatctgatctttgacaaacctgatggaaacaagaaatagggaaaggattccctatttaataaatggtgctgggaaaactggctagccatatgtagaaagctgaaactggatcccttcctgacaccttatacaaaaattcactcgagatggattaaagacttaaatgttagacccaaaacataaaaaccctagaagaaaacctaggcaataccattcaggacataggcatgggcaaggacttcatgtctaaaacaccaaaagcaatggcaacaaaatccaaaattgacaaacaggatctaattaaactaaagagcttctgcacagcaaaagaaactaccatcagagtgaacaggcaacctacagactaggagaaaatttttgcaatctactcatctgacaaagggctaatatccagaatctacactgaactcaaatttacaagaaaaaagcaaacaaccccatcaaaaagtgggtgaaggacacgaacagacacttctcaaaagaagacatttatgcagccaacagacacttaaaaaaatgctcatcatcattggccatcagagaaatgcaaatcaaaaccacaatgagataccatctcacaccagttagaatgacgatcattaaaaagtcaggaaacaacaggtgctggagaggatgtggagaaacaggaacacttttacactgtgggtgggactctaaactagtttaaccattgtggaagtcagtgtggtgattcctcagggatctagaactagaaatatcatttgacccagccatcccattactgggtatatacccaaaggattataaatcatgctgctataaagacacatgcacatgtatgtttattgtggcactattcacaatagcaaagacttggaaccaacccaaatgtccaacaatgatagactggattaagaaaatatggcacatatacaccatggaatactatgcagccataaaaagtgatgagttcatgtcctttgtagggacatggatgaaactggaaaccatcattctcagcaaactatcgcaaggacagaaaacgaaacaccgcatgttgtcactcataggtgggaattgaacaatgagaacacatggacacaggaagggaaacatcacacaccggggcctgttgtggggtcgggggaggggggagggatagcattaggagatatacctaatgttaaataatgacttaatgggtgcagcacaccaacatggcacatgtatacatatgtaactaacctgcatgttgtacacatgtaccctaaaacttaaagtataataaaaaaattaaataaataaataaatttattaatataaggtattagaaaaactgaagtagcagagtaacttcatttgataaaagacaaaacagaagaaggatatccaagtgcccttgttgtttgtcattgtttatttaataagcctttattgaaatacaacattcatctggaaaagtgtagacatcgtgatgtagagtacaatgccttgcctgaaagtgaacacagctgtgtaattaccacccaggaaaaaccaagaatacaaaacattgccaggcctacggaggctcctcctgccatttccaatggcctctctcctactaaaggtaagcaccattcaacttctcaataccacatatatttctgctacctcttttaaaatttcttttgagaataaaatagaactatgcaagtttcagcgtttagattattattctcagaatgtttctgacatccatccgtgttgcagtatagtattatattttatgaatatacaacagcttatttctctactcttttgttgttggagacttgagtagttctcagtgtggagctaccagaaacaatgctgctgcaatacaagaacacatcttctggtgcgtacatatgtgaatttctgctgtgcatgttcctgaaagtgaaactgctagatcttaggggatgtatatgttcaactatactagattctgctgtaaggttatgtttgtttgtttgtttttgagatggagtctcactctgtcacccaggctggagtgcagtggcacgatctcggctcactgcaacctacgcctcccggactcaagtgattctcatgcctcagcctcctgagtagctgggattacaggagtgtgccaccaggtccagctacttttttgtatttttagcagaggcagggtttcactatcttggccaagctggtatcgaactcctgaactcaggtgatccgcccacctcggcctcccaaagtactgggattacaggtgtgagccaccttgcctgacccctgatgtaagttttttaaatagctttctctcatttgtgaagtgcttcttcctctcttttgccctgtttttcattggctatttcaccttttctccattgatcttaaagtatagaaagctttatattaactctgttttgtagtgccaaggtacaggctctgcctctaaagcttacagcaaagtggcctgatctccacggcagtcagatgggttgtataaatggaaaatgtaaagcagaagcaaaggacatctaaagggtcaacacttacagtcgctctaatctcagaaggtctccaaaggtctctggctgtagcatttctagttggttgaaatgaatatacctggaaggcaaaaaatcaagttggttactccttgtgctggtgagtaaaataaaatgtttgaagaattagcaattgcttcagctgaaattatgaatttcactggccccaaccactatatatcacatacaaaaatcagaaactctgagatattttgtctcttctgttcgtcacagtcccgggtctaaaaacctgatgttccaaaggggaatccaaagcccacccagaaaggagcatgatgctgcccccttttcccagggagcctcttgagtcgatgctaactggttgttgaaattactcttttattcattaaaatgtttaaagtaagcaaagttacggtaataattaagattacaaacataataagatacattacaagtgaccacatgcttatttacatttcagaacagggagaagtgtcctgtctgacggagtcaaagtatggcatatttgatgtcatatgatcatcatacttgaaatgaattaatcttaaccctgggggatggatgagaagtaatgtgtcttgttttaatccttttggaattaggaattagactttttcagaccttggtatcccctctgtgcaactgatccaggagttatttcctaagcttccatttcagaaaggcttctcttaaagcagggcaactgaagacagaaaggcttgcatttccttcagaaatcctgtgatgaaatggagaagcatgtttccaaagcagacagttgagcagacctttgtgaagcaaatcttcccaacagacagaaagatccatggggaaggctgcacactcctcttagaaaatttaagtgtattccctgcacctgacttctgaacacagctttttcaaacaatctcagtgaaaccaacagtgatatatagcagtctatagtgaactgctgaagaaagcactgcagatacaaagtttccatgaaaagtaacaaactttcacaccaaattggaaaagaggatattgtacatttatgtgggaagacacagtgaatagtacttgattttgtcaatgggaagctctctgacttgaagtaatggcaggcaagtaaaaagaaagctttacaacccacgtttccataaaatgtatttatttcatcacagttagaaatatttttgaaaggagaaaagaaaaatgtttaagaaaaagaaatacttttacttcattcctaggcttccttcttataaatcattattatagtaagagtacttcagacacctaatgaaaaagtataataatcacaagagaatgaaaaccatgtcactggaaaggtatgattgtttcagactgccttaggttggatccagaagcagtgccacactgtactactctctgaaattcagcatcctggcccgtatcccatgcattcctcccaggagttctgttcattttaaaagtggtgacattttaccgtggtgacattgtataagacctggcaataattgcctttgggttagcatgaaacaactttaccttggttgccttgaattatacacacactcacactcactaacagactctcacacacacagacactctcagcttcacacatactttcatactgacacacactctcacattgtctcacactgacacactctgacacacctacatgaacacactctcacatgctcagactccctcatacccacacatgctcacactcacacacttacatatactcatatgcactaccacacttacactaacacacacacggacactcgtgcacactcacacttgttcacatacactctcacatacactaacacacagcatcacactcagatacacatctacacactcacacacactcacctaatctcacacactcacactgtcatgctcacactcacactgtctcatgtacactaacacactttcacgcactgacacatgtattcacatatatgctcacatacactaacacagtcacacacacatactcccacacactcacacactgtcccccacaaaatcattacctgtgtcattggtctagcacattaaaaaggaggtaggggctgggagagtgaaagaggatgtgggggaggagtgttaggcagagactggctgctgaaagcagggaagagagagaagtctctgtgactgcagtgaagaaagagttagaaggagggtccattacaaggtttctcttcccaagtgaaatgtatcgcatggttggattccaatctctgtgtatactggacaggcccaggcctgtagagtacaaatagacattttatgaagactaggaataagtgctgatgagggcatcaaacttagcataaagtaaataagagcaacagcaaaaaaaaatttattgtcctaagtgctttacatgtatttagtcatttttaatttttgcaactacactgtgtggtaggttctataaatacaccattatttacttaggaaaaatgtggtacagagataaagtaatttgttcaatttcacacagccagcctctctagcagcaagtggggggcggccgtgcacaggctcagctgacacagatcacccagagatgagctatggaaacctgatccaagaatcccggagcagagcctttcttgggtatggaaacagatactccacagggagaaggaaagtgcccaaagccacaaagccaatcaatggtaaatccaagccacaaacccagcaaaacccatgctctctacactcctgttctcagtttgcctacattagtggctttttaaatgtgaagctgtggggttcttaactggaggcaagcatcacattccagtcataaaacaacctaacaggtcacaggaaaggagtcacgagccgggtctgtggtttagccaacctaacaactcccagattttcaaagggagtattctagcttatgtataagcccagtagaagtgtttttttttttcctttcaactttttaatgctttgaaacaatttattataaagaaaacttgagtttagcataagaatttttaagtagcactagtattcctgccatcattgatcaaatgtgcatcctccatagtttgcacaggtgtctgcattgctagaagtagaaagacagctttcgcttgggagggcatcttatatactgagccacctaaaattagagcaaagagacaatctaaggggtagaataacatacaacagtttatccaatatcacttagctactatgtgttttattatccacagtaattaataattatcgatttaatatttaaatatttcacaggtagcaattcatatttactatgaattgctcataattcatgagaaatgcataatctccttttccacaatgcacccactgagagcccactaatcacagagccctgtctattccccattccagccatgcttccctagaataaatcactgcaatcttagactcacccagagatgccctgaaggacaaatgttttctgctggacttcaatctaatacacagtagggtaagcaactggtattggaattcactactaatgaatgagaaaaatgcatgtaagtagactttgttccttgcaggaaagtaagacaacccagagagttctgttgattatagtgcaagcatatttaagttttgtgtccatatgatttgacaaattttctaacaaaatctttttcaaaattttttttaaaactttaagccaatttaaagcagtaggatgttttaggttatatgtgtttgatttatgtgatggctttagcagattcaaataaggagggagtcagctttgatctccactcccttctgtgccttgataagagagcaagactatcctctcctacatcttatttttctaggctgtggataaccctgccatttttggatatctattgcaggtagataaatatgaatgattacttgagaggattttaaatctgtttaagtcacttcataaagtttatatgtaaatgaattactagttatccctttatttaaagcaggcaggaaattattgccattgtcatgtcatgttgattcatacttagcttccccagatgatttcatcaacatccatggcttcaattattatctctatgcagaagacctacaaattacatatccaacccaaatttacctctaggacctaaattcatgcacccaatgtcttcttaaaatatcatctagatgtctcaaggaacctcaaatccaacatgtctgaaacccagcccaggaatcctccttcaccatactggctgtcctccatttttgcttgtctcaatttatggcactgctgtatatctatttgcgcaactcagaaaactagcaatgacccctctgtctccctcactccctgtatcttacccaattctgcgttttttattttgcctcctaaatatctcttgaatgtattccattctcctcttacccactacttccacactagagcaaactataccctcggttactaaaatacaagaacaaactggtctgcctacatctatctggtctaccctcaatagaaatataagacccttaaatggcttttaatttctatagaaataaagacagaattttttcaacagagcccaagttccagcctggtcttgcctgtaaatgcccttccagtatcccctttatccccttcttgctctacctcaatcccagtgctctggcctcctcccagccacatacctgccatactcctgcctacagcagtctctgaatgattgtctttgtagcccagtaaaccttcccacccttcttgcctggtaattctggacctgttttcagatcttactgtgctctttccttggaaagccttccctgagctcctggtcaaatccccctgttatgggctcacccagcattgtactgttgcaatgtaatatttgagtgattatgtaatccatgcctgtctgccctaacgaaactctaagatccatgaagacagaaattatattggatttaaagtaatattcacatccctagtttcttagcagagtttgacaaatagatagtcagtacatagttgatcactgaaagaatgaatgaccagccagtatttttgcatgagcattgtctttgcaaacgtgaggataagacattgaacttttcatatgttctatggtataaagcaaaagatgggagtatgaatcctaataaaagctttctgagttaatatcagctcaacaatctataatggcattacatttccttggggaagaaccatcccaaacatttacacaagtctgactttagtaagctctgtcataatgtatgtttaattgtatctcctaaaactttgtagaatccttgagcactaatgaacctagagggcatctagcaaagtcttcctggggcttctccaagagaatccatctcactccaaagggacatgtttgaatcacacatttttgtgagcactgacaacacatttgacatctcgtatctgagtaaatatttatttacacaaccaccccgaggtatcaggccaccaaagagaggacaaaaatcttcctatgatctttaaaacatgcagagcaagaacatgtggtcagagaatgacaacaaaaataatagagagagaatgattctcagtgtgagaagttgctggtatcgctggtatcgctttagctttcagcgtgaactcactgagccacataaaaacaaatgttctgtgccgtatgatcaccttggcaaccccgatctaaggcaagagcagagatggggagaaaaacactatatttatctgtatctaactgcacaatcaaaatagcatatacggtcaatgttctcaacctttttgtacaaagtggctgctttttattttctcaaaatccatgagattgtaaagaaaaaaggagtactgttggcagaaggaggctgcacaccagagtgtctctgtgtctctgtgtgtctgtgtatgtaattttgcatgtgtctatatgtgtgtaacataagctaaggacatctgaatctgaagcttgcaatacaggggatcttgaatataagatgtcaacaatcctagcacatgaaacagagctcagaggaaaagcagtttgctgacagctggcttggagatccaccatgtcctgcctcacatccacaggctgggtgcattgagatgacacaaactttctgtataataatctcagctaagattaaaataggcacgctttagcttcattgcacaatagcaagcaagaattatctattacaccaacaaattattcatactattcaggaattaattaaacatctgaatgaagatccttatttcagagcacggtaaattatttcaactgattttaaaggaaaaattgactgaattatcataatctgttagtttccagagaaaagctttccagcatctcatttgcatgctgtgctaaagtcaataacagtgtattctaccaaaattcattataaagagaattatatttattcttaaagagttaaaaccagttaaaaatcatactgcacaagcttcactctttgggaagttatttcaatcctaaattagaatagttacagaaaaaggctgggcacagtggctcacgcctataatcccagcactttgggaggccaaggcgggcggatcacgagatcaggagattgagaccatcctggccaacatggtgaaaccccgtctctactaaaaatacaaaaattagctgggcatggtggcgcgtgcctgtaatcccagctactcgggaggctgaggcaggagaatcgcttgaaccagggattcggaggttgcagtgagccgagatcgcaccactgcactccagcctgggtgacagagtgagactctgtctcaaaaaaaaaaaaaaaaaaaaaaaaaaaactagttacagaaaaagtcatgtttctacaatagtttagatacagtatgattgagagttatgaaaaatctttctcactctttgttcaatctctacctctttttgcctgaactaatagctataaatgttccatgtaaatccagtctcttctttccaatctacactatgttgaattatttggtggttcttcctggaaaaatgcagattagaccatcccctttattaaggatcatcaatgtcttctcactgtctttagcaggaattcaaggcttttcaagattgagcgccaacctgtgactttcccctccctcataagtctgagcaccctctaaccaaattcattatctctggaaactctccgatttttttcatagtgtctaacagtcaaagtgttttctcacccatttaagatcaacagtacttttttttccattaaggacttagtgactgcttgtgtcagatgtaacttcattcctctggctcctttagtatattaaaacattaataagtacttattgagtgcccgtgaagtgtgagacaagatccttgaccgtctcagagactggaattaggtgagtggtcaaatacaaggaatcaatgaccacagtcttgtagaatacctattataataatgggatgcaaggaataccatgagaatccaaatatctacattagatttaaagataaagaaaggttatacaaagaaaaggattctctacctaacttttgtggacaaacagtactgacctagatgcaaaagagaaaagacagtgtagaaagtggggagacaaatgtatgtgaagtgcagagatatgaaaatgcaggactcttgcacagaacagtaaggagctgagcgggacagaagcactggttgcctgcagaactctgcaaagatggacttgggcaggaactgaatcacacatttcctttgtgctcaacaaggtgatttgaactttaccttaaagatataaggacacatgacaagattcaaagaaatgaaatttctaagtgaaatttttattttacaacattgccagcagctatgcaaacaaaggactggaagttagctagagagagactccagctagagcaatggtttgcagtggttttcagcttaggatgattttgttttgtccccctccatcctcccagggaatatctggcaatgtctggagatgcttttagttgtcgcagctggaagtggtggtgctactagcctccagtggggagggaccagggtgttgctcaacgtcctatcctacatgacctgggccagccccacaacattactaagcccaaaatgtcaacagtgccaggttgagaaacacctgagctacagcctgctttattttctgagcgggaaggagtggtggtgacgatgcctgccatgtggagcctcaattgaaggctgcaagagcttttccaaaggatcctagaaaaatgaaatgatagaaaactattaaaggggtgccaaataagaaggggaaagaattaatagaagcaaagtgaggaagaccctgcacaggaccaatggtactcgatggcaccaaaagggctattggaagatgttactgtaaaaaggaggcaggaatgtgtcccagtgaaacaggctggaataaaggaaatgggcactaactcacaatcgtctcttgtcacaaggaaagctagtgagaggtctattagctttgccctcaattttccccttaaggtaaaaggcaaagtcaactgtgaaatgtaagagaaatgtagaaaagaaaaacaaggctgtgaattttgaattgtggctatgtcatgcaggacaaggagctcagctccttttgatcattgctgctaaagctgggactgacttcttagtcctttccctagtggattttcagcagcattggaatgcgtcggttagtccctctccctgccatgttcttccctggcttccaggatgccatcctcccagatcttctcccacctcaatgggcctcctgctcagggcccttcactacttccttctctttccccagcctcctggactggagtgcctggggctgagtcctgaggcttctccctttttccagccaaactcaacagcatccagtaccaggaacatgagcactttcaggtgccaaagatacccacattgcacagccagccctcaccgccgccttacattggagacccatgccctactgccagccccatgcccatgtggctgcctagtagacaactcaaacttgttgtgtgcaaatctgcagtcctgattagtcttcatgcccacttcccagcatgtccatctcagctgaggaccacacttccttctagttgtttagggcaagaatctcagtaattccttttacttctttctttctccaacatcctacatctaagtggttggttgtaaaagagatccagatgctgcacccatcccaaacctaccctactgcctccttactctgaagccacaccacttctggcctagtgtacagcaaagcaaccaactggtcccccacccttgccaggccatagcctattgtctacgtagccatccttgttgagatagtagattttagatgctctcaccacacacacaaaacaataagtgtatgaggtaagacataggttaattagcttgacttggccatttcacaatgtatacatgtatctaagcatcatgtcgtacattataaatatatacaacatttatgtgtcaaatacatttttataaagaagaatgcaagaaacacagaaatcagagtgaccattataaggcctgttggatcaggcatgccaactgtccttcaaaaccctccagtgctcactcagaataaaatgtacatcgctcacaatgatacaaatcaaatctgttcctctgatctacacagttctgtgctaactgggcctgtctctctgctccagccacatcagcattcaagctgttgctctcacatgccaggctcactcctaacttagggtgttagcagcggctgcctttctgcctgcgctgtgcctccctggcatgcatgtgtctccttccctgaccaccaagcctttgctcaaatgccacccactcaatgagcccaactgtgacccttcctttttcaaattacaaccacattcccacgtcctggcacttctcaacccctccctcccctggttctgtgtgtacatatatatatacatatatacacacacacacacacacacacacacacacacaaatatatacacacacacgtatatgtatatatatacatatacgtgtgtgtgtgtatataccgatttaaatatttgccaaaaacttgcattatactatgcaatatgcttgttcatttattagttttaaagcttgccttccctgctagaatgttagcaggcccctcaaggtcagggattttatgttttgtttagtgccacagcccagatcctaaagagttttggcatgcaaaagacacccattaaaactgaaaaatgacaatattatctatattgcagggctgctgcaagatcagagataatgctctacagacccttagcacaaggttctagaaaggcagaaggccaagtcacctatgaaatgtagggggagtattggatctaaggcaagaaaggcacattgggaagagtccacagagccagcgagagaaggagttccattgtgctccttgtcattgctagaccatggtcaagttttagttttcacctttattgacccatcgagagcatgatcttactgagaaactcatctcacctagttctagaagatcacgctaagacttcctcttaccaaacatgagtttctggaaaaattgaattatttgaggatctacttgaaattcgagatgggtttgttgtgactcaaaatagtacagccttgtgattttgtggtttcctccaacacagtggagtagaaagcagaaataaagaaatagacactgaggttggctcatatttgaatctaaagcacagcaggggcataggacaaagcatacaagggaaaggaactataggccacatgcagagggacttaaatctggaaggcatggatagattttagatgagataaaaccgtcccatgagggcaggcctgagacatgacctaagaagcccaggagacctgaggctcatcgggtgatattttggaatttaagattcctggggccggccactatggttcacacctgtaatctcagcacttcgggaggccaaagcgggtggatcatctgaggtcaggagtttgtgaccagcttagccaacacaggaaaaaacattattgtgtttgcctgtgaacactgagatatgtaggggctggtctgtatttttttaagcactaattaaagggtttcaggctcaggaaattgatgttgtcagtgctgcaatttagggtcacaattcagtcaaaggtggtacaatggaacagatcaagggatgtgttagctatgaggatgctatcgtggtctaggaaagaagaaatgaggcagcgggtctcatgtgaagcagagataatcccaagagaaaatgcagaaatggattccagaggcttttacaggggcaggatggggcaagagaagcttgagcactggacacatgcaggcctgcactcatcttcttatttgacccctcaatcattctgtgatgctgtggctgatgatacttcatgccagggcagtggaagattgcagatcatctgtaaaaatcacctagcaccttcctgatacatagcagaagtccaaggcaactagagagaagaggaggttgagaaaatccttatggcttagaactttagacaggcgctagcagtatttggcctccttccctccagagttaatacagcatacaatagagcaatacaataatagaggggctggttgctgatggagaagtgactcccagtgcaggcctctttgtgaaacactggaatggacaacttggttggtgctgaggtcagcacggggactcttacttcctgcttccaaattaaaatcatcgggtccccttcccaagcttatgtacagagatatgcagggcctggagtatgtactccaaagccactcactgaccagttgcaaggagggggctgcaggccagactcaggcaggcagggcagaaaaaggatgactgaggtcaccgcagagccaccctgatccaggaacatcaatcaccaaccaatcaaatgcactcccccctttctagggagaagtgcccgagaagggggataaacgcccaggatgaagagtgcaatgctccctctcatgggtacagtaggcttgagaagaaatgtgagaaaaacacaagaaaagagaaggtaaagcccccttccccagtatactgtatctgctatatttcttgtcagccctgaacctgaatgcccccatcatccagccaagttactggctaaaagacttcagttgaatttttaaaagcaaaggaatggctgcctgctctgacatctccttcatgcaccatgattttatggcactgtggccgtgaacaatgctcgacagatcagaccgctccctctgaaaccattcccataaaaaaaaactcaagtgggcaggtgtgcacaatttatacacctactgacattttgaaaacggaacaagtatagggtatttcagagaagggcagcataatgtagaaatttcagaactcttgccatgaagaaaagagagcaacaaagttagatccaggggaggaaataaatgtgtgaagaggagcaaagactgagcctcctgagatgtgaggacaggggtaagaagtagacctgacatgacacggatggtgggatttctaagaagtgagagaagcacagagagaaatcagagaagaaggacctgatcacaaaggaggagatattccaatacgtccccctctcagccataaagtgaagatctctttggaagagtaatatagaaaaagggagatggcggcattgattctgtaacagggaaacagcaaatgaatgaatataacacactccatttttgtttaaggggtctttacccaatcctgcatgtaggctaggataactttagagcactgagataaaatgcagaaacagccacatgtagtttttgaagctaactctgggattaaaggggacatatgtaaacaactaatgatgttttgttgaagatttacaaaagcactatgacctcgccaaggacaaagtttccaaccttcttgaccctcgctggtgcccagatggctgcagtcacaatcacgtgactcttgatctcaattccctcctccccaccctgcttcccttaacataaaaaagagtctgaaatctatactgacttaagatggttacttaggacactagtctgccatcttctcaatttgctggctcttgaataaagctgcttttcctcccaccaacaggggcaagcagcccaacctaggttctgttccaattataaggcaaggaaggcatcctggaagggtctgtgcctgcatgctgtggaatgatccacctctccctctgcctcttgagttttcatacaaacaaaatcaattgtacataaccatcaggaagctaagatttgttcaaacaaaacaggactctagctagcagcagtgttgaagacctggttgcagaggggagatgaacaagtggtgggtggggtggaggagtcatgatgcaggctgatgcccacaggtgaggctgtgctgctctccagatgaggctgtgcacttgcaggcagggcctcggcataaacactctgaggatggaagcagtgaggaaagggaagtacaagaggtcagcactgacatgccctgcactgtgccttgtgaaagttgcttcagggccaccccgagcatgaaggtggtgggcccacatcttagtagcaggggaagatgagtcacactgtgcaagggaccagaagaagcctcagcttgcacaccaatgcaaccttactgcattctttttgtgacttcagacaagcatggcatttgattactacaacaacagaaacttttaaataagaaagagaatgaagctataatgaaagttacagaaaaattagcattggtcactgatgcacaatattgaaacattttctataaatatattttctcacaatagtgaaagagaacaacacactatagattagtattggcatgcatgcatgccttcctcctttattctaaattggctttagaaactcaaattcacttttgtaaatgcatctactgtaaaaagttatatttaagtttgctccacaagagtctaaccaactataaaattctacaatgttctaaatattctggcctggaagactctcccaattaaacccataaaaccagtttccagatgtagacgtagttgattgtcacctggggatttatacctcagagagaactagacacagctttaaccaaacctgaccataaatgaatattgtttctcctctatttccataacaatggttttattttacatttcacttctggatgtaagccatatacaaattagaggaggacattctgccatgaatagaaccccttacagttattgaagaagaacgcagagctctattcctcactgaggaagttggttgatgcttgaaatcctgagcatatttgcattgcattgagaataaatggcttttatctcagctggagccatgagaaataaactaatagtaggcttttaacatttagaggataatagggaagggaaagatactaggacaaaaccataatgatagttgtatgaaatagttaatgaataaaattgcaaaaaagactatattgtttcagtcagcaaacatatttccaaattgcaatccttatttctttccttttaaatcattaatttcagatgtaatagaaagtgtcaggttgctatatacggaaccatccctggatgaagctttccaaatgcaacatttaagacgcggggcagcagactcaatactatattatgaaaattcacatgttttgataattcaaatgtttatgatataattatctgtaatgcaccaatccttcaggtagcatcttccaatagtacaatctaaatgccttccaatacataggactgacaaaggaaggcagaatataaatcagttggtgctcctgaaccccctgttcaatactttgagcaaatgacaccacttaagtatgtccatgcccacatccactatgccactccacaaagtccaagcaactgagcaagaccgtctggggcttgatggaaatcccagagacataataaatacagccctggaaatgggagaaagttgcatccccacactgacctccagaaaccaaagtattgaagaaaagaggcatttgagacaagccaatgtccttttcatccccacaatcgttgctctgtgcaaaattcccatttcataacatacacattggagaaacatacttggagaaactttggtctgaagcatcatgacattgtcttaagcagagaaatacatagtaaagaataaagagaattagacctaaagttacactagatgcaaacagcagcgtgaagccaggaggaggctgcgtcctcgccagagcttagcctcaccttacaggggcgtgagaacctcagtgttgaagcccccaggtggatgcctgctgaggagggaagggggcaaggacagtgagggacaatcggggtgatatggaagcaccctggtcatggacttgcaggctcttcaggggctcagtggaagagagcttagatggaagagcagggggagatcatccacagacgatagggttccagggggcaggtcacaccctagctggtctgtgctgctgtgaggctccaggggtggaggcattgtcgagaggtggagaaggaacccactgtgaacacatacctgatagttctgggaagctgacttggaaacaaagtgcccggcatccatgttctccaggcactcttgacacacaccactaaacatgtacccaagcgcactgcggatgtttctttagatgtttctcttccctgtccatggcaaaagtccttgggagctgtgaggaaaacacattccttgccttcattttctcttcctcttgtcctccctcgtgaacatctcacgggattgatggactgtcagcctcctcccacaggggagagaataagctcttggcttgatttgtctgatctctggaaagtaatcagaactccctgagagctaatgttcttacttgtcacaagtggaaataacaatcttttggaagtttcatgggtgtgagtgaaatattctcatatatagacatacaaagcacaaagcacagactgtcacaataattgtgatcattttgatatcagatttctattagttttttcctctttcctaatttcatgttttacaagattttaaagtactcgtctggttcaagtttttatattaataaagatatatagtagtttttaaaaccctctaagtaactttataagcctctggggggtgaaatttcaatttcgagtcataactgaggtataagaagacatattttcaataataaaacaattgaaaggatatagcttcagctttgggtggatttttttctgtgtttctgacttttaaaggatattattaaagcctctgttgaaataaaattatgtaactttaaaaaacaaatatttacaaagatcattctgagatgagtaacaacatcctataatttaaatcaaagaaacatgttatatttcttctattcaatttatgtaaaatatgcatggtgaaaagcagagccctgattgtgaaaatatagcacagccacttttgattagaaacacaaattcaagtcaactctagaaagaagttaattttcacttgggctgtagagcagataaactggtatttaagcctgggcgtctgtgagtatcttggctttgacagacacaaattacagcctttccaagaatatactttcatttgtatttctccttcaaagtaagaggattgatagtcagaaaatccaccatgataagtaattagggtttgttgatggcgctttattttactttaaatcgacattctatcccagtatatttctagacgaaattagttttacaatattagcattttctagagagtgctatattattctcatctgccagaatgagatgagacatacaaagaaatgatataacttgcctcaagtcacacagtcctttctgttcttgccattggctacatcgtaaatcattccttggtagtaaaatgctgccagggcccctttaactgtttcctgacactagggaccaattaagatgtataaattatgcatttaatagatgctccctgcctaaaagagttaaaatgcctctgaggtcctacttcaacaccaaagcctgataaataaaagaattagaagctagcaagccatagagcttgacactattaattcctatttattattaaccccaattatcagaagttctaattatccaccttttatttcattttagcatgttctgtatattcttccttttactttcttttcaggaaaagtataaaacaaataagtagaacactagtaatgatttatttcaattcattgtaacctttcactacggatgctcagctctgattgaatattatatttgcccggataacttttttaaaaaatctagattttttagattttgtatcaagtatccaccctgagagattctgatttcattgggctgggtgatacccaggcagtgttatttttcagaaattctccaggtgattcttacacaaaactctaatagaaaaccattgttttatagcaatgaaatatagatgccatatcataatcaaaatatacgaaaatatattgaagtactttctgaagaaaatattagtgtatactgtgcaaagtgcttttactgtactcaagtttaaaaccaataataatggtatatataataatgctcagggtgctaaaatagtaatagaaccttttcctatccattgtagacacaattgactatgtcttgctcatgctttctaagacttggtctagcttctttgccagagcagtagatttgttatttctaaaatgccagtgcaaaataaaatgtatcatactagcattctatggcacatcaaagatgagtgataacactattatatgtgtaattgcctcttatatgttttatcaagggataattttatatgatcttgttctttttcctaactggtgacaagctttcaactagcttcagagggagagccgagattaattgcaatctagtacattgtaactgttgcttcctgtttgtgaagatcagcatctaatcaataaaatattaatgactatttttttagcccttctaaattaacagctaaaggcaaagagttgtttttgttctccactctatttctttatagttgggtgtaaaatcaaatgaaacgtacttttcggtgtgattaatgctgactttaacagattgcttctgtttggtgtagttagttccttaatttatcttcatataatagcaaggctgtgtctctaacaaacctctttaaggctactgtttcttcacagtgttcttcctaacgtcagggtcagtgtatcttgttttgtttttatcatagacttgtttaacatgttaatctttttgaagcacaaataaaaaggaaatggctaactctcatacctactgaataagaacttctgtgaggacttctgtaaacccacagacggattccaatgctgaatttccaactggcctataagagctcctggagctccatctgggcacatgtcactgattcttgggccaagactgccagagtccctgttctcaaggagcacacaatacttgggagaatcaagtgtttctatgcacatcaaacctatgcacattaaacaatcacagcataaaacatatgcatatatatatatacatatgcatacaagcatagaacatataatatgctcaaaactgtggaatacagctgagtgttttcattggtagagatcactatggactgaagttgtcaggtaagatgttaatgtaatcttgatttgtgtcctgagaaactcttacagaggcaggaacatgagaatgaggtcagtgatgggaaaatagcataaatcatagcagaaaataatgctaacctcactagaggattcactgcactgcagaaaaaggaggaggtgactgacaggttagattacactgcaccctgagaatgagagggagagaatctgatttcatcactgtaggagacatgcagcaattacatattaatgagaaagaaagtggctgaggatgagtctgacagagacacaaagaatgggctcgataggagaaatgatggtagcagaaaaacctgggaggtgataattgcagatgtcacctaatgaagagaggcacaagtgaaggaagaaggggtgggaggaaggaaataattaaaggctaatatgaaagacaaaagggacaggaaataaacaaggactccaggattttggtcagaaattttttaaaacagtagtggaaactttgggataggaaatggatttggccattaggaaagtgaaagtactgacataagatggatttttcttattttgagaatttgagaagaaatacaagtaaaaattgtcattggtagttttaattctgtgatggtaggataaaaaattaaagtaagataaaaatctagattggatatgtagaacaaaactaacatataaataatatctaagtacaagagtgatcaagaatttcctgaagaaggccgggtgcggtggctcacccctgtaatcccagaacttgggaggctgaggcaggcagatcacctaaggtcagaagttcaagaccagcctggccaacatgatgaaaccccatctctactaaaaattagccaggcgtggtggtgtgcgcctataatcccaggtacttgggagactgagacaggagaattgcttgaacctgggaggtagaggttgcagcgagcagactttgcaccactgcactccggcctgggcaacagagtgagacaccatcttaaaaaaaaacaaagcttcctgaagaaaatggagaaaaagaaaacaaggaagaggagaaagaggaggaaagataaattgcttatcatatggaagggctcaagctggaatggctacacacatctcaagactgagttcatcaaaaaataaagcaagagagttcatcaataacaaaaactgcaatggttgtgtaagtgccgaaagggtgaattctctcaaggggtaaacaataatgagagattggggcatcccaagagactggaagtcaggattcctgtccttacaataaaaacaagttcaacgaaaagaaaataactactttttttggacccaccagagaactgaggtctcagagcagtgagccatccctaaatctgaaaagacaggcaccttcaggcagaaaaaaaccacctgagatttgcttacctagagcggaacaccgcaggatgcaacagtctagggggaacaacaaggtgggaatttggaggagttgctggcgtccaagtgtggactgcggttgtgggtatctgccggcttttcctccaggaaggagttcactgagacccacagaaagaatgccggggaatctgtgggagcttccctcccacgcggcagggaaagggaaagaattatcacagtgctgtctgcccaggccctgctccctcacagaattaaagtctcaaccttgggaagaacacggccagagggcaatagtgaaatcccgccctatctgcccctcttcaacccaactctagcttctgttttccctcagaaaaataagtaaaagaaagaaaagaaaccatccctctagaaggggcgagcgctttgaatatgtggactggaacctggctgcggggaagggactggggcagggaagtgactggggccaatcactccacgccgcaccaggaggagggacggaaacgcgggagagccacaccctggagacataggcccgccatgcacccagaggacccaaatctcctcggaagatccgaggacggccacccaccatgtcctcccacctatgctaataaagctccaggaacaggaactatgggtcagagtgagaaaagctctaaggagcatcacaaaggccaaacccgaaaggggaggcgaaacaaggtgcaccagaagaaacgggagactctcctgccctcacagccaacaaacttcacattgcccagctcctgcagagcaatgcaaatcctcacactgaagcctgcatacctcagcacctgctgccttgctcaacactcctggccctcgaacaaaaaaaaaacttagaggcataccaaaagtcataaaaacgcaaacattccgaagaaacaaagcaatcaccagaaccagacccaacatgaccaagatgttgacatttatcatacagggaatttaaaaaaactataactaggccaggtgccctggctcatgactgtaatcccagcacttcggctgggtgggaggaggcggagttgggaggattgctagacgccaggagtttgacaccagcccgggcaacagagcacatagcatgaccccgtttctgcaaaaaaaaattaaaatattagccaggcattgtattcctgcctgcagtcccagctacctgggaggatgaggtggaaagatcgcttgagcccaggagtatgaggctacagtgtgctgtgattgcatcactgcactgtagtctgagtgacagaatgagactctgtctctaaaaatataaaaataaaaaagtctttactggaaaaagtaaatgacttataagactagatagataatctcagagagatggaaactataaaaaaaaagaaaatattttaactcaaaaacaatagcaacaaaaatgctccagcctcattagcatatttgacatagttgagtaaagagtagctaacttgaaaaaagtcaacaaaagttgactcaaagagaactgaattaaaataataataataaacagatatccaagaaatgtgggaaaatggcaaaagttgtgatgtgtacctagttaaaaacagaaactggcagaataaatatttaaagaaataaacaatggcttttttatagaagcaataaaggaaataaaagtttccaaaattcaaatatcaagctaaaactctgaggagcttagaaacaccaagcaagataaataccaaaaactgcatctatgcatgacatattcaaactgcagaaaaacaaagacaaagagatatccttgaagtcagtcaaaaggaaagaaaaaagaaaaaaagataaacttatctacagaggaacaaggataagaattacactgaacttctcattagaaaccatgcaagcagaaagaaaacagagtgaattatttaaaatactaaaagggaaaaactgccaatctagaattctacacccagtgaagttgacttcaaaggtgaaagagaaatagactttctcagacaaacaaaaactgaggcaaaataaacataactaagaaaattcttccggcagaaagaaatgcaataggtcagaaactgggatctatacaaacaaggaatgaacatcatacaaaaaattgagagaataatcttttatttttcttatttttaagttctctaaaattctaatgagaaaaggaaatacagtgcaaactttaaaactaacaagttgattgaacctggactatatggaatgggaatcaaataggaaggaataatatattctaagtgatgtttttcagaaaaagatcatcaaaaataagagaaactatttagtaaatctgtaaaaaggtatttgtagtccctcttgttctgggttctctgttttaactgccatcgggtcaggtctgtggaatgagttatgaaatgagcatgggtctaaatgagaagatgaccatgccccacaggcagactggcacgctgagctccagcattaaaggacttattgaaaaacttatagtagagtagaggaaactagaacaaactaccagagaagttcattttccattgaaaatataatatgtccattttcttctattgtaattggccttataagagaatgtaaggccggggcggtggctctcgcctgtaatcccagcactttggggggccgaagtgggtggatcacctgaggtcaggaggtcaagaccagcctggccaacatgatgaaaccccatctctactaaaactacaaaaattacctgggcattgtggtgcatgcctgtaatcccagctactagggaggctgaggcaggagaatcgcttgaactcaggaggcagaggttgcagtgagccaagatcgtgccattgaactctagcctgggcaacaagagtgaaatccatctcaaaacaaaaacaaaaacaaaaaacaaacaaacaaaaaaaaaacagagaatgtaatagaagtctctttccatttaataaaatactttatctttgtgggaaacttaagaccattaactgatatagtttctttacctagagatggaattacctacaacagtgatatctttttatgaaatcaagcttcaccaaaagagaaagataactattttaatgatagtttaaaattgtatatattctattttaacctatcattaaaaaaccagccaagtatcctgcggtttaagaaaaacagagcgtaagaggagcacagttaaatatctatgatgtgtctaaagaaatagtatatgaaaagtcgattaagatagtaggatttttaagtgatatagatataaaaatattctcacttatgatataatgttgttaaacatctataagatttttccacttttattatttactaatatgcttttggtaataacagctgtaaactacatttggaaaataaaattttctctctatgcaagttgtgtatcccatcaacatagccaacaatctgtggcatatgggaaaatcactgacttgtggtctaaaaacctgaattctaattgtgttctgctactaacttatcttgtgattttgagaaattcagttctgtctcaaatatctagttctttttcaacatttagctcttaagtgtatcaactgaaaaacaaaacaaagaaaacacagaagaattcagctagatgatgcccaatgtcccttccagcatgatatgaaaatgctttcaggaaaatgaaagttaacatcatcccaggaacccagtattactgcaaactgcacctgcttttgtagttgctatcatggaggctcccatacttttactttaaggttggcaagcatgatcttcccctttgtacaggaggtccctcaggcccaggggtgagcctgagcaatgacagaagaatattaattgattcaaaattgaactagaccaggcaagatttcttttttaatccctgaaagaaatcagagaattctctgatctttcagagatgaaatcagggctggaaaaggaaaatctccatgatgtttaaagagaccgatggggaaaaaagttagaatcatgtctcaactgtgtcaagatcaatccctttaataaatgctttaagcatgtaactggggcctctgcagcaggatctgggcaccccactgcctgtgtggcaccacccatacgatgggcttgtccacagggatttgccacctcggttcctcatggcacccaagggattatgatggagtcatacctgatatatgacctagttttaaatacaatcctgttatgacacattgttacatacgctccctaacatgacatctagttgttttcatcctctgaaaagctgttttcttgtaatgaaaacagataacttcaaagcacataataggtatacaataaatagtagatcttattaaattaaagttaaaattaaagttcttgctgagaaacatgttgtagaacttggaaataaatttttatggctggcatgtcattggcaattggcttggtagcctcctttttctctaaaagggcaatacatttaaacagttataatagctttcaaaaaccacttcctaaatctctttttctaagctttgtgaaataccatcacaaatctcaaaatttaggcaaatctttccacctaatatggagtgaagcacaaaacataaatgtataaaattcagtttttattttagatgtgaaacttttcttatgatgccaccattaactaaaaaaaaagatttctataaaataagtacttctcaattaattttttacttatctttcaaaaggtatcttttgaacagtttgaatgtgtcaggaaaatgcatcttttactttttgtgtgtgcctagttacagaatgggaaatcatcaaattctcttctgtggtcactgttctactgaaatagaaacagcacaatttcagaggaaattgctcttgggagttttccaacccaatactgcaatcttgagatttctggaatctttgaacaagcttaaggttagaaatgcaaaagttccaaaccaacctagaaaacactaaaactgttgactcatacaccctcgccttgctggaacaggggtgtgttgaactcttcctgatgatgcgccatcccagaagactgagaactaacaggaaggaagaacaattttaaagcaaacactgcttctccatttttaaaaattgctagctaagtttatgtgtcacctttatttaaaaaaaaaaaatctctttaaaatcttcacacatcactttccccacaacaggaaaagtgcaggaaagctctgcaaagccttatttacttttcctctgacccgctcatgatttctaatggcattgtcatttttgtgaagattacatattctttaaatgggtagattttatggtatgtaaattatagctgttcaacaaagctgttaaaatgataaatgggttaagaaaaattcaaacgatacagaaaagtgcattaacaaaccctaaaaacccaactgtccagtaattaccacgtgtaacatttgtcactgcccctcggtctgcttcgctctctatctgtaatcacacacattcagaaacgtgtctccaacttaatataacatctcttttccctcctccgttttggtaaacaaagttctaacatggagacagaaggaaaatcaagtcccagttaaaagcatcagcctagtccaaaatgctggacaaaataaaaaacattctagtgtggtgagtctgatgctataaataaaaataaaaataaaaaaccctaaaaccagtgatcctggctcagggaagattctggcagcctgtctgtcctcttagcagagcaacccctgagcactgaaggaaccagggcatgtccgtggtcagcggtcgcgatgatggcaagcagacagcaggaccaggggacagctcgtcacccaggaaatgtgcaggccagaactccatggtgaaccctcccacatatttgccctaaagacacaaacactggttgaacggagttgtggcaaataagaaagaggaaaacccaacccagaatactgcgctgtgtgtcaaatggcatgctcactcatacggttcttgttagggggaaatgctgctgaaactgcagaaatttttccatctgaaattttttgcatgtatagttttttccccctcaccgaaatgaaaatgtcactgaaatgccatcattttactataatctgtcctcagaatgttcccaatgtgtgtgtgtcaatcacaggagtcctggatcatccaggacagacaggtggacgcattcttggtctctgcagctgggcatggggctggcgaggcaggtattgcgagttaacagtgccaccttcagggcacagacggcataacagagcatatcagcaacagaaacagctctgtttcagagtgagaaatcttcccgtaccactaagtagctgatctgtttttttttcttttttttttaaatttcattttgtgagacagcctacgaggtcagtgccaatgttgatattcaacatatgaagccaatagtgtctaaaggttatgtgacagatggtagctgaggttatacagccatctagaagcgatgtgagaaaaaatgtccagcagttaaggaaagtttccatttggggtataaaagctaaggagagctattttatcgtctctccatccaacctcctcctgcctctgtatttctgtcactaaataattgttcttcctgtcactgaagctctgcattcccaggcacacaacacatccctctgatcgaatatgttctttcctaacatgtgatgtgatgtgaggggcatttggcatggagtgggaatttaaagatgctgttgctaataatgaccaggtcacctcagagagtgcctggaccaccattacctctctatcctgatgactttccatttattcttccaggtcagccctgcatctcctgctgcctaccagacatctccacctgggtgtccggcaggcactttcacattggcacagcaatgcttcctccggccagccccctctgtgctccgccctgggaataaccatcattcacctggtcaaccatgagcctctcttcaccctccttcccactcagccatctgcttctgtggcttctaccttcttcatatacctctttcccttccccactgcaagggtcttcaatttgactcatttttaaaaagcttttattttcctgcctctcagtttggatgcatgcagcctatttcttgaagagttgccagaatatcttcccaaaatgaaagtctgtcctcctgatcagccagacacctgagcttgccatagaagacccacaatgagctgggacctacctacatgggttcttgccttcacacacccccttcctacctcctgcgaggatgttgtttcagttccctacctgccgtgttttcatgatttagcacgtttgctccctgccacctcatatttccatttgcttgataggctcattttacctgccttctaccctcaaattccaatccacacctggtaaatattcactcctcattgtagacctccaccagaatgacaaggagagcaaacaggttgtggcatttcatggttgccaaacactgttccagctgctttatatgaagtatccgatttgttctacaacaaccctgtgaggtgagtattattatccacaggagatgttatggcccagggctcagaacagctgtctaagtggtatgacttttctaagtgtaaatacttaaagtgagctgcaggcagtaatggtagtgattgccaacacaggtctggatctcataatccttataacctacatgtaggagagagaaccatctgcaggagtgtgaaggaaggctagagttgccatcatgaaattgtgcagagggtgcaacagtgggaatccatgatggagagacagaggttacttgtacttagccttgaagagagaatcagtcagggaaaatatggagaaaaggaagcttgcttggaggttaggagtgtggatccggggcccagctcctgggttccagtcctggctccaacacttactggctgtttgtgcttggccaaggagtttaacctcaatgtgccccagtttcctcatctgtctaatctagtagtttgtgtgtaagataatttggaaaaagaagaaaccaaaggtatcagaattaatcagagggccattgcaatattacaaccaggagaggattcaaatattaataaaaatggtcacttgactcatccttaagttatttatacaattaccatgagactgaaaacaacagaccccgcttctcctggcagctgagaaggtgactcagggatgcagaaaatcaagaaacaagttctaccagctagtgtcataaagatgcaaataatttcacttaaggatataacaaaaactgaagacaaaaagtgtgttcaccatagtgctatttgcaaaatttaaaaatgcgcagatgcccaatatatgtttaaaatgtttaaatgtttaaaatgttttatatgaattataaatgtttaaaatgaattatagcacattcatatagttaataaaatatacagccattaaattgtgttacatgtttaatgttgttatagacagcccctcaaagatgtaaatgccttaatctccaaacctgattgtgttacattccatgacaaaagggactttgcagacgtgattaagattaagagctttgaaatgagagattatcttggattatctgggtaggtccaatctaatcacaccagttcttaaaagtggaaaagggggcagaagagcccatcagggagatgtggcagaggaaaagggcagagactcagatcatgggagggactcactttactcttgctggttttgaagctggaaatgggactgcaggcccacgactgccagcaacctctagaaattgggtttttacagcttccacaaccgcaagaaactgaattctgcccacaacgcaagtgagtaggaagcgaattatcccctaaagcatccagaaaggagcacacccatgctgacacttagatttagccaggcaagacccacatggaaattctgacccatggaaatgtaaaacaactaatttgtattgtttaagatgctatggttgtggtgatttgttatgggaacgaatatagttacaaatctgtatattgttatacagttataaacattatggacgatgtcaggttttttaaaaagcccagcatcagcactacatagatactttaacgtcaatcacatcccagttgtatatacacaagcaagatgaaaaagaagtacacaaaaatatttgtcagagtttggggattatgggcattttcatttcctctggatatgttacccatcgtcactccctcttatcccttctcccactcactgtctttctggatgctaatccaactgggcttctgcctccatgtttgcacctggagcaatagtaatgggtaactagtttgcaaagtcaaatgctgcttccaccatcatcttacttgacttatcaacagcattgcccacaggttattactcctgaagacctaaaagtattgcttgttgggctctgggaagcctcccctaggaccttgtaatttcatttgccttttctaagtctcttttgctgtttcattcttacctctcgatctccagatgtctgggtgaattgggattcaaacattaaatctctttcttccactgggtacactctccctaacccatctcatccatcctttgaatttaaattgtatccacacaatgatgactcccaaatattgatctcccaagaagacttctactgtgaactccagatgcacacagccagctacctgcccctaaacatctgatagccacctgcagcctaacctgtccaacctgagttcccagtctctccccacaaccacaccccttccattcttccacatcttggtacacgaaaactcttcttctaggccaggcactatggatgtttgtgaggggctgtcccatgcttggtaagaagtgtagcagcatccctggcctctacttacaagatgcctatagcaatcccccttccccagctgtacaaccaaaaatgcatcagcattgttaaatgatccctagggaggcaacttcctcaactctcctgtgaggaagcactcatctaggccaagagctttggagttcttgtggatataggttgaagataaagcagatagactatcagatgatcaaggggagatgtggggttggcagctgggtgtgtgcatctggagttcatggcagaggtctagttgggagaccaatatttgagagtcatcattgtatggatacaatttaaattcaaaagatggatgagatggattagggagagtatacctagcggcaaaaagggatctagcgagtgatttctaagttcttctcttctcctttttgctcaccttataaatccatttgttcatgacatctgtcttccttaccttcaacctaaatccacagtagaaacagttctccgctgctcctccaggtccctggcctctagtcttcctccttctctcttctaaatagatcaaagcagccagaatgatcctttcaaacataaatcagatctgtcattgctcagctggaaatccccagtatatttctcctgctcaaagtagagccaacgttgctgccatgaccacccggactgcccactgctgctcaggtgtctctgcggctctccactcaccccagtacagcacatctgcccaaccagctccctgcttttccttaaacacacagtgcctagttagctccgacctgtggcctctgcgctcacactctgcgtgtagtgctctgttcctgaggctccttcgctccctccaggcctcagtcctgctgtgagggcttccctacaccctatttaacaccacatcccacccttgcaccatttcccagtagctacaactctctttctgctgctgcacatattaatgtgttcctttatttctctctccttcctaaaaaggaagaaccctgaggccagtactttgttttttattcactgattgatttccagtgcctagaaagaaaatgcctagcacaaaatagatgctcagtaaatattttgaatgtgcacaagaataaatgagtgagtaaatgaatgaattgtaaacacaagaaagtccaaatacggaaagttactgtctgtgacttttaaactttaaagcagtctgtgagcctctcatctgacactaacaggaagagggcagctaaaacttccaggtctacaggcagaaaaatctccccaacaaatgcccccaaaagtgtgtcagctaaagctgtctagagctaccaaattgcttaaccaaggaattgattccagtggaaggagttataattttgcccatcaggatgtgccatgcattgtagaccagtgatgactgtgtccttcaaaatctccatgttctctaacgagtctttgcttgcttgcttggctcttattaaacctgttctattcctccctccgccccactgcccacagcatatactgaagccggggagtggataacctgtccgccagccatcagcccctgagggccacatctggagcagctgtggagaatggcatggtgcagagatctcaggccctcagctgctggcctgaatgagatgggctcaggccggtccccagggagaaggtaggtgcattctatagcaagtaaggcatgaacacagagctctgttgggtcagcagagagatggagcatgagacactgtgagatgggctttttgctgctgtgttgtatgtaaaccctaacttatacagatctatgggcaagaaggagcttaagtcaagtgaagaagatagggatgagatgtgaggaatggtggagagaatctgaaaagtcttggaggtgatagaagagggaaggcattcaaagaaaggatgtggattgtcatcacacaccacagtagacaacacacaagttcaagtatagaaacaggatttggccattgccaaactccaatcataaagtaatggtgaagtgctccccccaccgtcatcatccacattcagttgcagacatcccaagaagcaagaacactccccaaacacggtttaatgtataccttctcttgactaaattttgctacaacagcttgcaaatcgttgtgatggcttcttgtgtagatcaagattataaattgaggttgcgggtctggtctgtctacggtgcagaatgcaggtaagtatgactaatgcaaggcatgcttctcttaagctggcttagtaatagccttcgcattagaggcactgacactagaaacaacttttatacttaccacttgagaatcagtggccagaattaagaaaaaaaagagattgctaaaacagcaaagcctgttatttttcacagtattatatagtgatattctcatgaagacccagaactcaaaagcaaaagacttcagtttgcatttggcagtaccgttcaccaactgtgcaacaatgtgtgagtgggtgaaactctctgagactctgctgcttctacaacctttctgacagcaatggttacctcacagttactacagcattaatgccacaatgtgtacaaaaacactgctaacaaggatgcctgacaccagtgtgtgatgttattactattattgctatttcagtagaactgagagtagcatctctgagtttgtttgtttgtttgtttgtttgctttttggtttttaacttctcctttggtaagtcattggtgcaggttcaattgaaaagatgtaagcagaatgtaaaggcttcagacagcttgctaattcaaagtgtggtctctttgacaaagtctccccaacgagatattagccatagtcttctggtgctgtctcttctattttctcctttcactaccctggaacatggatgcagagcagccttcactaaagatattaaaacaaatgatagaataagctttgttctcagatgtaatcattgaggtaccatactaactcccaaatgcctatacccaaacatcttgttgaattaaataaatgaaccgcttttttgattaagccacaactctggcttaatgtgaaattgaatgcaattctaattgaatcaagtaggaaaaaaaggaaaagaaaaaaaagtgtggcctcctgacagccacagcagcaactccagaagctgattcaagaagcagaaacatggccccatactacaacttctgaatcagaatcttcttttaaaaaatatcaccaagtattcatatgctgtttatttatttatatttatttacttttttattttttgaggcagagtcttgccctgtcacccaggctggagcacagtggcgcaatctcagctcactgcaacctctgcctcctgggttcaagtgattctcctgccttagcctccagagtagctaggatcacaggcatgcaccaccacgcctggctaatttttgtatttttagtagacacagggtttcaccatgttggccaggctggtcttgaactcctgacctcaggtgatccacctgcttcggcctcccaaaatgttgggattacagtcatgagccactgtgcccagcctcatacactgtttaaagtttgagaagacctctccctccccctccccctccccctccctctccctctccctccacggtctccctctgatgccgagccaaagctggacggtactgctgccatctcggctcactgcaacctccctgcctgattctcctgcctcagcctgccgagtgcctgcggacgccgccacgcctgactggttttcgttttttttttggtggagacggggttttgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagccgcctgccttggccccctaaagtgccaagattgcagcctctgcccagccgccaccccgtctgggaagtgaggagcgtctctgcctggccccccatcgtctgggatacgaggagcctctctgcctggctgcccagtctggaaagtgaggagcgtctctgcccggccgccatcccatctaggaagcgaggagcgcctcttccccgccgccatcccatctaggaagtgaggcgtgtctctgcccggccgcccatgtctgagatgtggggagcacctctgccccgccgccctgtctgggatgtgaggagcgcctctgctgggccacaaccctgtctgggaggtgaggagcgtctctgcccggccgccccgtctgagaagtaaggaaaccctccgcctggcaaccgccccgtctgagaagtgaggagcccctccgtccggcagccaccccgtctgggaagtgaggagcgtctacgcccggcagccaccccgtccgggagggaggtgggggggggtcagcccccgccaggccagccgcccagtccgggaggtgaggggcgcctctgcccggccgcccctactgggaagtgaggagcccctctgcccggccagccgccccgtccgggagggaggtgggggggtcagccccccgcccggccagccgcccagtccgggaggaggtggggggatcagcccccaccggccagccgccccgtccaggagggaggtgggggggtcagcccgcccggccagccgccccgtccaggagggaggtggggggatcagcccccactggccagccgccccgtccgggaggtgaggggcgcctctgcccggccgcccctactgggaagtgaggacccctctgcccggccagccgccccgtccgggagggaggtgggggggtcagccccccgcccggccagccgccccgtccgggagggaggtgggggggtcagccccccgcccggccagccgccccgtccgggagggaggtggggggatcagccccccgcctggccagccgccccgtccgggaggtgaggggcgcctctgcccggccgcccctaggaagtgaggacccctctgcccggccagccgccccgtccgggagggaggtgggggggtcagccccccgcccggccagccgccctatccaggaggtgaggggcacctctgcccggccgcccctactgggaagtgaggagcccctctgcctggccagccgccccgtccgggagggtggtgggggggtcagccccccgcccggccagccgccccatccgggaggtgaggggcgcttctgcccggccgcccctactgggaagtgaggagcctctctgcccggccaggaccccgtctgggaggtgtgcccagcggctcattggggatgggccatgatgacaatggcggttttgtggaatagaaaggcgggaagggtggggaaaaaattgagaaatcggatggttgccgggtctgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgttaagagtcatcaccactccctaatcttaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaataaataaataaataaataaaaataaagtttgagaagaactggtatggacttctcttttcttctttctttttctcctttctcccatctttcctctcttattttccttaaaaagaaaagaatattccttagtccttatagaatctcacaagacaggtatagtggagatttgctcttgcccccctccctgcattcgctctcttttactgtgactacagttcttaccacgtttccagcttctgtgatctgtgtaaagctgaccccagccctggacttgggggatggaacaagtgattaagttcagtgcaaccagagcatgtggacccctggccatggtgatcgggccagcaacaggcacctgaccatcccagtcagtccactcagggctacaccctctcgggacctgaaattttcctggatatttgagtaccaagttctatcttaatgaacaagaatggggataaaacgaggaggctagagccgaagcaacctttttatacagttatagagcttgagaataaagctgacaccaaggacacaggaactggaaatggagagaaaaaaaccttgtactaagtctgcatctagactatgaggccttgtttttttcttaagcaagttgaggttgagttctctatcacttacagtgtaatgtatgcttaattatatacacaaagggaagaaaaagaacagtagctaaacgggaatgttggctcaagaatgggctttcttggtaagaaaaacttgagcctaggctgaaatgaaaaaggtaatgaaggcgtggaggggaaaagcaaaagagaatggggagggcccagagagtgagcatgacaccatccagggaacaggcacgacagtgcccaggacagggtggcaccgagttttttcaatatcccaagtctttcagttttttttttttttaaatgcatttattctttaagcttttggattcttctttcttcgtaatatatcacaaatttcattcaattttcaaaggtttatgcttggcaaacatgaatatttgctgcaacactaaatggaactgaagaggtctggtccccaacagttttcacacaattacataaaaaatgaatgtctgagaaagtgatttttgcaacaaacgtgctctgaggtgcagaaaagtaagttaagaagatgacattttcacgacttctatttcttaggtacctgaactcaatgtttataaaaatccatttaaagcccaaacctaacgtgcttattggctggtgcctggcacagcttttatgccagataaaggcagactttagataatggggcttataaaatactggtgatgattgttaggcaaggtttgtagacagaaaagcaaacataaatcccagataagactcggatagtatctctaggacatgtaatacctttaaggtagagataatgattcctaaccctgaccacacattagagtctcttggggaactttgaaaaaaaccactgatgccagcaccctcctcctgagattctgattcaccgtgaatgtgggcaggcagtgcccaggtgattctaacatgctgcaggctggacaccctctggctggggacactactgagcaccatgataagacaaaagttttcactaatctccacctatcctcttaaaacatgacttagaaaaggaaacttaatcagaaactcagacatataaattggcagcaattgcttacatagtcacttcaaaacatattcagacctataaattttattctcccctctagccattttaaaaactgcactgcttgaagctggacatgagtcccctaactccctgtgatcccagtcagtcacaagtacctgtgagcaagcaaagagcaacaggggggaagagggacgttcagttccaccccctccactgacctatttctcagtgtgagtgtctgggccttttccttggaaaccttgaagagcccccaaaggatatcagagaacttctctgtttttaacatgtgcttcctattgaagaacaaacttgggcattttcaaagtaagttatgctctttacatcatacgggttttatctagaattgcacagaagagggaaaggtcttcaaaccctatttttttcatgcggtgcccaaaaaagaggttttaccagtgttagactcatgagaaggaatatcaatgaggaatcagaatggaatagatcggaaaagccacaccacttccagctagcatgacatgcagccaatcctgccccagaaaaggatgctctcacaacttaacaatagagaatattgtattactattttctcatcaaatgtatctcaaacttgttacaaagaattgcataatgcagaatagagctattcctagagaggtacttacaaatagacgtttactgatgtgcagggaatacggtgaaattgcaatgcccaaaactgctctccagccctcgtatccctgaggttctgtgaaagagacaccagtgattctacccaagatacacaggatgctgtttccagccaaacatgcactttgatttttccaaacaatttagataactaaaatttttgctctggtataattctaccagaaaataacacgtttcatttgtctgtacatttatagtgtgtttggtgatagaaattccaacaaactgatccatagattcaatatagtttcaatcagaattcagagggcttttttttttcagactgaggggatgattagaaatagacaatctaattctaaaatacatctgagaatgtgaacaatttttaaaaataaatcggccgggtgcagtggctcacgcctgtaatcccagcactttgggaggctgaggcgggtggatcacctgaggtcaagagtttgagaccaggctggccaacatgatgaaacctcgtctctactaaaaatacaaaaaattaggcgagtctggtggtgggcgtctgtaatcccagctactcaggaggctgaggcaggagaatcacttgaatctgggaagcggaggttgcatgagccgagatcgtgccagtacactacagtctgggcaacaagagcgaaactctatctcaaataaataaataaattaattaattaatcaaagttggagacactttactgtctgattttaagacttgctataaaccactaaacaaaaataaggggaaaatcatgcaattatgtggtgaataataataatgtatttgtctttgctttttgttttatgttttttgtttcttccttcccaatctgaattccttccatttattttcctttccttattagaatcattagaatctccaataaaatactgagttgaaatcgtgtaagcagacatcttttccttgttcttcaccttaagagttattcagtctttcaccactgagtatgaaattcaccaagggtctttcctagatgtcttttaccaggttaaggaagttctcatttgttcttaatttgatagaggttttctgtcatgaatggacattaaatttttccatatgctttttctgcatatattgagatgtttttattatttttattttttaatctgttaatataataaattacatttttgtttttcgaatgataaactaacttgcattcctaaaattaaacttacttatgcatgatatatttttatctttttcttatattgctgaactcaattttctaatatttggttaagggattttgctttattttaatgagaaatatagttatgttgaaggtttttcttatgtctgtgattttggtgtcataaaataattctaactcataaaatgagttgagaattatcccactgtaagaatttgtacagaattgaatttgtttgtttcttaaatatttgttagaatttaacagtgaagacatttgggtgtagagttttgttttgttttgtttttttaattggaaaagctttaacttcaaatatgatttctttaaaagatttagttatgcagtttatcctctcttcttgagttaactttataagttgtatttttcacaaatattttcatttcattaagttgtcaaatttactaatataaaactcttcaggatgcttcctctttatccatttaatatgcatattatctgtaatgagatgcctcccttcttgatattatgtatcttcttccttttttatggtagttcagcttgaggtctatcaatattattactcttctcagctataatttgttctattgacttctctctattgttgttcagttatctactacctttttttttttttagacagagtctcactctgtcaatcaggctggagtgcagtggctcaatctcaacctccgcctctcaggtcttctgagtactgggactacaggtgcacaccaccatgacatctaaattttgtatttttagtagagatgggatttctccatgttggccaggctggtctcgaactcctggcctcaagtgatccatacacctcagcctcccaaagtgctggggttactggtgtgagccactgagtctggaccagttatctctctggtttctctctctatggtttaactcttatctctattgtttcctttcttttgcttactttgaatacaattctccattttttgtcctgattcttaaggtagaagattgcatcactgatttaggtctttattaattccaaatatcaccatttaattttataagtttctatctaacttctactttcgctttagatatatccccaaaatttctgaatattgagttttcgttcttattctgtttgagatatttaactttccttataatgtcttctttgacacattgattacttaataggtctaaatatttgagaatttttatgacatctactattgtgttctagtttaatcctgttttgataggaaaatatattttatatgacttaaatcctttaaaatttattgagctttattatgtaatccacaatataatctatctcggggaatgatacttatgtggttgaaaaagttgtgtattcttctggctttgggtgtagtgctctattaatatcagttaggtcaagttggttgattttgttattcaggtcttctttatacttactttctgtttacttgttctatcagttactaaaagaggagcgtggaatttgtttatttcttttttcagttgtatcacattttggcaccttgtattttgtaactcttgtatgatgtgcttgcctggtaatttttgactggatgatggaaactgtgatttttagtttcttgggtgcagatgttgttattttttttttcaagaatattggactttcagctggttgcagtggcttatgcctataatcccagcactttgggggaccaaggcatgtggatcacaaggtcaatagatcgagaccagcctgaccaacatggtgaaatctcgtctctactaaaaatacaaaaattagctgggcgtggtggcatgtgcctatagtcccagctactcaggaggctgaggcaggagaatcacttgaacccgggaggcagaggttgcagtgagccaagatggcaccgctgcactccggcctggcgacagagtgagactccataaaaaaaaaaaaaaaaagaatattggactttctgccacacagttacatttcttgggatcggtttgatcctttcaggtttacttttgtgctttataaagcaagcccagaatgatcttcataatagggctcatatagcctttccactaaggtgacacctttctgagggctccatccaatgctatgcagcaaggtctttccacactagctggtagtaacacaaagtattccccaccctgagtgatttctgggaagtttttggcccaggaatttttactggttcttttctagccacaagtagtttcctccgacacgtgcagatcattgtccggccaaagattttaggggaagcctctgcaggtctctagggctctctgtgtagctccctgctcactggtctcctacaccactaattttcacactaggcttcctgagccccagtctctgtatcctcaacttagcaagcctgctggtctctggttgggaacccttctctgtacttcagcatggaaaccacctctggaaaacaccagagaaaactcacagagatcaccccgtgtgtcccttccctcatggaccacagccccttgcagcctgctctccagttctccaacactgccgtttcatgttttctcattttctacgagtttttttaagcagaatattaatctggtctctcctattccatcatggttaaaagcagaaacttgtctctgttttataattcagtgaaaactctcccagatattatatatcaaaggtgctttttgtactaataagttgctagtcatcatgatggaaaaaaattacagtaaataaagtcttttgtaaagaacacttaccaccacaatagtctacgttttattctgaatttcaggctttaatttattttgagaaagggggaaaaaaaggagtatcctcaacatttaaaaactggtttcacactcaagggcagtccatgatattctcctattaaatattatctaacagaacacaacctcagacaaggttaccctgagaccatgataaaatgggccaaagcaatcctactttataattttgtctcagcatagacaaaagcaagtttattgaatattatggactgaatgtttatgttccatacaattcatatgttgaaatcttaaccccaaatataatagtatttggagatagggcctttgagaggtaatagaattagattagatcacgagggtagggtccttgtgatggaattaatgcccttataaaaaaaaaaaaaaagagagagagagaagtcgaccaggtgctgtggctcatttctgtaatctcagcaattttggaggccgaagcagatgaatcacatgaggtcagcagtttgagaccagccggaccaatatggtgaaactctgtctctactaaaaaatacaaaagttaggctgggatggtgggaggcgcctgtaatcccagctactcaggaggctgaggcaggagaatcacttgaacccagaaggcagaggttgcagtaagccaagattgcaccattgcactccagcccaggtgacaaagcgagactccatctcaaaaaaaaaaaagaaagaaagaaaatgagacactcttttacaataaactagacagatcaacaaaggccaaaagaattaagttagtgatacgttatatcactggctaaagttaattatgtattttaaaatacaccatttaaagttagctctgtcagaaagtaattgctgaaataataataacaaaataattaatatggtaacaaagaaaataggtattattatttcagaatctgctcttaccaaatgtttcatacattacctctagatttcagagccagcctgtcaaatcactgtaattattctcattttataaacaataccaagaaactctaagatttagaattttaaagtggaattctcaagatcaaagagctaagtgccaaactttcactcagttcaaactcaggtctgtttgatttccaagactttatgcccggtgatactactctgcctctttccataaatttagtagatgatgagataaaaagtttatatttaatacatgatgcaatatgtagcagttttatacaggtgtagaagcttcctgttgtctaaaaaaggtactctagtaaaatatcccacttagaaataagtaaacaggtaaagaaaagaagaggtaataaatataaggctatatactgaagaggaaatgtaagttaaaaaacaatgactatgggcggatcacaaggtcaggagattgagacaatcctggctaacatggtgaaaccccttctctactaaaaatacaaaaaatttgccgggcatggtggtgtgcacctgtaatcccagatacttgggaggctgagggagaagaatcacttgaatctgggaggtggaggtcacagtgagtcgagatcacgccattgcactccagcctggtgacagagcgagactccatatcaaaaaaaaaaaaaaaaaaaaagaaagaaagaaataatgaccagtcaaagtggattataacacttctagttcaagggtcatatgaggaacatggctagaagatacaatttttacaaaagagatatttgctgcccactaaggaggcaagaaaaaagaaaaatttattggcaaggataatcaataaaaatatgaaaatatgtcagctctatcagtgaaataaaggcagaaattgtagatgaggaataactgaaagcaggatgattgattaacatcagcattattaaacagtgctttctaagaacataccaattactcttgttctgaaaagtggagtgattaaagagtcctctgtgccatttgtagagcagaaacatccagctaacaggatgtgtatgtaaaaggagaaaataatacctaatcaaaaggtctttacctttggtaaaagttcattatatcctctcaagtctgatcattttaaagtatgatatgctttatgcaactgagcatgaacttttctgaacaaaatctggggtggagggtgaacatgaagtgcaggtatgaacacagaagctccagcagatggtgcaggtaggtggggaggggtgaggcctgataataaattatcatccattttctttcataaaaattcgatgattataattcttacaagatgattactcctccctatgctatcttctgcactgacacaatcaatataacatcaggttattcttcggaactatctagccctcactgatgcttaaagtaacatttttgtttattctatgacattgttgtgtttaccaaatttctcctgatgtagccaacacatagaaaataacctaatgcaacataaagagaacatttatacttgaagcaaatgtagtttggcaaattttcaatcagcaaacaatcaagaaaagaataaggctaacaaatccttcttcaatatcccttcctcaccccccacaacctactttttagggtcaaaggctatgtcatgaagccaacaggaaaatcaaaaagtgtatttttatactcattgtgaatatttatatctgtagcaggattggcatttctatactgtgctactgtcaagacctctgaaaagatctattatttatctctgccttcctcaaaaataaatttaatttaaaatggatgatgtacaataagaaacattaaaataaaggcagtataaaaacaaacatctccggcaccttaagatctatcattgttttgccaagatatactgaaataaaattgaatttcagagtttatgattaaaattatgataaattttaaggattatagattacatgtttggaaaccaaaaattctctctgaatagtgattcacaacagcatggaatcagttttaaaatagaaagaaaaaatgtctgttttcttggctttaaatactaagattactcaatattagtaagactagtaattattatcagaatataaaacacttactgctgagaattatgtgcattttaaataggaattagaactttttcatatgctaatttttataagccatctgtaaatacgtttgatgaaaaacatcacagtgataagggctttccattttgtctttatttaaaaatgtatacttgattggttaatgtgatgattcagcaatatagtaaaaattacccaaagcattacacaatttaaaattattttttaaaaagacgaaggcacacattttatcacagtgatagtttagtagtcattgtcttagtttgttttgtactgctcttaaaaaaaatatcacagactgggtaatttataatgaatagaaacatattggctcatggctctgaaggctgggaagtccaagattgacaggccaatcatcccctcaatcccatgtcatcccatggcagaaaggcatcccatggccttatgtcatcccatggcagaagggcaaagagagggtgagagagagccaaaagggaaaaaagcacatcctttcataaggaacccaatcccaagatgtggaactcacccccacagtaatggcattaatctattcatgagggcacggtcttcttggtctaatcacctcttaaaagtccaacctcttaatatttctacaaggcaattaaatttcaatctgatattcagaggaaacaaacattcaaacttagtctgtcttacatacaaaatatgttattttcatctctatagcctcaaaatcttaactcattccagcatcaactgaaaagtctaaagtctcatttaaatcagacatgggtgggtagggaggatgatggacagaagacaggactaacatgcagctcccatttggacagacagaacagcatctgaagacttacattgtgaactcttgcttcaataaccactataggaacatatgaggaaaaccaaaagaattcacagaccctttatagcagctgcttgctgctacaagtgctgtgagacagccagaaaactgtgagttcctaaattgttagagggggaaaattcagcctctgaacatgcattcccactggggaacctaaaaatccagatcacaagggaaggatttaaccttacctatacctgaaatggatttaaggagctgagtctatagccataccaccctgaaagtgcctgatcttgtttgatctcaaaagctaagcaagatccagcctggttagtacttggatgggatttagggagctgagtgaaatataaaagtagataaagcagcagaaagagccctgtaggcactcctggtcaccagcttgagtccagggaagccattcctagccttacctcacagaggtccttggggaagggaaggcagctagcagaattggggaggggccacagggtaaaggaagctcctagttgaacttggtaataattgcaactgagcatgaactttcctgaacaaaatctggggtggagggtgaacatgaagtgcagaaatgagcacagaagctccagcggatggtgcaggcaggcagggaggggcgaggcctgagacccctacttgctttctcagtcaggaagcttgtagcctggggcaagatctcagccctgcacagaggctgcatggatataaactcagtgcagatgggcggggcacagcaggagtgagactggccttgctgactccatgggaacagggtaaggcctgtcactgctggcttcccccagttctctgaaaacctgaatgaagcagcagaggcattcataatcccccttggaacataactccattggccaaagaaccacccgctcaatccctcacagtgcccgcagcaagccccaccaaagaagagtctgagctcggtactgcccaatcctgcccccacctgatggttttctctacctgcccttatagccaaaggcaaaagacataaacttttgggagctctatggccctgcccatcacctcagaaacctgagtacctatcctgaccaatgtagggcaaacccatatccccctcctattgccacagctggtactctctagaaagtaccacctcctggctggaggccaccaactcaagctattatttcaactcataacagaacaaccctgctccaaagaaggagcaaacaacagcaaatttcaccagctgcaacaccctggctaaccacagatcctgactctggccatgtgacagcttcaccactagcataatcagcattcaagaaaaccagcacactaaataaaactccaacaatggactccaacagagtccacttcacttccccacaacctccaccagagcagatactggtatccatggctgggagacctaaagacagatcacatcacaagactctttgcagacattctccagcaccagcctacagcccagtagccctactgggtggctagacccagaagggcaataatggttaccgaagtctggctctcagaaaaccctatccctagggaaaaggggagaaaaccacatcaagggatcaccccatgggacaagagaatctgaacagcagcccttgagtcccagatctttccactgaaacagtctacccaaatgagaaggaaccagaaaagtaattctgaaagtatgacaaaacaccgttctacaacatccccaaaagctcacactagctctctagcaatggatccaaacaaagaagaaatctctgaattgccagataaagaattcagaaagttgattattaagctactcagggaagcatcagagaaaggtgaagaagatattttttaaaaatacagaatatgaatgaaaaagtctgcagagaaatagatagcataaagaaaacacaatcacaacttctagaaatgaaagacacacttagagaatacaaatacactggaaagttttgaacaataaaatcatacaagtagaagaaacaacttcagaattcaaaaaaaaaaaaaaagaaggcttttgattaacccaacctgacaaagacaaagaaaaaagaattttaaaaatgaacaaagcctcccagaaattttggattatgttaaacaaccaaacattagaataattggtgttcctgaagaagagaaatctaaaacttttgaaaacttatttgagggaataatcaaggaaatcttccctgaactttctagaggtctagacatccaaatacaagaggctcaaagaatactcaggaaatttaacacaaaaagatcatcacctagccacatagttatcatgttatctaaattcaagatgaagggaaaaatcttaagagttgtgaggcaaaagtaccaggtagtctataaaggaaaacttatcagattagcagcagatttttcagcagaaaccttacaagccaggattgaggttctatctttagcctccttaaacaaaataattgttagtcaagaattatgtatccagcaaaactaagcttcataaatgaaggagagataaagtataattcagacaaacaaatgctgagagaattcacctctatcaacccagcactacaaaaaaatgctaactcttgaaacaaaccctcaaagtacaccaaaatagaacctctgtaaagcacaaatctcataggacctataaaacataacacagtggaaaaaaaacaaggtattcaggcaataactagcacaataaataggacagtacttcacatctcaatactagcattgaatgtaaatggcctaaaggatccatttaaaagatatggaatggcagaatgcacaaaaatccaacagccaagtcttgctgtcttcaagagatccacctaacacataaggactcacataaacttaaggcaaagggatgggaaaagggatttcatgcaaatggaaaccaaaagcaagcaggaatagctattcttacatcagacaaaacacactataaagcaataacagtttaaaaagacaaaaagagacattatataatgctaaaaggattagcccaatagaaaaatatcacaattttaaatacatatgcacataacactggagctccaaaatttataaaacaattattactagacctaagaaatgagatagatggcaacacaatcataatggggacttcagtactccactgacagcactggaccagtcaccaagacggaaagtccacaaagaagcaatggacttaaactataccctaggaaaaatggacttaacagatatttacagagcattctacgcaataactgaagaacatatatatttttttcatcagaacatggaacattctccaagatagaacattatgacaggccacaaaacaagtctcaagaaatttaagaaaactgaaattatatcaagtattctctcagatcacaggtgaataaaattggaaattcactctaaaaggaactctcaaaaatatacaaatacatggaaatttaaaaatctgcccctgaatgatctttgggtcaaaattaaatcaagatggaaattgaaaaattgttcaaactgaatgatgatagtgacacaacttatcaaaacctctgggatagagaaaaagcagttctaagaggaaagttcatagcattaaatgcataaatcaaaaaatctaaaagagcacaaacagacaatctaggctcacatctcaaggaactagagaaacaaaaacaagccaaacccaaaaccagcagaagaaaagaaataacaatgatcagagcagaactaaatgaaatggaaacaaacaatacaatacaaaagacacaaaaacaaaaagctggttctttgaaaagataaacaaaatcaatagaccattagtgagattaaccaagaaaagaagggagaagatccaaataagctcaatcagaaatgaaatgggtgatattaaaaccaataccacagaaatacaaaatatcacttgaggctactatgagcacattcgtgtgcatagactagaaaacctagaggagatgaatacattcctggaaatatacaaacctcctagattaaacctggaagaaatagaaactctgaacagaccaataacaagtagtgagattgaaccagtaataaaaattgccaacaacaacaacaaaaagtccaggaccagatggattcacagctgaattctatcagacatccaaataagaattggttccaatcctactgaaactattccaaaagataaagaaagagggaatcctccgtaaatcagtctatgaagccactaccataataccaaaacgaggagatgatgtaacaaaaaaagaaaactacagaccaatgtccctgatgaaaatgatgcaaaaatcctcaacaaaaacctagctaaccaaatccaacagcatatcaaaaagataatatacaatgatcaagtgggtttcataccatggatgtagggttggtttaacatacactagtcaataaatgtgatacaccacataaacagaattaaaacaaaaaatcgtattattatctcagtagatgtaggaaaagcatttgacaaaactcagcatcctttatgattaaaaccctcagtgaaatttgcatagaagggaaataccctaaggtaataaaagccatctatgacaaatccacagccaacattatactgaaagcactacccctgagaactggaacaagacaaggaggctcactttcaccacttttattcagcatagtactggaagtcctagccagagcaatcagacaagagaaagaaagaaagggcatcctaatcagtaaagaggagtcaaactgtcgttgttcaccaatgatatgattgtaccagaaaaccctaaaggctcatccaaagagctcttagatctgataaatgaattcagtaaactttcaaaatacaaaatcaatgtacagaaatcagtagcactgctatacaccaacagtgaccaagctgaaaaccaaatcaagaactcagccccttttacaacagctgaaaaacaacaaacaaacaaacaaacaaaaaccttacgaatatacctaaccaaagaggtaaaagatctctaaaacagaaactaaaaaatgctgctgaaagaaatcatagatgacacaaacaaatggaaacacattctatgttcacagatgggtagaatcagtattatgaaaatgaccatactgccaaaagcaatctataaattcaatacaatttccaccaaaatatcactataatccttcatagaactatgaaaaacaatcctaaaattcatatggaaccaaaaaagagcccacaaaagcaagactaagcaaaaagaacaaatctggaggcatcacattatctgactataaactatactacaaggctataaataccaaaacggcatggtactactggtataaaaacaggcaagtagaacaatggaatgaaatagagaactcagaaataaagccaaatacttacagccaactgatctttggcaaagcaaataaaaacataaagtggggaaaggagaccctatttaacaaatggtgttgggataattggaaagccacatgcagaagaatcaaactggatccttttctcatctaatacaaaaatcaactcaagaagggtcaaagatgtaaatctaagacctgaaaccataaaaattctagaagataacattgtaaaaactcttctagacattggcctaggcaaagacttcatgaccaagaacccaaaagcaaatgcaacaaaaacaaagataaatagatgggacttaattaaactaaaaagcctctgccctgcaaaagaagcaatcagcaaagtaaaagacagcccacagagtgggagaaaatatttgcaaactatgcagctgacaaaggactaacatccagaatctataagggaactaaaacaaatcagtcagaaaaatgcaagtaatcccatcaaaaagtgtgctaaggacatgaatagacaatgctgaaaagaaggtatacaaatggccaacaaatatatgaaaaaatgctcaacatcactcattatcaggaaaatgcaaatcaaaaccacaatgcgatactaccttactcctgcaagaacggccataatgtaattaaaaaaccaaaaaatatcagatgttggtgtggatgtggttaaaaaggaacacttttacaatgctggtggggcaaccactaatacaaccactatggaaaacagtatggagattcttaaagaactaaaagtagaactaccatttgatccagcaatcccactactgggtatctacccacagaaaaagaagttattatataaaacagacacatgcacaactatgtttatagcagcacaatttgcaattgcaaaaatatggaaccagcttgaatgcccatcaaccaacaagtggaaaacgaaaatgtggtatatatatataccatgaaatactactcagccataaaaatgaatgaaataatggcacttgcagcaacctggatggaactggagaccattattctaagtgcagtaactcagaaatggaaagccaaatatcgtaggttctcataagtgcgaactaagctatgaggatgcaaaggcattagaattatataagggactccaggtattcggagtaaggatggaagcgggggtgagggatcaaagactacacattgggtgcagtgtacactgctcaggtgttgggtgcaccaaaatctcaaaaattaccactaaagaatttattcatgtaaccaaacgccatgtgttccccccaaaactattgaaataattaatagtaacaataataaaagatagacaaaaaattaaataaatcagatatgggtgagactcaaggcatgattcatcctgaggcaaatttccccacagctgtgagcctgtgaaatcaaaaccagttatgtgcttccaaaatgcaatgtgggacatacatagaatagacattccaattacaaaagggaaaaacaggaaagaaaaaaggagcaactgttcccaagtaagtccacaatccaacagggtgaataacattaaatcctaaggctctcgaattatcttccttgactctgtgtcctgcctcctggacaaggtggggtaggggttgggcccccaaggcctcaagcagcccaagccctatggctcagcacacccaaagctctcgtgggttgaagtcttgtgctgcaagctctcccaggctgacattgcacactggcagctcaatagttctgggatcttggtggcagtcccactcccattactccactaggcattgtactcgtatggactgtctgcaatggctttgctcctgtgaaaaggcactgcctggggcctcaggctgtccaaaacatcctttgaaatctaggtggagaccatttttgaccccatagcccactcattctgtgcatctgcagaattaataccaaactacggactctgtaagtaagtgtataaaatatgctttttaaagatgttcttcatcagttagttcaatgccttgctgtgagaagtttatatatgcgcattgaaaacatgaaatgagtgtgttacttcaaagatgcattgtgagctcctttattacagtgaattgaaccgcttcccaaacaatgaactctatcaacaaatgtacaaatacacatttaaaagatgttccttatcatttagtttattgccttattgtgagggattttatatatatatatatatatatatatatatatacacacactgaaaatataaatctcggcatgttacttcaaagatgcattgtgaagcactttattaaaatgaattgaactgtttaacacagtgaactttttaaccacatgtttaagacatgctctttaaagatgtcccttgcccttgtgttctaagccataatgtgaggagtttatacatccacatttaaaagatgaatcgaagtatgttacttcaaagatgtattgtgagctgacttattacagtgaattggactatttaccattctgtgaattctgtaaacaagcatataaaatgtttttaaagatgttctttaccaataagtttaaagacttatcgtgtgaggtttacaaatacatactaaaacataaatctgctgccaaggcttaccacttgcattcctcaaattaggggcacaatccacacctaagcccacttgagtgacagctgagatgaccaaggagcactgtttgggaatttggggggcagagacttaaggtggtgcagggtagtgaatgctgattttttttcaggcatgctgagctgctctcttgaggctgcctcaaagatctctgaaatgaattgggtgtcattctcccattgtcttgatgaatggcacctggcttattttatctatgctaatccctttatcaaaggatcaattggctgcacccttgcactttttttgttctttacttggccaggctgtgaattttctaaatctttatgttacacttcccttttaattataaaggtcatctttaaatcattcatctcttcctacattttactctaggcatttaatagaagctgtgcagctccttcaacgttttgcttagaaatttattccaccagatgtcccagttcattctcttaaattcagccttacataaagccctctggtgtggacacaattcagccaagttatttgccacgttagaaaataatggcctttactccagtttccattaccttgttcctcatttctgtccaagaccccatcagaattgccttactgtccatatttataccagctttctgatcatagctacttaagcaacctctaagaagttttacactttccctacagctctccttttcttttgagccctcgccagaactgcccttaatgatctgttcatggcaatacaagctttttctatcctggttctccagattcttcccatttgtgcccattatccagttccaaagtcacttccaaatattcaggtgtttgtcacagtaacaccctactctttgataccaattctctttctgagtcattttatgctgctataacagagtaccacagatggagtaattcataatgaacagaaattcgttggctcacaattctagaggatgggaattccaagattgaagggccggcatcctttaagggccttcctgcagtataatcccatggcaaaagggcaagtgagggcaagagagagagagcaagaagaaaccaagtttgtccttttataaggaacccactcccatgataaagagcttgctcccacaataagaaactcacttccacaataacaacattaatctattcattacctttcatggtctaatcaccccttaaagttcccacttcttaatgctgctacaatggcaattaaatttcagcatgagtttcaaaccatagcagtcatgtaaaaggaaattaataagagacaaaagtagagcaaaggcaatttaaaaaaatttttttgattggttgactgtgttttaatactataacctaacagttcagccttctatgaaaaagaaatttagatttcttctaaccatatttattatagaaataaaatcatgttttgaaactaagaaaccacattgaatatggaaacaaatttcaggatcaaaagcttctgatatacagaaatcctgccaatacttaaaaacagtctgcattctacatatccgagtttcagaactatcccataggttgtcatcaatgggaaaaatctttttaattatctaattagtatttgtgtttcaaacacttgtaattgagagaaatctatgaataaaacatcaaattgcagtttagtagcagtattagtaaacaatatgaccttttgatattgaagaattcatatttcacactgaaattatgatggtgaatctgaggttttcataaagtatcaaatgctaaaaagtacactaagatagcggtcagtttgagttgtaataataatgctacagggctaggcatggaggctcatgactataatctcagcactttgggaatctgaggcgggcagatctcttgaggccaaaagttcaagaccagactggccaatgtggtgaaaccctgtctctactaaaaacatataaattagctgggcatgatggggcatacctgtaatcccagctacttggggggctgaggcacaagaatcacttgaacccaggaggcgaatgagctgtgatgggacaactgcactccagtctgggcaacagagagagactctgcctcaaaaataataataatgataataataattataatacagactcataatttggggcaaatcagttaactaacattgaagttaattttattatctgtaaaatgagaggtataatcccatgttttggaagttctaatgtcagttaaaagcttgaacttgtttcataaattatagtcacagctataaattaccttctataaaatgcctattttaagtcaagtaataaacatttttgcttaataaacattattgctctttgcatgcagtaccttaacatgcaccacggaaatatgtgcatttcaggatttggaaacaaaggttcacggagggtaagttgcccaatgtcacacaagtaataaatgcagtgctggaattccagctgagttctgtctgtcttcctatccttatgccaactcaatcatacattctgatttttatccaactgatgacagatattcaatcattcaagccacatggagaagcttaaaataattgttcaactatcacataatggcatttaaaaagctgtctatttgaactgtcaccatgagtgatttaataaaaaagtttctattacttacagatgttccaaagatatgagtcctttaaatgtttgcttatctagtgcatggatttcattcttatacaggtacctggaaaatatatagaatgtcattaaattataaattagtagagataccacatgtcttagatacaaactttttaaactataagctgtggaccttaggagctttgtgggatgtccatagattctctaacaatatatagaaactgttatttcacttaaatgtgttcaattggtaagagttctaagcctctcatcaaattctcaaatggatccttggttcaaaatattaagaaacatagagtatttgtggagaaattctgactaatggagtcatatatactgagtaacaacttctctaagaaaaatatgtttgactataaacaattttttaaaatttattttatgacactgaatatattcaactggtagttataaaactggcaaataccaccatgggattcatcttaaggggataaaagcatcttagagatgcataagatgaattttgatcctcctgtggctgctgttgaaaatctgcagggaagaatactataaatggatttataaatacgatgatacaactaatctttaccaaagggtttaaagaaaacaatttatgtgacatatgagcactttctccatcgtttttcttcaaccataggttagtaaggtgatttcttctccacactctttgttaatgtcatgaaaatgaagccctggatcttttctacttgtgcctctcagggtttgagacaatcagaattcctgaaaccttctatcaagtgtcttcggaatgtgctcttgcatattgtcagtgcatcagaatcacctggtggtttgttaaacacaccaattctaaagttcacccacaaacctactcaatcggactctctcaggatattttctagataattcagttgcagctcatctgcagtcctgccttaaaggccatcaaaatcacagttctgcctaaaaataaagaagggactgattttctataatttgcttagttaagcttttaaagttccaaaccagtttcttttcccccagtttaggactccagtcagtttctaaaagtagcagtgaccagtgtggatttacatctaactagatattgtttttcctcagcattaattgatacttcagaagattttgcttttactccaaatctcaaaaatatagctatgtgttagaattcaagaaatacaatattctagaaccatgtttcttcaaacagtttataagaagcattgagaagtcgtctcaaaactcactagtggttctcaagtgtggatgtatgcaaatcatagtgtaggtacgtgagtcagtagtatttgtaaggcctcattttgagttctacccaagccttatagtaatgtctgggtccctgcctccacaaactctaatttaatgatgggtccagggtacagactagacattgagattcttcatagctccacaggagataataatatgcagcaaggttgaaagctactgttactaggtacagaacaggtgaaagtattctgtaaatgtaccccactggattcagaactacctcctggtaaaggcccttagactattagaatgttgagagccacatgacttcaagggtgtcatgtcttgagcataaagaagttgacttctactgagaggcatacaaacactatacttggtttttattattatcgtcaattttaaataatgaggagttgtttcataaagataaaatgaaatcataaaatattcatgaaggagtttcaaaacttaaaactaaaggtttcccataatattttatctcagatacacagattcactttagactgttatattgtagaaaatggttcaggaaaaataagcacaaagtagggggaaaagagcagaacttctgcaatcagatctgcacaaattgattaaatcagtaaagtatgaattccagatatgttactacctatattcaagttataggaccaacaggtttgtatgctcgctgaagagtaacagaccaatacactgagatagcagagtttgcagcagagaaagagtttaattatcaacgggcagccaaataaagagacagaaaggaccctcaaattcttccccccaatgagttctgggctggggtttttaatggattagtagagggaaagaggttagaaaattggggttgttgattggctggaataagggggatattatttggatgtggaaaccgcattctttggtgagtcagctcctcatgaggtccttcagaccttattggtgtgcaggacctaaaaggatatctcaaatggaaaacttaacattttataattctcaagttgttatctacagagcagttaaggagaactataatcttcatgggtctatgtgattttaggacaataggcacaaaacagctatgaggaaggggtcagagagcagctgatctcatgatgaatgctgatgtgctgaaagtttggcttatttttgtttcttccaaaccccccccccccccgccaccttctttcctgattaattttatgaagtttatagggacagtttcattaacaccagtcacacagcttcccgtttcccataggataatggtattcagctaaattcaaatctctccacacacctctgaaaaccacacagttcaacgaaagaagaaaaacacatcacccagagcacaatctaccacaaaaccagagaaagagagcattagcaacttcagtttacatgtaagtggtgaaaacactaaagcatctctagagtccaccctcagcagagtcaagtgggaatccccactttttacagatgaagggactctggcagaaggggtagaacaacaaagggtgagagtaccatcctgatgagaacttaagattgaggaaattagaaccctggctcctaaggaattgaaagaaagggcttggaaaatgagtgggagaaagcaccttgctagcatggggtaacttgtggagaattggtattaacaggaaagaagaaagcaagaagtcaaagtaaaataaattaggaccaggattttaaaaatcaagattattgtgtaccaagataatcactgtaaggaaaattacctgtaaatactaaaggaaaattaagaaaaacaaatctgatactaaatttgatagaaatacaaaacctagaaatagaaattttgatcaaaatctaaataaaaaatcaaaaagatatttctcaactatttcatttacaatagcttataaataataagctacctaggaataaacttaaccaagcgggttaaagacttctacactgaaagatacaaaacattactgtaagaaattaaagagaatgtgaatgaattgaaagatttcccatactcatggccttaaagatttaatatcgttaaaatgtcaatactactcaaagtgatctaaaaatttaatacaatccctatcagcatttcaatggcatttttttttgcagaaatagggaatctcatcctaaaatctatgtgacatttcaagaggccctgaacagttaaaacaatcttgagaaagaataacatagttgaagattttacactttctgatttcaaaacttataacaaatgtatagtaatcaaaacagcatggtactggcatagaaacagatatacagaccagtaggaagtccacaaataagcccttgcatatatggtcaaatgattatttacaagagtaccaagaatacacaatgaggaaaggaaaatctgttcaataaatagtgttgggaaaactagctctccacatggaaaagaataaaactggaaccttgtaccatatacaaaaattaactcaaaatgaagcgaagacctaaaactgttagaaggaaacatacagagaaagctccatgaccttgggtttggcaaatatttcttaaatgtgacaccaaaagcaaaggcaacaaaagtaaaaataggtaaactggactacaccaagatttaaaagtttggtatgtcaaagaatacagtcagcagagtgaaaaggcaacctgcagaatggacgaaaatatttgcaaatcatatatctgataaggagttaatatccagaatatacaaaggccttctacaactcaacaacaaccaaaaaaaaaaaccatttaaaaatgggtaaaggactttaatagacagttcatcaaagaaaatatacaagtgaccaacaagaattcactaatcattagtgaaatgcaaatcaaaaccacaatgagctatcacctcacatgttaggatagctactttcaaaaagacaaaataagcatttgtgaggatgtggagaaataagaatcctgtacactgttggtaggaatgtaaattggtacagccactatgaaaaactgtatggagagtccttaaaaattaaaaattcaattaccatctagcaattcctaggcaaatatacttctgggcatatatctgaaagaattgaaagtagagatatctgcacacacatgttccacaccagcactactcacatagccaagaggtggattcaacccaagtgtccattggagagtgaatagaaaaacaaaatgtggtatatacatacaatggtatattattcagccttagcatttcaggaagccaaggcaggaggatcacttgagcccagaagttcaagaccagtctggaaagatgagatagcaagatcttatctctactaaaaaaattttgaattaatttttttttaaaaaaacgaaggaaattctgacacatgctacaaaatggattaacattgaggacattaaactaagtaaagtaaaccggtcacaagaagacaaatactatgtgattcctcttgtatgaggaagatagagtagtaaactcgtggtgacagaaagtagaatagtggttgccaggggctacagagagatggaaatggagagttatttaatgggtatagagtttcagttttgcaagattaaaaggttctggagattgattacaccacaatgtgaatatattgaataataccaaatcatttagaaatgtttaagatggtacattttatgttttgtattttttaccacaattacactttttaaaaaatgttaaaccgacataaaatcatctaaattatataaaataactgtgtctacataaaaattaaaactacatccaaaacattgacagtgataacaggcctggggttttgcacaaatttattttcttcattgttctttttcatatttcaatattttctaagatgattatatattgatatattgctttttcatatttatttcatatttatttttattatatgagtaagaaattatatccctttataaaatatataattttaaagaaataaatcaaactcatctacatgttcttcaccctggataataacattacttttaaaatgtgtcattttatattttgtgctatctttttttataaaaatgatatttagtgtataaaatattatgttactttttatcttaacaactggaagacattaaccaacttattttatccctccatgcttcattaaatttatttagataactaaagattctttccctaattccaaaaaatattatgtgaaatttatagccccaataataacttatacgaatgaaatcacagaactcaaacatcatttatttccttttaagtctcacatagctattatataggtttgacactaaaattttggggaaatgcttgctgaactaatgtattaagtttttcactccaccctctcagtgtagataaaacttattgggcttttggaccaaggagtgttatagaggggagcaatgaaaagcctaaaccctccccatcaaacacagaattagttccaagggaaaagtaataaaaatcaaaatagttggtaggtgtgagaatagagtctgtaccctcatttcctgatggttgctctggaagatgacagacatcacagataggtttctaacctaccatgggaccatagaggtgctgagatggctgtaagatgtatcaaggcataaaactaacctgacaaatcactgagctcttcaatggggtggggaagagacaaaggtttttgcaggctttatagtgggtggatgtgacaccaagagtcatggacttgcgagggagttgcagttgtaatggagctgtcacaggagaggttggtttgctcttgcaaccctgtgacaagaaagaaatagagtagccccagatgtcatgactgtgctcaaggactacctagacttgtgtttcacctcacagaatgagaatgatcacagactagagagcaagcataatacctccatgaaaacaaccaagaggtctcatgaagccatatggagcctgggcagccatcttagcccaggcttccataacaaaagtacatagactggatggcttgaacaatagcaatttatatgctaacagttctagaggctgcaaagtccaagatcaaggtctggcactgtttggtttctgaagtctctcttcctggctcgcagatagccactttgtcactgtgcccttacatggcacagagagagcgagagcaagcccccatgtctcttcctctttcaaggacactactcccatacaggggctccacactcatgacctcacctaaacccaattacctgctgaaggctccacctccaaataccatcacactgggtcttagggcttcaagataggagtcttgggaggatacaaacattcaatccataacagtattttagattgaatagagagaaaagaatgagtaacagagattctgaatggactctatttaccccaaatggtaaatttacccaaattgggccaagatgttttctgccattatgtggaatgaggtccaaaataataactggcttacaaaaaaattattttttgcactactcaatacatagactgataaattcacagttgatacacaccccattgtaaacatatttccatgtgaagaactacacagtaagttgcaaaagttgcacacctcagtctctgtgtggtatcatgctctgctcaatatatttaaaagacagtacagagcaatgtaactttctattatctataaaaattccatgcagattttcaagtaataatatatgtgaaaataaaaatgcaaaataacttaaaatgtgaaataaatctagttgttaattcaaagttggaaagtcatttctatatacacaaaatctaaaagtcatgaaaaaatgtttgactacatgaaatgtcaaggaaattgaaatcttgttttctaaaagatcctacatttaattacctcccagtataaaaggacacttgctattcagattttattttcaattactatttttcactagaagaaattcaactctttgaagacgcagctgcttcaagttctggggcaacaaaagtatatgacacaatgtttgacaaaaagcactcaaagtctaacgggattatgtcaaaaggacaaaagagttagctggaagagtcttccactggccaaatttgggactatttgtgggttagaaaaagggataatggaactgattataatacgtagaatttattttatttccaacttttattttcggttctgagggtactgtgcaggtttgttacatacgtaaatttcaggtcacagacggttggttcacagattattttgccacccagataataagcctagtgctcattagggagtttttccatgctcactctcctcccaacctccaccctcaagtaggcacactggtgcctacttggacacatttgtgtccatatgtacttaacatttagcatttcatgagtccaccgagataagggagaagaagagaaaatgacagagacacaacataatggggcatgggaacagattccttcttttaagaagaataccagctagtacagggagtcatgaaattaggaaatcataattttgcaatacaatataaaagtatacttatgcaaggctcatcaatgatgccaaaaccattggtgaaattttgtatatgggaaagcaattaactttgatacattaaccttgaatcttataaaccttgttataatcacttattagttctaagagatttgtgttgattgtttgggattttattgataagtaatcatgtaatttgcaaacaaagacagttttacttctcccttcccaatctattgtttccacatttcattagctaaggcttccagtacgatggtgaatagggatggagagaggggacatcctggccttgttcctgagcctagtgggaaagcaatacaggttaagcatccctaatccaaaaatgtgaaatctgaaatgctccaaaatccaaaactttttaagtgcggacatgatgcaagggtaaaattctatacctgacttcctgtgggaggtcgtagctaaaactcagtcacacaacatacagcttattcagtgtccccaaaggaaaagggctctcctagcccccttcagctgcaatatatcttttcctaaataaataaataaataaataaataaataaataaataaatagatagatagatagatagataaataaataaatacagtgcacagtaactttttagttgaaaaaccacacaataggtggaggctgaaagcctgccattgtttgtcattgctgttgttcaacagctgatgcaggtatctggtgatgccactgccctgcttaggtactctgcacactatattttttcactgtaataataatatgtcgttttttactattaagtacttatgtgtgaataagtataaaaaaaagattccaagtcaggaatgagagtactgtcaaataacaacagattgtctatatggatggctgagacagtgacacctttgctttctgatggttcaatgtacacataatttgtctcatgcaaaaaattattaaaatattttataaaattactatcagtctatgtgcatcaggtgaatacatataatgtattgtgaaacataaatgaatttcatgtttatatgaattccatccctaagatatctcattatgtatatgcaaatacaccaaaataaaaaaaaatccataattcaaagcatttctggtcccaagcatttcatataaaggatacttaacctgtagtttctcaccattaagcattatattagccataggggttttttttggatcttctttattgagtgaagagagtaccctcgcttcctagtttgctcaggttttatcacaaatgggtgttcaatgttgccaaacgcattttatgcatcttctgatataatcatatcacttttcttccctaacctgttgatatgatggattacattatctgattttcaaatgttgaaccacctttgtatacctgggatagtataattacttttatacaatgttagatttgattagctaatattttgttgaggattcttacatttatatttatgagagatattggtctgtggttattatttcctgtaatatatttttctggttttggtattagggtaatgttggcctcagataattaaagttaggaagtattccctctgtttctgtttttctggaacaaattatagataattaacgtcattttttctttaaatgtttggtagaattcaccagtaaaatcatctgaatctggtgctttctgttttagaaggttattaattattgattcaatttgtttaataaatatgggcctatttagattatctctttcttcttgtgtggtttgttacattgtgtctttcaagaaattagtccattttatctaagttaccaaatttatgggcttaaaattgctaataatacccttttattattcttttaacatctatggttcactagagatggcccaattttatgtgtgatattagtaatttatgtttattcttttttttttcttcactatccaggctgggagtttgtcaattttcacaattttttcaaagaaccagttttcacttttgtcaaatttctgtattgtttcccattttcacttttattgatttctgctctattttgtaattatccatttcttctgcttgtttaattttatattgcttttttttctcttgtctcctatgattggaagtctagattattgattttatatcttttttcttttctaatatatgcattcaacactatacctctaaggactgctttaactgcatcccgcgaaatctgatgagttgtatttttacttttattcagttcaaaatacttttaaatttcccttgagacttctttgatcagcatgttacttataaatgtgtttaatctataaatattttgttattttccagctatctttcagttattaatttctagtttaattccattgtggtttgagaacatactttgtatgctttctatttttttaattagatgagatgtgttgtatggcatataatatggtccttcttggtgaatgttctatgtgagcttgagaagactgtgtatttctgttgtcactgggtggagtattttacaaatttcaattagacccagttgagtgatggtgctgttcagttcaacttactagttttctgcctgctggatctgtcaattgctgatagaggcatgttgaagccttcaactatcatagtcgattcctctatttcttcttgcagctctaacagtttttgcctcacatattttgctgttaggtgcacatacattaaggattgctgtgtcatcttggaaaatgaatcactttatcattacataatactctctttatccctcaatactttttgtttttgtccttaagtctgctttatctgaaattaatatagctattctagttttcttttcatttgtgttagcatgatgcaactttctccatctctttatttttaatctatctataattgattatactatttcatgggtagtgctggtaccttgtaacagagtatagtcatccttcagtatccataagggattggtttcaggacctctcgaggacaccaaaatctgtagatgctcaagttctgatataaaacgatgcgacatttacatataacctatgcacatcctcctatataccccaaattatctctaaattactgataatacctaatacaatataaaaacctatgtaaatagttgttgaactgtttagagaataatatcaagaaaaaagtccctatatgttcatacggatgcaattttttcccaatattttcaatctgtgatcagctgaatccatggatgtgaaactcataaatatgaagggctgactgtatttccaatttcttttttctatcccttttaacaattattcctgtcattccacttatccataagctaccaaatttattgtatttatttttattctgaacaaatttttatccgttatatcaataaataataaaaaataaaagattatattttaccttgatttattccttctctattgctccaccttcctttgtataagtctgagtttcagatctacatcatttcccttctctttgaaggattttttaaacattcattgcaaggcaggtctattagtaacaaatttcctcaattcttatttgtctaagaaagtcattgtttcctcttcaatttgaaggatttttatcaatacagaagtctaaactggtggtttttactttcaatgttttaaatattttacttcatgctctttttgcttacatgttttctgagaagtccagtgtaatttgtatcctttttcctatacaggtaaggtgtttttacccctggctttcaagatttaattctttgtctgtttttctgcaatgtgaatatgctatgtctaggtgtagattctttggtatttattctgctttgtgttctctgagcttttgggacctgtgtttcccatctgtcattatttttggaaaattatcagccattattacttcaaatgttttttcttctcctttcacattttcttccgatctggtatttccattacatgtatgttacaccttttgttattatcctgcctttcttgagtattgtgtttcatttttccatcctttttctctttgtatttcagtttacgaggcctctattaacatatcaccaaggtcactgattctttcctcagccatatccagtcgactggtgggcccatcaaagtcattcttaatttctgctacagtgtttttatttctagaatttccttttcattctttcctagagtttctgtttctctgcttaaattacccacctattcttgcatgttttccacttttcccattagagtctttggcacattaatatagttgtttgaaattcctgagtgagcattccaaaatctctgccgaatctgagtctagttctgatgccagctttctctcttctggctgcatgttttcttgctttttaactttccttataatttttttaaaaggtggaaatgacgtatcctgtaacaggaactgaggtaaataatttttcagtactgaaaggtgacttgcagcttattttcatatggttcagtaaaatgtataatgcatacaaatatgtaatatgcgaatttctaattaatttccattcaatggtggttttacaggtgtttgctttcctgcatgcttgcacattttcaaagtaaaatttggagagcaaatatgaacagattagggtgctgataactaaaacacacgctttttgttctttcaaaaatgttatgatgaacatacagagataaacacacatgacaattgtatgtcgctctaggaaggcaaataaacatttcctttatttaaaagcaacataatttagtattcaatattatcccttcaaaaaggattaggaatttcttccaagatgtgaaaattctatctaaaagtaacattaacttaaaatttttggcactactgaattatgagatagtttttattatcatatttactcatcatatttttttcaaatcattcaaatattttaaacattttgaaaggaagataattctatataagaaaaaactgtaaatctaaaatcaaattagtactccagcaaaactgacagctaatttaattctgtaaagccatgtttctgaccaataacacatcagagatacacgggcatgaaaatcttctaaagtgccttgcttgagacagtttttccaaaaaagagttaaaattttttctcagtaaataatgcatttagatgttttacagaaaatggcacaattttctgcaagtgcttttgttgcccgggatcactgcgaagctgcagagcagctttagcagcaccaacttcctcatttcttagttacagtgtttacacccagcctcaggctgcagtgaccggctcagagaaagacatgagcagtgagacacaagtagacatttgctgggattctcatatattaaaaaagtttaatctcttcctcatgaggcatcagaagaaatccatcattttccctggatggggcagtatgaagagtctggcagagaagtgttgctaactggaggggaaaacatgacgctgtgggttccactaggtaaagctaaggatgaattaaagctgggagaggcccacccatccggagagatgcagatgaactaggctcttggcgaaattgtttgagccattaggttcgtcttagtcagcattacttctaagatatttatatctacctgagcagtttgtttgtgtttttatttgtttgttttggtctattgtcaccaagagaatctaacctgacattatactttttaaaaagaaaggaaaggaaataaaggagaaaaaaagaaactttcatttttcttttatcattgcctcctcatccttttcgtctatgaattcttcctaataatggcttcagcaacatgaaaacccaccaaatctgaagcatttttatttttaacaatactaccatgggaagctgtcccctgtccttttatccactattcatgtaggtttactaacaatagtgtatacttataatgttacattttgctcatttgataattccagcattcaagctagaattcataagggtcaaagaagtagatataaactgtataaaatggtaaatgagaaatatacacaaaattcttactcataattcaatacattcaaaatttattatatatattgtaactaaaacagatgatatatatgcaatagtagctaaataggcaaagtttgtgctgaagtcatttctattctcactatacttgggggcaaactgaagtttctcctatatcctaaaactatgttctgcattatttcagagtgtaataattcactaatttccaaagatcttaaacagtaatagaaaaagacaattaaaaatttttcaccccttatatcagttctttttttttgaaaaaaaaaattgtcagataagccaatgacagtaaaattctatctattaacatgtacaaacattctaaaaatattttcacttgagattagagtgtggtcttccaacaacaaatttatgtttgttctacaacaatcaaagctaagaagttcaatcatcatttttgattcgacatttattcattttggaaataaggtattagattattgccagtgagctccaagaatacagtcatcagctgagaaacatcctcacagaatccagaaaaatatatttacataacagatatgtatggaaaataaataatttgataagaattttatgttgacatgtttcattaaatatttacacatcaacctatgtatttacactgatgatgtcattttgagagagattgtgcccaactgtaaaaataaggcttaagctaaaatgatttttaaactatagaaaatggattatacataatctataagactccttctaagggcaaagcttctggagttttgaactaaaaaacacatttttagaacattcttctcaaatgataatttaaactttgctttaaaatctcaaggctgttaaccaaaagcatgttaagctcaatatcataggacagaaatgtgagttttgactcagttatggaatgctcagaatattaagcttatttgtgtagttagagaattaatacatgaaatcataaaactaatctgaaaattcaatgaggcacttatagaaatattttgtaagacagtatacaaaagtaagatattaaaaattactatcagtaaggtgtttggcaaacaaacaatgatcaagaaatgtgtagaataagtgaatgactatagattatcccttatttacaatggtttccctttatgacagtgcaatagccatatgcagtcagtatgcttttgacttacaatgggatttcaaccagataaacccattgtaaattgaaaacagtgtagatcaaaaatgcactttctacttacaacattttaaatttataatgggtttatcaggacataaccccatcataagttaagcagcacttgcatgtaaattaataaaagtaatcaatgcataaataattgcatgaaaataaattttggaattctacttctgtgatataccagaagaattgaaagcagctactcaaacagatacatgcaaagcagtattcatagcagcataattcataatagccaaaatatagaaataacattgaacagatataccacacttaagcaaaatatagtatatctgtacaaaggaatattatttggcatttgaaatgaaattctgatacttgttgcaacatggatgaatcttaagaacattaccctgaatgaaataaaccaaaacgaaggtgaaaatactgaattattcatgaagtatctagaaaagaaaaattcatggagactgaaagtagaatgggtgctataaggggctgagagtgggaggaatagaggattatttaataagtatagtttttgtttgggatgatgaaaaaattctagaaatggatagtggtgatggttgcacaatatggtgaatgtactttatgatactgcttagtacttaatgatattaacatgattaaaatggcacattttatgtaatatatgtcttaacacattttaaggaataaaattttatcacatattggacagctgtgattattaactagttctctttttttaaaaacacacacacacgcataaagtaaaaatgctcagaagtgcctttatcatatttatcccactaaatacaactagaaatcttggacattacatataagacaaactaaaaggcctctgaaaggtagaaagcaaatctcccgggaacttcagggcccaagatatgacacaatggtaattttctaggttttctttttgcttatttatttcaaacttagagatgaacaagcaaaagcctagaaaatatcaatgagtacagatgacaaaaagtccaaacaaataagggaagaaataagtctagcaagacagaaaacttttagaaaataataactctattctagccaaacactacagaagaaactatggttgcactcccactcatgccattaaaagtcaactggggatcctagatcctcacacttgtgaggctatattgaggcacccaacacccccatagctgtgttgtcagagaagtaaagtaaggagctggaattttcattcccaaatggtgataataatgaaacccgctctggtatcagtacagaccacatagaaagccttgacctccacccaaaccagcaataaagagctgtccttcctgctccccactggaaaggtgtcagaggagaacaagtggatagtcagtattttaactaatatgaagcagtgatgatgccacccccactacatggtatcagtgcagttcatatggggagcaataataaagcatttataccctcttggcaaagaaattatcagtggagagcccgcactcccaactccaactagaagtaacaaggaatctcaccaccatgtgggaatcaatggaagccacatgggaaacctagactcctacctgcacctgacaataacgaggcagcattccttcctttgacagcaatgtaggaggaagtcagctaaaacagaaaattcaaataagatccaggatctcctctccacccaaaaatataatgtcaaagtctttacccccagtacctcagaatgtgactgtatttgaagataagacctttaaagaagaaattaaggtaaaacaaggtcatatagatgggctctaattttataaaattaacatctttagtatttcgaagaaaatgagattaggacacagacacagagtaaagactatgtaaagacaaagagagaagacagtcattctgtcagccaaggaaaggggctttagaagagaccaaaattacatttctattgtaagccacccagcctgcgggactttcttacggcagccctagcaaagtaatacagatgacaacagcaagatgacagagacgttaggattatataatagagatttttaaagaacatcataaaaatgcctcaggaaacaatcacaaacaagctggaaataacttttttaaaccagccttaaaaaacaaataggaaatataaaaaacacccaaacagaaactttagaactgaaaaatacttatctactgaagtaaaaaaaactcaatgtatgggtcagtggcaggatggagaggacaacagaaaaataagtgcacttgatgaagagcagtagatattactcaatctgaaccacagagagaagaacatagacattaaaatatacaccgagtctcagggacttgtgtgaccataacaaaatatctggtatttttttttcaacacagtcctaggaagagaggagaaaaaaaggatgaggctaaaaagtctttaaagaaacaatgactgaaaacttccaattttggccaaagaaataaatctacagattcaagttgctgagtgagccctaaacagggtaaactcaaagaaatctaaatcaagatacttcatattcaaatatcagaaaactaaaaaaaaagaaaatctcgaaagcagtgacagaggaaagagagctcaaagaatcataggtatgacagcagatttctcatcagaaaccacagacgcaaaaggaattggtacatttttccagtggtgaaaggaaagatttgtcaacccagaatcctatatctagctaaagtactcttcaggaataaagggtaaaccaagacattctcagatgaggggaaatcaagagcatttgtcaacagcagagctattttgaaggaatggttaaatgaaattctctaagaggaaagaaaataatacaagaaggaaatatgaggcgtcgagaagaaagaataatagagtaaaaatcatggataaataccttttaccttttctcttcagcatcctaaattatggttgataactgaataaaaaataatagcattttctgaagtaattctcaatgtatgtagagaaaatagttaagacaattatattataaatcagggagggtaaagggacttaagaggaggaaagatttttatacttaaatagaatgatacttgaggagaatgtgataaattatgtatatgtatttaatacctgagcacccactaaaaaagctgcacaaagacataagaacactaacagataaatcaaagtaaaattctaaaaaatgtacaagtaaccaacaggaaggtagaaaaaagagaaagcacagaaaagggagaaaataaacagaaaaaaaattaaaatgtgaaacttaaacccaatatatcaataattacattaaataaaaatagtctaaacacactgattaaaagacaaggttgcccctgaatcccagcacattgggaggccaaagtgagtggatcacttgaggtcaggagttctagaccagcttggccaatatggtgaaaccccatctctattaaaaatacaaaaattagccaggtggtgtggtgcacgcctgtagtcccagctactcaggaggctaaggtaggagaattggtcgaacctggaaggtggaggttgcagtgagcagagatcacaccattgcactccagtctgggcgacagagtgactccttctcaaaaagaaaaagacaaagattggcaaaacagattttaaaatatgactagctgtatgctgtctataagaaaaatgagttcaagtaaaatgatatgaaagtaaaagtatgaaaaaagttaggtcatgcaaacatcaatcaaaagaaaacaggaatggttctattaatatcagataaagtaggcttccaaacaaaaacaatgactaaagttagggaagaatattttataattattttaaaaaggtcagtccaccaagaagacatagaaatcttaaatgtatgcatcaagaaacagagctagaaaacatgcgaagcaaaaaatagaactgacgagagaaacagataaatgcatagttatagttaaagattttaatacccttttctcaacaattgatggaagacctaaacagaaaatcacccaagaaatagaagaactcaataacttcataaaacaacacagtctaactcacattattagaacactgctccaaaaaaaaaaaaaaaacaaacaaaaaaactcaattcacatcctttttgagttccctgagaatacatatcaagatagatcatgtcctgagctataaagaatcctcaacaatttaaaatattgaaatcatacagagtatatttcctgaacacacacaaaaaaccaatagcaaaaagataacaggagaatatctaaacacttggaaaccaaacaacgtacttacaaacaatccctgagtcagaaaatctgaaaagagctaaaaaaaaatcggactaaatcaaagtgaaaatacaacatcaaaaattaatgggatatagataaggtagtatagaaaggaaaatctatcatatgacatgcttacattataaaagagcaaaagttttgagttaataatcaaaacaaccacttcagaaacatagaatacaagagcaaaatgaactcaaagcaagaagaaaataataaaaataagcaaaacttaatgaaattcaaaacagataaacaacagaaaatcagagaactaaaaaaaagctgattattttaaaaaattaataaaattgaaaaacctctaccaagactgacaaagaacaaaagagagaaaacacaaataccaatatgagaaaatcactacaaatcctgcagacattaaaaggatactaacagaacacaacaaacaattctacacatatatatttgacaaattagaaaaaatggacaacttcctcaaaaagcacaaactatcagttcactcagtgtgaaagagataatgtgaatagtgctataactatttaaaaaattgaattcagaacttaaacattcttgaaaaagaaatctccaggctcatgttgtgtcactgaggaattttatcagacatttaatgacaaatttaataccaaatctacacaatctcttccagaaaaataacagagaaagaatacttctcgattcactttacaaagttagtattaatgcgataccaaaacctgagagatagtaagaaaaaaggaaacaacatatcaataaccctcatgaatatggatacacaaattgtcaagaaaatattagcaatatatttgagcaatatatttaagaattatactccataatatagggaagtgtatttcaggaatacaaaagtagttcaatattcaaaaattaatgaataaaatccactctctacatatttatgtgtgtatatatgcatttatatatgtatgtatttgtgtatatatgtatatagagagggtggattttatttattactttgaaaagatcaatataattgaaaaacctctggcaagactgacaaagaacaagagagagaaaacacaagtaccaatatgaaaaaatcactacaaatacatatattttatatatatatataaaatctatctatctacatatatatatatatataatcaggctaaaaaagaagttatatagtcacagcaataaataaggaaaaaacctttgactaaattctatgcccattcatgatcaaagctccaggaaaatagaactgtagggaaatttccttcacttggtaaagagtttgacaaaaaacctacaggtaatcttatcagtaatggtttaagactgaatccttccctctaaggtcaggagcaaggcaggaatgtctgctcttaccactccattggaagatctaggcaatgaaaacagattgggaaaaataacatacaaataagaaagaaagagaaagaaaagaaagaaaagaaagaaagaaagaaagaaagaaagaaagaaagaaagaaagaaagaaagaaagaaagaaagaaagaaagaaagaggaaggaaggaaggaaggaaggaaggaaggaaggaaggaaggaaggaaggaaagaaagaaaggaaagaaagaaaagaaagaaaaagagaaagaaagaaagaaaaagaaagaaagaaagaaggaaagaaagaaagagtgagagagagagaaagaaagagaaagaaagaaggaaagaaagaaaatatattcctgtttacagataatatgcttatgtatgtaaaacatttcaaagaatctactccccaaaataatcttagaatttaaaaagtgagatcagcaaggtcacagtatacaagggaatatgaaaatcaattgcattactagtttctggcaatgaaaatgtcaacactgaaattatactaaaaagcaatactctttgcagtcacttgaaaacaaaatacctaggtataaacctaccaaaagctttagataatgtttattttaaaactataaaacactgattttaaaaaattaaacagatctaaataaatggagacttaccttgttcatgaatttaaagtttcatagagtaaatatgtcatttagccccaaactgccatacaaatttaaaacaatctataaaaattcaagcaagacttttgtacatgtagacaaaattattttatgttttaatggaaaggcaaagaatctagactaactaaaaattttgaaaaaaaataaaatggaaggaaactgtctacctggcttcaggatgtattatttagctatagtaatcaagattatttggcaaaggggtaagcatataggtaaatgtaataaaatagagagcctagaaatagacctgcaaaatatagccaacttatttttgacaaaggtgcagaagcaattcagtggaggaaagaaagcatcttaacaacaggtgctgatgcaactgaacattcatggcaaaaacacgagccttgatctaagcctcacaccttttacaaaaactaactctatgtgggttgcagaattaaatgtaaatatgtaaactataaatcttttaagaaaaaaagttaggagaaaatcttctggatggataggcaggaaaagaactgtgagacttgacaccaaaggtgtaacccatagaaaagaactttgataaattgaacttcatcaaaatgaaaacacctgctcttcaaaagaccctgttaagaagactaaaagtaagttacagactggaagaaaatatttgaaaagtacatatctgataaaggactaatctccagaatatataaactctccaaacttaacagtacaaaaccccacaatctcattagaagttaagcaaaagacatgagcagacatgaatagaagataaacagatggtaaatgttcatgacagatgttcaacatcattagccatcagagaagtataaactagaactgcaatgagatattcctatacacatatctgaacggctaaaattaaaaatagtgacaatgcaaaatgttggcaggggtacagagaaactggatcacatactggtgagaatataaaatggtacagctcctctggaaaacaatttatcagtgtctttaaaaccaaacatccaattaccatgtaacccagcaatcacactccaggatgtttattctaaagaataaaaaatttaaattcacccaaaaatagttgtgtaaatttttatttatgtgtgaagcaatgttaatcaccaccataaagattttaattcttaatagccagaaactggaaataactcagatgtctttcaataggtgaacggttaaacaaactggtatattgatatcatggaatattactcagcaataaaaagtaataaactattgatattacgcaaaaaccaggatgactctccagagaatgatgctgatgaaaaaaggctttttgtccttgtgatagtttgctgagaatgatggtttccagttgacgagttaatgggtgcagcacaccaacatggcacatgtatacatatgtaacaaacctgcacattgtgcacatgtacactaaaacttaaagtataataataataaaattaaataaataaataaataaataaaaagaaaaaaggcaatcacaaaaggttatatattttatgtttccatttaaataacatttttaaataaaactgtggaaatggagaattgactggtagttgccaggatttgaagaaggtgtgggcagagggaagcgaatgcagctataaaagagcaacatgagggaccttgggtgatagaaatgttctttatcttgactgtatcaatgccagtattctggtcatacattccattatatttttgctatatttatcatcagtagaaactggataaatagtagatgttatctctctgcgtattatttcttacagtggcatgtgaatttataattatctcagaataaaacattttatttaaaaaatgtctgttgaatgaatgtagattgaaatgaatgaataagttaactgaaatcattttccctgtaactgtatctaagtccaaattccattctctggaactactaagattaatttaatccattttatcatacaaaaccaatttgttccacacatctgttcattagacttttgaatatcatgttccaccaaagtcatccattctacagattaaaaatacagttgatgtacataataatttatttaacatgtgtaagtaccagagactgcataccattgcctggaagacaaaagtagctaaaaaattccttgataccaagtagcttatcactttgtagaatagaaggatacaacagctatatgacaaactcaaatattgaaatcagagggagagaaaaagaaataacgtctcacatgtgagaaataactctggttggggaaatctagaaaagttacataaaggatgtgagctgctggctgttcatgaaatagatgcataatagaaggcaaactccatagatatttttttgcataattagcaaatatacaatgcaaaacagtgctgagtctatttctccctctcttttcgcaaacctgaaaaggattctctcactatggaccttaccctagtgagtaggcaacaggcagaaaggtggctgattaggagaactggtcttgagtagcctgaaatcaaagaaaaatcaggaaataggaaggagtgagaaaaacgtctggaggaaaagaaatcttgtagccttggatcattctggttagggtaacagtatgactgattccaatcatctgtaaggttgaccttgtattaccaaacagcttcataaaagcatatgcttgggaggccaagacgggcagattgcctgagctcaggagttcaagaccagcatggacaacatggcaaaaccctatctctactaaaaatacaaaaaaattagctgggcatggtggcatgtgtctgtaatcccagctactcaagaggttaaggcacaagaattgcttgaacctgggaggcggaggttgcagtgcagtgagctgagatcgcaccactgcactccagcctagatgacagagtgagaccctgtctctaaataaataaataaataaattttaaaaattaaaaattaaattagaaaataaaacatatgcaccagaaaaagaaatgaaataagttatcttcgtgagaaattcatgaaagcataaaattaggtatcaaagagtttgagtcaaattgaaacacctgtgttcatcagggatactggcttgcaattttcttttcttgtagcatccttgcctggctttgatttcagagcaattctggtctcataaaagcagtttggaagtattccttaatattaaatctttcaaaagattttgagaaggattggcattagtccttgaaatgtttggtagaattcagcagtgaagccatgaggtcctcagcttttgatgggagatgtttcattactgatgcaatctgcttattcatatgcctgttcagattttctatttctccctcatcaatctttttttacctgtcacagaaaaatttaattacatggaacacatgggaatatattaggatttttttaaagcaggctacaaaatgatataattttttaaatgtatgtgtatatataagaagtatacttttaagtttcctatggagctatggactgaattgcatcacctcaaaattcatatgttgaagctctaacctcaaatgtgagtatatttggagataggacttttataaaatagagttaatgaggtcatgggttgggatgctaatcctacaggattattacaaagcacatgtactgaggaaagagggtggctgtctgcaaggaagaaagcactcactagaacttgactatgctagcactctgatatcaggcttccagactccagaactgggagaaaatcagggtttgttggttgagccatctagtctatggtattttgttatggtatcctgagccgatcaagatatacagtaaatgtatgttattctcatgactagaaaaagatcttttcagcaacagcaacaactttgaaaggctctgacaggtaaattttatttaaaaagtgttgcacacaaaaacacttgtctatattcagggtcatagagttcttttgaaggacaatgttatgatactttataagaaatcctacattaccttatctgatgcttagtaacactgatatttatcacttattactccctcttactcttgattttatgatttgagcagatagaatgtaaaatgatgtttttttaaatgacttcatcaattatgataaaattatatgctttaaattcctcaaaagtaagacactacagttatcctatgttaaagcagtcttttgaaattagtcttatgtaactagaatgaccacatgcttgacttgcttgggacggcctaggtttatactctatactggcataattgttagcagtgccagctttcactctcaaaaaaaaaatcctggtaaacgatggctgatctacacataatcaattgcagaataggatagttacattgaaggaattttataaatgtagtgtttcatctggggaaggaaataccatctagcactaaaatctgaaaaatatggttgtcacagtatataatattcaattatttaaatatttttctcacagggaaccaaagtaaattttgtgagtgaattgaaaagtactaagaacaaggtgccaaaatattttttaggtgattgtgttagtccattggcatcgctttaaaggaatatctgaggctgggtaatttataaagaagagagttttattttggctcccagttcagcaggttgtatgaggaacatggcgccagcatctgcttggcttctggtgagggctacaggaagctgaccatcgtggtggaaggcaaagggggacccagcatcacatatggagaaaggaagcaaaagcttccttatcaatcttgaaaggttgcatgtttctagaaatctctttcttctaggttatcaaattttggggtgtatagttgttcatagcagtttcattatcttttgcatttctgtggtattagttgtaatgtctcctcttccctcctcaaaattcctgaatctcattctggacattttgactccaaatgcataggacatagtaacttactattaaaatattaagatagaaaataaatgaataatgttcctctactatatcagttcatagattttatgaggacagagccaaatcttttttgctcaccacgacataactagagcctagtatagtacttccatggtaggtgtttattacattattgttggatggatgaatagataaatagatggatagatggatattagatagatagactgttggatggatggacagatggatgaacacatggatgaaaactaaaatttcttaatcaaaatatgctgacaaagtaattatatgtcaagattataaagtaatgctacctaattttcacgaagagaaaatagttgccagtacagagagaaaagatagacgtataggaaggctggatgagtcgcccaaagaggaccttccagaggttcctcaacttggcctacaaaatgaatttagtcagagcatctaaatatattttattcttttggaaactaattttccctatccaaagtcataaaaaaatcaataaatcaattaattaataagatatgttacttccttgaagattgggctatttttctcaggtagtcagcatattctttccttgatggcaaatctgtacaagatgacaatcaggatgcttgatgaaaacggattcagagctagatgatgctaatgcttgttctcattgagttatgatcatttgatgcagctatttctctaagtgggtaaacctgctgagtgaccagtccaccccactctgtaaggcagggaatactttcccaggcagggtaggagaggtgtcactgctcttcactcccaccccagactgcctgctctgcttctgttcctacaatttttcttagaagggcctggtattttcatatttgtgttcttggtaaaattaattgctgtgttcatctattccatatataaaaccttacaggtttgttgcacagattactgacaatgtacatctctaataacatagtaggtaaaaataagtgatctgttatgtgatcatcagagtcatgcagcgggacgtattttcaggaagacacaatatcccaacataatacagttgccaagagagtatgtgaaggtggcaattcagaaggatatcaaatgccacataccaggaactttagaactcagagtttgaggaggtgattgtcatgaaggctgaagatataaataaagttgaatcttatatgttctgttaatgagattttacttcatcccaaaaacaatgggagccattgaagaaccctaagaagagtgggctaatcaagtcttttttttagaaaagatgactagtcgcccttcagagatttagaaagggaaagatttggacaaagaaataaagttttgtaccggcaagggtaatggatatggaagatagaaggtaaggcagcacaatgcgggtagattggaggggaatagagcaatgttaacctagaaactttaggacttaacaactaactagacacagcaggagagaaaatgtgagaaggccaatatgatgcacagatatttagtttggatgactgtatgagtctgtcatcatttcataaaataagcacatttgaaggggaaagtaaggagtgcgtttgaagggagaaagataatgagttaaatttaagtcacgttaagtttgaagctcctgtgggacatatcagggaaatattgagttagaaattgcatgtgtatggattgggaaacataaaagcaatccaggctagaaataaagatttgggagccaggagcatctacataatgactgaaaccatggaagcagatatgttccacctcagggaggtgtaaagtgggaaaagagaacagcacatgggcaagaactcagggtgaaggagtctgagcaggcaggtcagcaaatggcacaccaggaacatgcaatgtcactaacaccaaggagattagagggtgagcagtcaatggaggagaccatgaagcctcatgaaacataattaaacacagaatggttccatatgtttaacaacatgagtggccttcatcaaaaaacctttagtagagtggtaggaatgaaggctggtttggagtgagtagaagtaagtaagagctaactacacggagacagaaagcttggcacacaaaccctcttcccccatgattcggtccttgtcaaacttgctagccttatttctcatcatgctccattcaggcccttccatccattcattaaaagatacttgccataacacaaacataccagactatttgctgaattttctcacaaccttcttgctccttccatcaagaccaacctgccacccaccccttgtggctctccagatagatatggccccttttctctttgagttcctactgcataatccatcctggatactaacccaggatgtgcttgattgtgattgcaacctgtacctcaacccctggaagccccagacctatatgaatgtgacagagtgcagaaatggcaaaaaattcctcccatccctgattcatacccctttgcaaggtgattaagctgcttcatccaccaaaatatggagcctgtttctccagtgctgaatcacatcttggtcatgtggcttaactggccaaatggaacactagcaaacatgacagaagcaaggcgtggaaagcactcatccctgactatgctagggataagatcattgtgtgaacaagcacaatctagctggctagagaaagagaagccacatggaaaagaaaaggatcccagctaatactgagaaattgccagctatgtgaaaaaagtcattctagaccagaagatctgagccagcctagacaaaaagaactgactcattagtccatggaacaatcatgagagatagaaatgcttgattgttttaggccactaaattctgcagtggtttgtttcacagcaaaagctgagagagtggacaagaaaccacaaggaaattgcactcattttgttaagattgtcattaaaacccagtgagtgagagatttcagacctggtgagagttgtgtccttcaagcttacactattaaaggtcacattcttcaatggcacttacttgcctaatatttcaaaaaaaatctttttatctataggatacaatagaaatagggcagactcccaataaattcaaagaaactggagagaaatggaaaatgccaatgctaaggatacaattgcaagtgacgcattcagccaataatctaagtaggtgagtttgtgcaaaaagagcagcatttagtaataggagttcaaaaggacaaagctgctcagagctgggctagtaggaagaagctataattcagagaaaatactaaacttagagaatgataaccatggccagaaacagaatcacagatttgaatatggaataaatttcctctttaaatgctagcattgatgcctagtttatcgtaaacatgcacagagatgcatcagttttttgccccatgggtaatttgaaacttgtgaaattatcagtgcccttaagtaacatgactattatcacattttgtattacagtgatttgatatcattatcaatgcccgtaagtaacaagatcattataatttggatgtcaagatgtttctgaataaataaactttatttttggagtttatcattagattaagtcaaatggttaaaaataatgaacattgcaaatgctattcttaagggttgctaaatcaaagaaaagaagctaaagtttaagtgtctgctaaaccaaagaaaaggagaattttgctcttagatcttcaagaaatcttagctctaaaattcagctaacattaaatgaatcactatatccaaagatattctcaaacaattgtatttttttaatttgaaagcacaacttgtcttaagacatttcaatttatttttgcccaaggggatcagagatacattttggatcaaaactcactagaatttcagatgagtttacaaatgcttgtgtcttagaggaaaagctatgctatcctttgtgtttggcagggtaaaactgcaattctgtggtatagtcaaatgaaaattaacctcctgaatatacaagcactataactaccttatgtaatataaatacttgtaatctttgggaaaatgcacgctataaataattgataaatacacatgttgttgaaacaacagaggcatttaatagtgttatcattcctctcttaagattaactcaacataactgagagtcttaattaagcaaatatcaagcatttattgagtaccttatgttcatacatttattcaacaaatatttaatgagtagttcctgtgttctagatactaattctagatgctgacctatgtgataaataaggagagcatggccacccgacctcacagaatccagtggggaaatcagaaaataaataatttaacaaatagatgagaaaaaataaacttttgtggtatatgcaataaatgaaatacacagggtaccatgttagggagaaaaagagaagtactggttggcttaaggtgattgctagaggacatgacattaaagctgggacaagaaagggaaaatagccaaggaacaaacaataagcaggacatgcccagggtcagagagtagaaaggcaatgcttaccatatttgaagaaataaaagagcaatggatcaagtataaagagcaaagaaaagatataagaacttgcagatactgtatgcattgaatgggtcttctaactcacaaccctctttctctacaaaattccctggtttgaaaggcaatggttacttggcaatgttattgaaaacatggcaaaatttactgcagtgggtacatgaatgtgttcaccatgtactgcttcacacatctgttatccttgccttttaaataacatgtcttacaagagcccagactcttttttcacttaataactagtgtttttaattggccagagcattgattagaagttgtgtgaaatgattttttgttctcactcagagcagagaatacacttgtgtatgtaattgatccaagcctctgcaacattgaacatctgtcttattcaaaattaatttcctgctaataactgtcattttacttatttcctcattgaatattagtgctagtaatgagattccttctaaatggatatttgaaaagccataaaggttcttgttttgttttattaatttgtttgtcttactctaagggagttactcgtgacatgcccatgagtagagaactacagagcaggattgagatgaaacacagggagaaggtcaagctccttcactaatgaggagcaggctttgcacacccccaaagtttgaaggatccttagtaatatgtaaaatatggaaataaagaatggcatgcacctgggcaagtgctatggttttaatattccatccaaaattcactgaaatttaatttccagtgtaactatgataagagataagacctttaagaggtgattaggtcatgaggactcttccctcatgaatgggttaatgccattatcacaggagtaagttggttatcacagacgtttggccctttttctctctgtcttgtgtgtttgtttgttcttccactatgttgtgacacagcaagaaggccctctccagatgcagcccctcagtcttggagctcccagcctccagaaccatgagtcgaataaacttttctttataaatttcccagtctgtagtgttctctcacagtagcagaaaactaagacagataattggtattgagaggtggatctgttgttctaacagataccaaacaacgcagaagtagctttggaactgggtaatgggtaaaggctagaagagtctggaggagtaggctagaaaaaccctagattgccatgaacagaatgttaaaggtgattctgttaagggcttagaagaaagaagaatctgtagaaaaggtatggaatgtcttagatattaagcggtcatggccagaatgttgatagaaatatggacagtaaaagccattctcatgaggtctcagacagaaatgaagaacaagttattggaagctggattaaaggtcaccctgttacacagttgcaaagaacttggctgaattgtgttggtgtcctaggactttatggaatgaagaacttaagggtgattaactaagatgtctcatgcgagaaatatctaaagagcagagcactcaggttgctgcatggctacttctaaccacatgcattgagaagctagaggaaaaaacttaaagatggaatttataattaaaaggtaaaaaacagaaagatttggaaaatttgcaggctggccatgtaaagagtaaaaaagcatgtaaaagagagaatactacaggtgtgcccaagtgaccatttgctaaagaggttatcacagatagtgattcaggtgctattcatcaagtgaacaggagaaagacttcaaaggcatttcagaggccttcaaggctaccccttcccatcgcaggccctgagctctagaaaaacagaatagtttcagggaatgggctcaagataccttccatggacttgctgctcagagccacattgggtctctgcttcctgtgttccagcacagtgcatgactcagccaaccccacctatagcctaagtgggttcctgcagtgtgcatgcagtaagccttgacagtgtccacatggtataagtctccaggctcacagaatacaagagctgtgggagtagggctcccttcacctagatttcaaaggatgtaccaaataaactgagaacccaagcagaaacctgccacaggtagagcctccacagagagtgctcactagggcaaagcctagtggatccgtgggattggggctgccactgagaccccagagctacagggccacctatagccagagtggaaactccggcctgggaaggtcataggcatgagactccaacccaagagaactgaagcatggctgagcccagcaaagacatggggtcgtggccacctgaggctttggagacccaaattccccatgtccagaaggtggcaaatggagtaaatgattattgtggaagtctaaggtttaacattgttttccctattagattttggattaacttagggcctcttgctcctttctttttgcctatctctcccttttgtaatgggaatgtctatcacatgccagcaacattgtcgtattttggaagtagatatcttgtttttttttatttcacaagcttacagctggagaggaatttgcctcaggatgaatcacaccttgagtctcacccataccagattcagatgagattctgggctttggacttttgagtttgtgctaaaataagtcaagatttttggggccactgagatggaataaatgtatttttgtatataagaaggacatgagttttgtgaggcgaagaggcagaatgctacagtttaaatgtttgtttcctctaaaactcatatagaaatttaattgtcactgtgatggtattaagaggagggactattaagaagtgattaggtcatcagggctctgcccttataaatgccataatgccattatcatgggagtggattagtgattgagggatttcaacccccctttttctccatgtctgtatgctcatttgtccttccatcatgttaggatacaaccccttgatcttggacttcccagcctccagaatgatgagccaaataaactttttttaaaaaaattaattacctagtctgtggtattctgttacatcagcagaaaattgactaagacggtatgttagatttgttatgaaaggttaggcgagcagatggaattgactaaactaagaggaaactgaaactttaggactcagtaattagcagagctgtgggagacctctatgttaggctgaggtgtctcagctgaacacaggaggctttgaggctcttgacctgggtttaacaggaatttcagtggtttcgggagatactacagttgtataaatttggtcagagctaaagattggaatggtgtcttctctttaagagaataattaactttttagcagtatgcttaattaatctgcagatgaacatatttgtataaaaatgttcattatcgccttagcattttttttttttgagacagagtctcactttgttggccaggctggagtgcagtggcgccatctcggctcactgcaagctccgcctcctgggttcacgccattctcctgcctcagcctcccgagtagctgggactacaggtgcccaccaccatgcctggctaatttttttgtatttttgtagagacggggtttcactgtgttaaccaggatggtctccatctcctgacctcgtgatccgcccgcctgggcctccccaaagtgctgggattacaggcgtgagccaccgtgcccggcccattattgccttaacatttttttaaaaagaaagttgtagcactcactctagctgagataaaagcccttgtagtttgtttcttcagcctccaacataaccatatccaatcatgacctcccaacattcaaattaccaaacaccaatgtttctgagtcaaacaggcagttgtttaaaatatctttattcccatttaccaataatacacaaaaaccatgacaattgtcagtgatcatatttgtgacctaatttttcagaaatttggtccttacccaagtttattaaagttcctaactaactgtaatgtgttcactggctttggaaggtcttggatagatactctgttggcataaagctcctttagccaacaacaaaaaaacccttttctgtgtgtatggaatttttttaaattactgagtaattaaatttgaatgtgaaatattggaaaactgttttgtttttatttttctccaatttagaacttgtggcaggagaaatgtgcataaatatttgaatattttcagatgcacaatctattgaaagcaataatttattgcacttaagacatgttcatatgtgagttttatataaaggttgaaactgcttttcacgaaggtaaagaattattttaatttaaagtaaacacacacaaaaaaggcaaaaatagtcaaacaacaccataaggcattgttgttttttcttataacttacagatatagcaaattttcaagtccttcaaaagcatttctggaaatctttctgatgtggttgttgttcagcagactgaaaaagcaaaaacaaacaaataattcccaaatgagaaacagactctgcaaacattaaaatagttctgctaagtatagtgctttacacaacagaaaaatatttactgacatggttcactaaatttggaaatttatactttaattccctattcaaaaaagtgatataaaacattaatttgtcacaaagactttaaaataatttatattcattaaattaccctaaaacactcctaaaacaacactgcaacccagaggtaaaattcttgttctcctgaagcataccatctaaaaagaaaattatcaacatagtcatggtaacaaaggaacatattcctaaacagatggagagtattgaacactcaggcttaagcatcttccttggaaaaataaatatcacagatattgacacacagtagactttcattgtgtatttgttaaactgtcaaaccaagagtcaattacaccataggaagtgaggctcttattatagtagtatccagtggtccaaaaacgatttctaaaaaatccagggagaaaaataataggtggcagaaataaatcgaatttgaaccgtaaaacaagttactgaaaaatcaacttgcagtaaccttgaaagcttcagtaaaagcaccctggcaaatgaaaattataaatttttttctagtaaaaacacttaaaatttctttcaaatttaaattattatggcatgtctaaatatagagggaaagtctgctaattagattggcacacatgttcctgaatattctatgtctaaaaccctcaaagcttttaaaaatctactgccgaagtccaatgctggaggattcacttttagcatattacaaaatatttgttttgtggggtttttgtatgaatgattaggaaaacagaagtgttttggccactggagcaggtgattatttcagttattatgcacaatttcacaggcagcctagagatccccaagctcatctgttcctaactgattcactgtaggcctcactgttaaattccccaaacagcatctgaagtggctgacacctcacctatggcaccagagccatttctcaccatttgtgactgcctggtgtcctggccattgggaggcagaacaaccaatctacagcttgcattggaggtgatgccatacagagataatgtcaattttcatggataattctaagcttcagtcaatgagccattcaactttatagtccaccatgtgttcaaggaatttttaaacaggctgaaagcaatataactagttaatgtgtaattaataccagacacaaaccttgtcctgggagaatttgctgtttaggcactctcccattctattgttcaaaatcaattaatgcacttctgttagtttcccaaaccaccaccatgcaaatatatttacttgaagaaatgactattctgtccaccttagtctattaaatacaacatgcaccaatgcatgtagaataaactatacgtgtgtatacatacatatgtgcatgtgtgtatgtaatttgcatgtctgctatgatgcatgtgtatgtgtggtatgtgacacatgtatatagtctcaacctcatattaatcacagatcacaaaaaacaatttgagtgactattttcttaaatcttccaacggtggtgcctaggagagagaaattgactcatttcatacaaaaggtgtctttgggcattagtgttaattatctttcaaagccacaattagaaacggaaaagatattacataccataattagtctttcttcagtatattaaatgtgcttgaagcctaggtttctgcatattcttttagagttatttaaattttaacaaaaatgaaacataagatttcaaaaaaattacactgaaattatgatgtgcataacctaaagtatgagatcaaacaatttaacttgttttcttgagaatttttttattgctgacaagaaatcaactcattaaaatggttcacagttgaatgtattttccaatcacaagtacatatttcttgtcaagttttattcaaagcattatggtttccatcaaaatatctttattataattttaatggttggaaccttacccaagtaatgttttggttaagtggttatagaaacggtcatttatgttatgttgttttattattcagaaagaaaatgcattcaaaatgtatgagtgggtctgctaaaattcagggcgtaaaacaatacctaacattatttcatcaaaactcagcacaagcatagggaaatttgtggctgtaccctatatcctcatgatgcccatgatgccaaaggaacaaaacaaaacaaaaaagaagcgaacaaaacaaaacaaaaaagaggcaagcaaaactctcaagaagaaaatgtaaaaatgttacagtttttattgagaaaataaaacaatttctgaaaacaggatatctgaatatactgatgatcaaacttttggggtaaaagaggaaccagcaatatggaccaatggcccagtttattagctgttttttgctgaaacacaaagccttacccagagtatgcccatatacacttgcatatttactagtatagaaatgtatactgtgtggttggaaatattttattaaaaaccaataaatgactgctagaaaagattaaggctatttgcatagtcatcaattcatcaaagtgtaaaataaaaaataaaaataataaaatttataaagaaaaatagaactctctcccacctcacataaaatttctactaggataatgccaagatttactccacaagtgaatcattatctctacatttaaatgcaaataatatattttttgtaaggggcaatcatgttggtctgttcctgcttgttatggttatgcttattttcatttggatactccagaaatatggttctgctactgttaacatgaaagggttgtgaacttcatttctgtgcgtaccaaagtaaacatagtatgaaactttcagtgagcataaaccattattctggagtgatttgcatagtcaccaagcaagagattcatggcaaaagtcacttatagctacccttgataatctgtcacagccacagaaaaatatttatgtgatcataaacaacgcataaatcatttgcagttcaaaactgtaggaaaaaaaaagaggaaaatgagcaaggaaaggaagtcatcaggctgatttaaagaatataaatttattatttttaccaacttttattttagattcagggggcacatgtgcagatatgttacctcggtatattgcatgattctgaggtttggggtatggataatcccatcaccccggtactgagaatagtaccaaatagttttccagcccttgccaccctcccttcctctccactctagtaatccccagtgtctattgttgccctcattatgtccgagtatccagtgtttagctcccacctataagtgaaaacctgtagtatttgtttttttggttcatgcattaattcacttaggataatgacttccagatgcatccatgttgttgcaaggaacatgatttcattcttcttatggctgcatagtattccatggtgtatatggaccacattttccttatccagtctaccactgatgaacacctgtgttgattccatgattttgctattatgtagagagctgtgattaacatatgagcatatgtgtctttttggtagaacgatatgttttcttttggatatatacccagtaataggattgctgggtcaactggtagttctgttttaaattctttgagcaatctccaacctgctttccacagtggctgaactaatttactttcccatcaacactgtataagcattcccttttctccacagcctcaaccacagctgttgctgttttttactttttaataatagccattctgactattattatagaggtagtatcttattgtggttttgatttgctttcatctgatgattcgtgatgatgagcattttatcatacatttgttggccacatgtatgccttcttttcagatgtctctgttcatgtcctttgcccatttttattgaggttatttgttttttgcttgttcaattgtttaagttccttaaagatcctagatagtagacctttatcggatgcacagtttgtagatattttctcccattctgtaggttgtctgtttactctgtttttagtttattttgctgtgcagaagctctttatttttattagggcccacttgttgatttttgttttctttgcatttgcttttgaggacgtagtcaaaaatgttctcccaatgcccatgcccagatggtatttcgtaggttttcttctagaattcttagagtctgacgtcttagattcaaatatttaatccatcttgagttaatgtttgtacacagtgaaaggtaggggtcaagtttcattcttctacatatggctagccagctattctagcaccatttattgaatagggagtttttccccattgcttgtttatgtcgacttcatcaaagattaaatgattgtaggtgtgtggccctatttcaagtctctgtattctgttccagtggtctatgtgtctgtttttgtaccagtacaatgctgtcttggttactgtggccttctaatatagtttgaagttgggtaatgtgatgcctctggctttgttctttttttaagattgctttggtttttggaggtatttagggtttcatataaattttagaatagtttttttccaattctgtgaaaaactacactggtactttgctaggcatagcattgaatctataggtcactttgagcagaatgtccattttagcggatattgattcttccaatccatgagcatggaatatttttccatttgcttgtgtcatctgtgatttcttttagcagttttttttgttttgttttccttgtagaggtctttcacttcctttgttagatatatctctaagtatttgtgtgtgtgtgtgtgtgtgtttatgtgtgtgtatgtgtctactgtaaataggattgcattttttttcttttttttttttgagatggagtttcactcttgttgcccaggctggagtacaatggtgcgatcatagctcaccgcaacctccgcctcctgggttcaagcaattctcctgcctcagcctcccgagtagctgggattacaggcatgtgccaccatgcctggctaattttgtatttctagcagagaagggatttctccatgttggtcaggatggtctcaaactcccaacctcaggtgatccatctgccttggcctcccaaagtactgggattacaggcatgagccactgcgtctggcctaggattgcactcttaatttggctatcagcttgaaggtaatttatgtataaaaatgctactactactttttgtatgtttattttgtatcctgaactttgttatcagttccagaaggtttatggtggaatttttagaattttaaggcataaaatcatattgtccacaaagagaggtagtttgactttttttcctattttgatgccttttatttctttttcttgcctgattgcttttgctagcacttttagtagtattttgaataggaatgatgggtgttggcttccttgtcttattccagttctcaaagggaatgcttccaatttttgcctgttcagtatgatgttggctgtgggcttatcatagatggcttattattttgaagtagattcctttaatgccttgtttcttgagagttttcattatgaagggacgttgaatttcatcaaaagctctttctgcatttattaagattatcatatggtttttcttttttaattctgcttatgtggtgaatcacattctcacatttattgattttcatatgctgaaccaatcttgaatcccagaaatgaagcatatgtgatcatggtgaactaattttttgatgtgctgctggattcagtttgctagtattttgttgaggaattttatatctatgttcatcagggatattggcctgtagtttcattttttattgtatctttgctagatgtgcgtatctaggtgatgctggcttcagagaatgagttatggaaaggtgcctcctcgattttctaacataggtttgagcagaattcatgtcaactcttttctgtacatctggtagcattcggctgtgaatccatttggtacaaggcttattttggttgacaggtttttattactgattcaattttggaagttgatattggcccatccagtatttcaattttttcctgattcaatcttgggagatgtgtgcttacaggaatttatcaatttcctctagattttctagtttgtgtatatagaggtgttcataacagtctctgaggatcttttgtatatctgtaggattggttgtaatatctcctttgttatttctcattgtgctaatttggatcttctctttttctctttgttaatctagctagtggtctatccatcttgtttgcctttttgaacaaccaacttttggttttgttgattctttgtatggattttgggtctcagttttattcatttctgctttgattttatttacttcttttctcctgctagttctagggttagtttgttcttgtttttctcatttttccaggtgtgatatcagattgttaatttgagatcttcctaattttttgaggtaggcatttattgctctcaactttcctcttaacattgcttttgttttgatatgttatgtatctgtttttatttatttccaataattttttgatttctgattcattgtttacccaaaagtcattcagaaacaagttgtttaatttccatgtaagggtgaggttttgagaaatgaaattgatatatatttttattccactgtggcccaagggtatgagttgctattcttatatcaagatataataaattatatcttatataaattatcttatataaatgatatcatttatataataaattatatcttatataaatgatatcatttatataataaattatatcttatataaatgatgtcatttatataataaattatatcttatataaatgatatcgtttatataataaattatatcttatataaatgatatcgtttagataataaattataccttatataaatgacatcgtttagataataaattataccttatataaatgacatcgtttagataataaattataccttatataaatgacatcgtttagataataaattataccttatataaatgacatcgtttagataataaattataccttatataaatgacatcgtttagataataaattataccttatataaatgacatcgtttagataataaattataccttatataaatgacatcgtttagataataaattataccttatataaatgacatcgtttagataataaattatatcatataaattatatcgtttagataataaattataccttatataaattatatcgtttagataataaattataccttatataaattatatcgtttagataataaattatatctcatataaattatatcgtttagataataaattatatctcatataaattatatcgtttagataataaattatatcttatataaattatatggtttagataataaattatatcttatataaattatatcgtttagataataaattatatcttgtataaattatatcgtttagataataaattatatcttatataaattatatcgtttagataataaattatatcttatataaattatatggtttagataataaattatatcttatataaattatatcgtttagataataaattatatcttatataaattatatcatttagataataaattatatcttatataaattatatcgtttagataataaattatatcttatataaattatatcgtttagataataaattatatcttatataaattatatagttagataataaattatatcttatataaattatataatttatatgataaattacatcttatataaattatatagtttagatgataaattatatcttatataaattatatagtttagataataaattacatcttatataaattatatagttttgataataaattatatcttatataaattatatggtttagataataaattacatcttatataaattatatagtttagataataaattacatcttatataaattatatagtttagataattacatcttatataaattatataatttatataataaattatatcttctataaattatataatttatataattaattatatcttatataaattatatagtttagataataaattacatcttatataaattatatcttataaatatattatatcttatatcaagatataataaagttatatcttggtataattttgattcttttaaaatttattgatacttgctttatggccaagcatatggtcaatcttggagtatgctccatgtgcaggtgagagaatatatattctgtggttgatccatggagtattccgtaatgtttattaggtttaactggccaagggttgtgtttaagtctatagttttgttttgttaattttctgccttgatgctctgtccaatgttgtcgttggggtgttgaagttcatgaatattactgtgtggctgtctaagtcattgcagatccagaaatactttttttataagtctgggtgctccattgttgggtgtgcatatatttaggatagttaagtcttcttgttgaagtgaacccttggtcattatgtaatgcccttctttgtcttcattttactgttgttgatttaatctctgttttatctgatataagaatagcaactcctgcttttttttccatttgcatggcagatttttcactaaccctctgctttgagcctatcggtgtcatcatgtctgagttgaatctcttgaagacagtaaatagatgggtcttctttttttatccaacttgccactctgtgcctttaaagtagggcatttagaacgtgtacattcaaggttaatattcatatgtaagagtttgaccctattacaaagttgttagctatttgctttgtagtagtttctattgtgggttttttttttaatgtagggtctgtaggctatgcacttaaatgtgttttatggtagtaggtatcattcttttgtttccatgtttagaacttcattaagaatctcatgtaaggctggtctagtggtgacaagttcccttagcacttgcttgtctggaaaagattttatttctccttcatttatgaagcttattttggtgggatatgaaattcttggttggaatctcttttctttaagaatgatgaaaataggcccccaaactctcctcacttgcaaggccgttagcctgatgggcttccctttgtatgtgattttttttttcttgagcattgattttggacagtctggtgactatacgccttggtgatgtttgttttgtgtagtatctcacaggtgtgctctagattttttgtatctagatgtctacatctccaactagattaaggaagttttcttgaattattccaagtacattttccatgttgtttgctttttctccttctctctcaggaataccaataattcataggttattttgctttacataatcccatatttcttaaagacttcgcttatttaaacattttcttccttttttttaaatcagattatgttaattcaaaagaccagtcttcaagctctgaaattcttttatctgcttagtccacataaatttattattaagtgaatttggtaacttttttcttcatgcatatttctcaaaaaaagcagatttacatgttaaatataggagtgacaaattctaagacttcaaaattcaaatgttatttgaaacaaatgttatttgaaagaaagatctagttattctcaaaatttatgttaagaaccatgtgtttcttttgatggacattaacttaaaaaatcctttgtctcatattttcactttgttttgtatcttttctttatcaacttattaaaaaccctttgtaagcaaaaaattaaacgtttgtttatgttttacaattattttttcaaagtttatgtaatttctacttttagctttctttattgtttttattatacagatgttttaaatttttatataataacatttattgttttttttctttatggctttggattttgtatcatacttaggctttcctgaatctaagattacattaaaatcccaatatttttcttaagctttgtagtttcattttaatgctttaatctctgaatcatcttgaattaatattttttccaaattatttacatattatcattactattgattgatatatttatagtttcccctgtgatatgcaatattaatgtaattatatgcaaatctccaacatgtatctggttccctttctagacatactgcaatggaaatatttccaatatcattgttttttaatattttactctttatataggatagtttctacccctcttttttattattttaatgattaattttaaagatttttttctgggtaaattttaggaacatccgtcaagcttcaaaaatttcctttgcatattttgactaatattcaaattttaccatatcgactttacctatctaacaacatcattcatttttctgcttatctaaaccatctttttaatcttagtatgtttttgaagtagtcaccttgtgtgtgctatgtagttcttaatgagtctattgatacttcttatatcttccagtttgctaagttggatattttctttcatcatattttgtaacagatgactttttgaatataggatattgattttttcttatcagttgttactatacttccttattatatttccttattgtttttaaccatttctaaggtgaatgtgggttgcactatataagcatatcctgtaatgaccatgattttttactttctcttttccataattataatttatttctatcccagacctaataatagtagataatatgtctttaaaattagctttgaaataatgatgataatggacattcttttagagttttgcccttaataattatgatagtttcagactagtcaggttggaagagaaaaaattgtaaagaaaatatttaccaggcaactctgttgctaaatcaggaaacagggcagtgacaaagtagtgtcactgtgctcatgctttctcttaccacaagtaattactatcataagcagtactaaagatatggcttttttttggatctataccaaaaccaaagaagtagtacatttttcataatactgtcaacatattataattgctttaagaaaccttcctccaaaattataataaaattagtttgttaaattattcaattcctaaaatccattactaatactagaaataccatttgacccagccatcccattactgggtatatacccaaaggattataaatcatgctgctataaagacacatgcacacatatgtttattgtggcactattcacaatagcaaagacttggaaccaacccaaatgtccaacaacaatagactggattaagaaaatgtggcacatgtacaccatggaatactatgcagccataaaaaatgatgagttcatgtcctttgtagggacatggatgaaactggaaaccatcattctcagcaaactatcgcaaggacaaaaaaccaaacactgcatgttctcactcataggtgggaattgaacaatgagaacacatggacacaggaaggggaacatcacacactgggaactgttgtggggtggagggagtggggagggatagcattaggagatatacccaatgctaaatgacgagttaatgggtgcagcacaccaacatggcacatgtatatatatgtaacaaacctgcacgttgtgcacatgtaccctaaaacttaaagtataataataataaaaaaaatacttaaacatttgcccataaatttaggcttctaaacagttttaggtctttctgttattttcagacattattaatttcaagactttttaccatcctgtatctggatacacaatacatctctatatacatccaaacacacatgcaactgctattgtgtcatcttctgacacacagagcaaatatctcgtcagagtttgtatagtattaggaatatacatcatcacatgacttccattttagtagaactataatgctaccatgtatcacataagtaatccatgacaattatataaaagttagaaaatacacatttgcccaagtaaaactaaaagaaacaaaactattcagaaataccaagttaattttggtaaatatcttctaagttttagaattactcaatatttataaattgcccgcgatcagcagctagtaattttgtattttcttatattattgccttgtaccatataaaatataaatattattctaggacatatttatgatagatataatgacatatactaagtgaaaagcaataattttctctcatatggacatataggtctcaagattaaataattttgaatgagtcaagatgagaaactatcaatttgataaagtaattttaaagaattgctgaaatataaaagaggtcagattggttactattttccaaggcttcctggtctttcttccaggtttggcgatatgactatttgttgccagtgggttatggtcatatgctttatgtaattttaaaagaaaaaaagaaagaatctgaattcaaaaatatgaaatgcatacagatatagtcattattaaaattattaatataaatattcattattaaaaagaaaatcacaaggctatgtttaatatcaatttgctaaatacattttaaaatctaagatcgaagatgaggctcttaaatgtatgagtttaataatgaatcatttgatttcctaaatgtagaataaaagaaaaattatagttagatgttgttggatttgaatgtgtcccccaaaagttcatgtgttggaaacttaatccctctgttctcatgaataaattaatggattaatgagggccctgccctcatgaatgagttaatgttgctatcaaaggtgtgggtttgttatctccctcatgaatgaatgaatgttgctatcacaggagtgggttcattatctccagagtggctttgttataaaaatgagctgtctgattctcttgctcttgccctctcaccatgtaatgccccctatcacattacgaggcagcaagaaagccctcacgagatgctagtgccatgcactcggacttctcagcctccataactgtaagaaattaatttattttattcatatattatcttgttatagcaacataaaatagactaagacagatctctttttaaaaaaagaaaagatgccagattctatgagattgtgaattgtgataagattaactttcagcaaacgaagaaaatctcctgttgttaaattactcatatacgtgccatgagaggctgaagtgacattgccatggagtatcacagagttttagacataaagagatctcaaaagttatttaactttgaattttttgtctgttttggcttttatgataacaaaactaatgaaacatgattttatctctcatcgtagcatatttttagggaatgggtctatttgtgcccgccagcagtggatccttcatgttcccctgggaatgcagaacataggacactttctgtttgtggttcttgtatagctcattgtaaaaggcaaaatacaattaacctttaggtatatgcatttgccacaagtagaaataatactctaactataaagttctttaaccaaacttttaaaagcagagttttaaagaagttcaaactagcctttaacatctagaactgtgctgcccaactgaaatataatctgagccacaaatgcaagtcacatatgtgatttctaattttctagtagccacattttaaaaaagtaaaaacaactgggtaaaattgatttttatgatatatctttatctaattcaatgtattgaaatgattatcattctaatgtataaccaatataaaaattataaataagatattttatattattattttcacatgtctttgcaatctgaatgtctttcacacatacaacacatagcaacttggactaactacatatcaagtgctcaacaggcacccacctgtggctcatacatgtggttaccatattggacagcatagttcttttgctcactgtcaacagtctcctacaaaatctttcctctctaaaaatgccctataacccaggaagaactcacatcaccatcacctcttcatgcaaagtaaaacttatgtgtttgggattttttttctgatacaataatgtacttaaatatattgtggaatataatttacttgatccacatctttaactgaacactttagaaaccaatatttattgattctcaggctccatgatcccacagactgatctgtatagcagtggacataggaaatggggagggacacagttagaagcactttcctaaacccttcagatgattgtccatatgcagctcacagatctccacctgccaaacatcacatgccacttttgagagttaattggcactaatagaagtaattactatgatctcatttctttcttccagagccttcaatccctgatgttcataacaaaggaggcacgaagcccagttatttttggctcttgggctggttgtggtcatcataccttaaccaattttctacccccactgccaataagtgctggggctgctaactgcaattgttgggaacccactcctcctctacccaccaatactgcttggcactgtaagaaagcagagaggggccgggcacagtggctcatgcctgtaatcccagcactttgggaggccgaggtgggtggatcacctgaggtcaggagttcgagacaagcctggccaacatggcaaaaccccatctctactaaaaatacaaaattagccaggcacggtggtgcatgcctgtagtcccacctacttgggaggctgaggcaagagaattgcttaagcccaggaagcagaggctgcagtgagctgagatggcaccactgcactccaatttgagcaacagagtgagactccatctcaaaaaaaaggaagagaggaaggaaggaaggaaggaaggaaggaaggaaggaaggaaggtggggagggagggagggaaggaaggaaggaaagaaagaaagagagagaaagaagaaagaaataaagagaaagaaaggaaggaaggaagagagagaggaaggaaggaagaaagaaagaaagaaagaaagaaagaaagaaagaaagaaagaaagaaagaaagcaagcaagcaagcaagcaagcaagcaagcaagcaagcaagcaagcaagcaagccgggcacggtcgctcacgcctgtaatcccagcactttgggaggccgaggtgggcagatcatgaggtcaggagatcaagaccatcctggctaacatggtgaaaccccgtctctactaaaaatacaaaaaattagccaggcgtggtggcgggtgcctgtaatcccagctactgtagaggctgaggcaggagaatggcgtgaacccgggaggcggagtttgcagtgagccgagattgcaccactgcactccagcctcagcgacagggagagactccgtcaaaaaaaaaaaaaaaaagaaagaaaggaaggaaggaagaaagaaaggggcccaaagtcatgatgtcatcaggctcatctcaggacaactctttcattgacttccaggtttcgtttttattacaaagccacaaagcattaataggacaaaggtaaagagaaagtattgcaggccgggcgcggtggctcacgcctgtaatcccagcactttgggaggccaaggcgggcagatcacgaggtcaggagatccagaccatcctggctaacacggtgaaaccccgtctttactaaaaatacaaaaaattagccgggcgtggtggtgggtgcctgtagtcccagctgctcgggaggctgaggcaggagaatggcgtgaacccgggaggcggagcttgcagtgagccgagattgcgccactgcactccagcctaggtgacagagcaagactctgtctcaaaaaaaaaaaaaaaaaaaaaaagaaagtattgcattgagtgaagcctaaggaaaagcatatgttttctctgaatgtaattttatgtataactcttgaatatgaaaatactcaaattgacgaggtgctctttcaagtcacttatcccagtcctctcccaactctatcaggattaagtggaaaattctagagatttcactgttagcaactccttgttctcacaaaggcatctttaaggatttacagttctctaaggatgaatgacaaccttgaaagagagactccaatgcactgcaaggagcagtatttaataactcaaggtcatgtgttctaattctcaataaatcttcttgattacttactattttggagtttgacttttcccatctgtaaaaaagaaaaagtaataacaactgatatcacacagttgattaaaatattgtacataagaataaaaaactagaaaaaattcaagtggtaatttatagagtatgaggactccagtgggggcaggtggtaatggactacctggaaatatgggattgtccttgggaggacacatcaggaagtgtcctctatcccggggtccttgacccctgtgctcttgacctttggggccacataattccatgttgggaggggtgatgtcctgtgattgtagtgtgattaacagggtaaattcagaagtgggaaccaggtagttaaagtgaattaagccaaaatgggtcaacatggtgatagagatgaatagagttggtaggaaataggaaacaaaggtgaaacacacatagatggacaaatgcaggtggaaggataaatccaagaacaagaataacatgggaagaaatgggaaatctcaggaagagttaaagggaaaatagcagcgagagttgtgaaagcagaagaaattattctggagggctgcttactgcttgaaatgccttttgtttccactcgttcttcacaggatttggggaagctctcaacattttaaatgtacgtagagaagtgcttctgatatcacctgctaacaaccagataaccagatcacacctggacaatttctgggagcagggggttctctgtcccactgtctatgtttgcaaagccccgtttttcactcgcttgtgaccatttgctgaaggagatcaagttgcaaggtcacatgttactggccttctattaatacaataatctttccattttttttcaacacgcagctctagcaaccaggaataggtataataattcacatttaattaaagtcaaagaaaagagagcacaagaatttgtccacaggtcaagttcctttaggtggttaccctaaagacaaattacacctgttggtccttgtgagaagagacacccattttaagcaacaagaagcctgtgccatttgggactaactgggcttggagtccacattagattacattgtttcaagttccttaggcatcattagcaccatccatagttctggagctataaagaacacatttttaataaactagtgtgaaggttttatttataatagtatataaatattagaaattaaaaactatacatttgctattataattctattagtattcagtcttcaggactaccagtattaatagatagacctttccctctctttatgtcaaaatattcctggaagaaatttaatagagaaactattttagggaggagggtgagtatatttattaattttctattgctatataacaaattaccgccaattcaattgctgtaaacaatactcctttattatctcaattggtttaggagtacaggcatggctctgttgcatcctctgctaagcgtctcaccaggctgaaatcaaattgttggccaggctgaattcccatctagagtaagggtcctcttccaaactctttcaagttgtcagaattcaggactttgcagctggagaactgcagccctcagctgctgctggacacatttctccataggcatctcatggcatactctgtttcttcttccagcctcttttaaagagcccatctggttaggccaggcccacacaagatgatctcccttttgattgactcaaagtcaattaacagaccttcactaaatatgaaaaaaatctctccatctttgcagtagtgtaagtaatcacaaacactgagtctaagcaacatgagtgacatgagtgatgcccatcatatgcagaggccccgtccacattccagggcagggtcattgtatgggtattagggggtcatcttggaatttctcctatcaccttgagtttgggattagtaattgaggcagattgcttggctttatttgtatatccaagcaaaatattattattattttaattagcatgccatgtaatatttaataaaaacgttaaacatgaaaaaactatgttttatttagggatatatgacacccttattagaaacagaaataagtatttagaaatttaaaatagcaatttcagcatagcagttacttcgatcatgaaaaaagaatgtaactggatttattgttggttagttttttaagtgggatggtagttacacgagtgtttattatattgttttagaccttttaaggagtcttaactattttatgataaatgtttaaatatagtgattaaacacttttttgtgtaattgactgttttcaaagttatgtgacaaagcttctgccttcaacaatctcaaaaatctaacaagggaagaaccagagaaataagaaatgacaaatgtcttacaaatttttgtgtgaaaaggactatgggataggtcatgcacccaaactaaggtttgaatgaaagaagcaggaagtttcccaggagggagcacggcactctggaggaggggtgggaattgtctgccaagtgggaggggtgagtccagagattcccaggagggagcacggctttctggaagagaggtgggaacttcctgcaaagtaagaggagcaaggccagactttcccaggaaggagcacggcactttggaggaagggtgggaactgtctgcggagtaggaggagcgaggccaggagcagccgggatgccgaagggaaggcccggggcaccagcgatgggcagctcagagcgggctatggggtagggaggaagccagaggagcagatgcaggcagatctggaaagacctgggtcactctgctatgcttccccttctcttgaaagcactggggactcaagagtcctttaaccaaaggaataatggtattgacaaatatcgacctggcaacaggataaaagtgagttcctttgttagtttgaattggagggaggtagaggaaggtagaggaaaggaggctggagttttgaagagcacattggtggttttgctcccggcctccactcctcctctctttcccagcaaccctgtcctgttctgtagggcctgcttcctttgtcctctgacctccagctggcttcatgaaatgggcagcagcagatataggaggagaaaggcgagtaaaattgagatatttaatccctacctacagatttgtggggggctaacaatcgccatcgaaaagcccacagttcatgctgagtatctctctccacgcaactctctctgcatctctggtgtttgcttcttccccttttccctttaggggtggtaaagtctgccaggcatggttctatggtctgaacgtttgtgccccccactgcccccaaatacctgtgttgaaatcctaactcctaaggtgatggtattgggaagtgggacctttgagaggtgatcaggtcatgagggaggagctccctttaatgggattagcgcccttataaaagagacccccacagagctccctccccaattccaccatgggaggacacagggagaagttggcagcctgcttcctggaagagccctcgccagcccctggccatgctggtgccctgacgcaggatttgtggcctccagaattgtgagaaataaatttctgttattcataagccactcagtctatgatattttgttatataacagcctgaataaactaagacacatgggatattgcatttttccttgtttttctacaccatgtctgaacctttgtaagagtcccttaactaaattatcttcagaatgcccaatctgtatgtcatctgtttcctgtcagcacacagggcgcctaacttgggaggttactgctgcgatgtaaggcagatgccgcaaggacctaaactaagactgcagatagggagaggaagcatcagaaggattcgatggaaaattgatcacagctgataagcaattgactatggggccataagtgaatgtcaaaggttattctcaggtttcagatctggattaccagaggatgctgtcactgttcaccaaaaaaaatatatatatatgtatatatatggccagagggatgtgaagatgttaagccagggttgatcatgagttcagtttaggagagaatatatttgaggtgctttacaggcagcaaagtgtaaacacattgattcagatctcaggactgagataaggcctaaagacatcaatttgagcgtcacttgatgtacaggcagtatctgaagacaagaaagtacacgtgatcacccagagattttaggtaaagaggatccggggaaacctcacagcttaagggggcggggggggggcagggcggcagagggggaagacaagcttgcagagaaaaagatgatttcaaggatggagtgatcattactaccagaattactaagaagtcgaataagagaaaaacttggctgtccacaataatttagcaactgcttctcatggacgttgacatattgtaactaaaatgccacttcctcaggttgtctctatttttctccattttcttcataggattaatcatgatatttactttttatatgacagcctcaccctctaaaatgcaaactccacgaggcacatcttctattgcttgttcatccttacatcaagggagcaagcatggttgaatacgcattgcttaagtgaaagtcaaggaactaggaggccattattatcttttgatgttgtctcaacctaaccatcatccaaattattctatttatgtactgttaggtgccccagtctctctgtcctaggtttctgggcctgaaagaaagtgtgctgaagcagcaggaagtgattctgcactgcttgtcgcattagcctccctcccacctgatggttgtgccatcttcatattttgtacgctattgactaagtgaacagctattttcatgtattcctttaaagaaatgatatatgaaaaataactttcagaattatagaatctaagaatctaagagcaacagatcagtcagcaccagtcattctcttataatttatcttccattactctaccgattatttcagtcatattagtgttgttaaattaagattagcctaaagctgtctccttacatatttcaagtttggcctaaaggtttcttcgtacatagtgaactgtaacctaactgtatgtgtaaacagactgtaacctactcttgtaacacgcagctgagtctcagccaattgcaggtggccaactgttcaaacaaggcaaactccaagctataaccaatctggctgtttctctacctcacttacatttactataccttattttccctttttcgcccataaactctggccatgtggcagcacctgaatcactctgaacctattctggttgggagtagagatgaccaattcacgaattgttacttcctcagttaaactctgttaaatttaatttgtctaaagtttttcttttaaccctgtattatagagatcaacttataaattcactcagatgatttttaaaatcgactttagatttttttacatttttattatctacaagttttatgaaaataatgatcatctgcctgtatctgacatagtacaagaatttaagaaaaacttaaatgtttccaaaaaggaagtaaatataagactcctcagagggcaacacgatctggaaatacttcaacttcttagtaggagaaataatctcaagatagaaacttaaaaagtacaagatgatagaagtaagtatataagcaaataaaaaactatctcattttcagttaatttgaataaaaacagatattttggttattaattatgtgcttcgaattccattttatagttgaacttcaaaaagtttaatattatattatgttcatagaaaatcaaatgcagattttcataccttttcctgtgacttcaatcagacatgctcagtggttttctactcagaatgtgcaagttaatctctatgttgtaaatggcacaaatttccactagcagtacaacataaaatagcatgtctgagctcacaaacctattccttcttactggcattttttaaatgcatgagaatttactcatttaaaaaaaatccttacaatttttttctacttctcagtcaacctaagaagctgacttgttttttttttcatcagtttctctatgaaaattatatgaaatagaaaatagacaatattatctatgtaaatggtttttgcccagctgtattatgggcacaaaaatatttatttctgtgatgtcagactacaccatattttctcttgaaatacatatttcagaattaatcaaagcaaaattaatttttttagcattgttaaagtagagaattcaaacttaaagagtctggggggaaaagagaggaaaaggctggaaatggagtcacaaagtcctacataaatctatatgagggattgcacctagaaacaagaatttagtttgagagttaatttattcaatgtgagtgaaatttcaaagcttcaatcactggcaggtttcaagcattcattataaggtaatctccttaagatagattttaccaatgatgacaattcactgaaataacacatttacaattcataataagtcaaagatacaatttaacaaatgagaatttccaatatgatgttaagatcagccctctgcatacattccttgctcctcagtgttgtagcccatcagtgcatgatgacagtgcattaacatggcagcagagaatggccatcaccacggcagcctgaacatggtgcctctatgagactgtccatgcaagtgtcacctgccctccaccacccagccactggctctgcccagtgactgcctttctctatcagagcaatggccccacatgctaaaccacaaagatccactccaactgacatacaaaagtatctggcaggtggggtggagcccatgcctgagatggactagcctggggcaattaaggagccattaggttgtgcctctgaagatgtctgcacacattcagggaccaacagacagctcattttcagtctcgtattttgaaaaacgcaggaaatcttacatttgaaaaatctgcacagatggtttctggtacttttctaaagcatccatatgagagcagccacagatagaagggaggacacagccatgtgtgtaggtttgtctgagagagaacaccaaggcccactctgggatcagccacgatgccatactccctacaacttaccttcgaaagagattttctttgggccaaaaactaaactgaagaatgtatttctagggaaaaatacacagaaacacacacacacactcatttgtatccatagctatacagatatctgtgtatgtacagtggtccctgggtatctgtgaggcattggttcaaggaccttcctctgacaccaaaattcaaggatgctcaagttccttatgtaagatgattgtagtattggcatataacctacatgtgtatactttcagtactcctgtatactttaaatcatctctagattacttaaatacctaaaataatgcctacacatcacttcattcccatggattcaatgaggcacatggtgtgaaattcaactttttcttttgaaactttgtaggattttttttccaaatattttcaatccgaggtcagttgaatccaaatttgaaacccacagatgtgattgactgtactttaaatcatctctagattgcttataatataatataatgtaaatgctatgtaaatagttgttattctatattgtatttttattagtattattttaattgttttttattgttttcttttaaatatttctatctgtggttggttgaactctgagaatcagaacctgcagattcagagggccaactgtacttacatgtatatctaaaagaggaaaagggagtttgagaagaattgggagaatagaccgttaacagggagtcctggcgaagcttgagaggaagaaatgaaaaacacaattcgccaatttgtcagtttggccaaatggcatctcaatcttcctcaatctctataaattaaataaatgcacatgaaatttaaaagcagtataattttaatggatccatttcttaaaattagttgacattaaaagacagcatttgttactgtatattatttggtcatttcaatttccagagattaataggagatagcaaaaaataatgcaaataaaggatacaaacactctgccaattgtttgaattaacttcaaattagaattgcattcttcaagtatgatgcttttctgttaaatgctataagtgtcttggttgtttcactgccactgcaaacagaaatgccaaaaagaatgctggatttccatcgagttttcacatgcgccacatagaggctgggaagcttagagaaatatgacttcgaacagataatgacttcaggctcagtcaatactgcatggaaatctactaaacattagtaagctggtgctctctgagtgttgggactttctttcaggtttaatggctaacattccattttttttgtcttttacaaaatgtctgtagcaagtatgcattaattttgcattaaaaaagtgaaacaagcacagtaatttaaaaacacaaatgacatattggtttaagagatgcccagcagagctacttctcccactgacaatggaaagggaagagaaagccaagaaagaggttttgacaattgtccttttctttttccttctgcctgtaatggaaaacacacaaacacacatgcatgcaggcgcacacgcacacactgtgaggggtcttccgtgacagccttgctccaatacggggatttccaagtggttataaaatgccttttgaagaaaatcccaccattttgaaagtcgctgcttcttttctgactgccaagttgcagctccctggtgagtcattgtgcaacaaaaatggccttctgggcccccaggcgctacctcgccacacaagctgccagtcacccagacctccagatggcaacagcaggactgaagctaaagggcaaagacactggcgattaccagagcagagaatgggacagaaataggaaatacaaacaaagcaaagtctgaaaggcgagggcctacaacctggaaatcagcgggtgttggcattcaggagaaagttcttttccttggacttcaatatacttaatagtaaatgaaaaaactgaataaaaacttgctggatggattgactaggggcagaatcaggatgcagctgcaactgggaaccaggcatcatggaaatgctataataatcctccagtaaactttatctgcttttaaagagaaagtgcagtagtctccagctacctgctgcatggttcatgttttagctctcctttctcagctcatggtgaagtcagcctgagagtgtggaacctgataggaggcctcgcaataaaagtcagtgcctggggcctctcccagggaggagcaggtttgcagaagaataaacttgaaatcaaactccctgtgggaactgataattcctaaagagaagcagtgaggaacagtgactgacattttgtgctctgcactcatgcagacttaagtttgaatcccagatccaggtccaccctcctagcctgcaaaatgagaaacataataacaccttccttcccttgtacaattgttctgagtggtgcccagtctggatcttcatgagcactcaaaaaatgtcggtggttcttattaaaagaatggtgaatctcctgagctccagcattcttttacgcaggcagatgctttagtatttctttatatttcaagaagtatttctagacttgaaagcacagttctgagagtatgacctgtaacatagatcagacctctcataggattcagaaaatgataccccaaagtgatagcctccaaactagcctcagaagcaaagtctctctctgacctgctcttctgtctctcaccattcattctccctcaagtctagccataataactagaattcttcttccccaaggtggacatagaaactagaattcttcttccccaaggtggatgtagaaaccagaaggccctttccctaaagtcagcaataaaccataaaaatatttctccagccttccctgcctttctgtgtaagggctggccataaagaaattctctgacctattttgtttaatggtagatcacatgaccccctttacagaaagggtttagcctcacaccctggagaaaggaacgctgcatgaagaggccaagaagaatctgagcagacaggccttgccaggtaatatgatttgggtctgtgttcccacccaaatcttatgtccaattttaattcccaatgttggaggtggggcctggtgggaggtgattagatcacgggggtggatttccccttcggtgctcctctcatgatactgagtgagagctcatgagatccagttgtttaaaagtctgtggcacctccccgctttctcttcctcttgctccagccatgtaaggcatgccttctcccccttagccttccaccatgattgtaagtttcctgagggcttcccagacatgcttcctgtacaacctacagaaccgtgagccaattaaacctcttttctttataaattgaccagtctcaggtatttctttatagtagtgcaagaacaaactaatacactgggttttctcactccgtctgttagcattagatgatacccttttcatccaatcagatttccacccagctgctcatttttcatcaaacctaggcataaaaatgggctgtttctctatatttggaggccttcattttgaaggctcccatatctcaaaaagctttgattaaataaatccgttctacttttctattgttagcctgtcttttgttactggagtatcggccatcacccttatgatggggaaggaaaggcaacacaccattttgccctcatatctcaaaaattttgttgtgaaaacctagttttaaaagaacacctgaaaatatagttttgaacaaaatgaaggtgttgtaaagacaaatttggataaaatttgtcaatgaattgagaataatagccaaagaccagataaaatatatggccatatcttttagatatcccaaagtaattttctatattttgaaggtttcacgaatgcctctaatcctgaagaggtcaaaaaaaatctcaatatgtgagatggaaaataaagaagtttccaaatctgctgtacacaacactgtagtttattcctagagtgattttagctaacacatggccaacattttcccgtaatttcttgcctattactgttttctcagaattccaggcattataaaagccaatttcattgtgtgagcatggcatttgcatatttccagctgagactttcttacaactcaatcacttttttttttttttgagacagagtctcgctctgtcacccaggctggagtgcagtggcacgatctcggctcactgcaacctccgcctcccaggttcaagcaattctcctgtctcaacctctcaagtagctgggactacaggtgcacgctgccacgcccggctaatttttttttgtactttagtagagacgaggtttcctcgtgttgcccaggctggtctgaactcctgagctcaggcaatccacctgccttggcctcccaaagtactaggattataggcgtgggccaccatgcctggccttaaatacttttattgttacaaaaatagtttcttttgacaactgaataaattccttttgtgcacttcctcaggacaatatattgttatttttgtaagctgctacagatatgagaattagattgctaaataccaatgttgtttgccctttaagagcttagtcatggattgattcatgagtcacacttttcataatattactaatatactatgaaataaagatgaactactttctatcttgctaattcctccctttaaaaattggtaggagcatatatcaagtatatctgtattcaaatggattttataaatattattctcaaattttctctgctctcatgcataaggatatattacacatatctacacatcataaaatttctacccatctgtagattctagaatagtggttgattgctaaatagtaatacacaaacatgtattctgtataatataaatagaatgataacaacagttggtattctaaaactatagagcacttaaaataattgcctgttatgtgttggtataattaaaatattgttgataaaactattatgcatttatataaaataacattacaaaagaatgagtgtgtgtgtgtctgtgtgtgtgtgtgtgtgtgtgtgtgtgtgtgtgtgtgtacagcaaaagcgttatatagtgcagcagaaattcagactttggaggatatggtagacgggattctaagatgccagaccccaggatctattcctcaagaatgggactttgaatataatgagatatcatgcctgtgactatgataacttacatatataaaagtaattttgcaggccgagtgtggtggctcacacctgtaatccccacactttgagaggctgaggtgggcggatcacttgagcccaggagtttgagaccagcctgggcaatatggcaaaaccttgtctctacaaaaaatacaaaaattagctaggcctggtgacttgcacctgtagttttgctactcaggaggctgaggtgacaggatcacttgagcccaagaggcagaggttgagttgcagtgacccaagatcatgccattgcaggccagcatgggtgacagagtgagaccctgtctcaaaaaaaaaaaaaaaaaaagcaattttgcagatgtagttaagtttactaatcagttgactgattaactgggtggttctggtttaatctcaggagccctttaaaagtagagttttctgtagttctggcagaaggggaagtcagattcaaagcataaaaaggatttagtggggctttgctggcttccaagatgcaggggccacctgtcaggaccaaagaggggcctctggtagctgagaataacctcacccactggccggcaaggaagcaggaatctcagatccacaattccaggaactgaaccctgcctgagtgagcctggagtaggtgtttccccagagcctctgggtgagggcccagccacagactccatgatgagagttgaagctgccagactttgagcccacagaactgtgagctaataaatgggcactgctttaagccactgtgtttgtgggaatttgctatgctgccattgaaaattagtacagaggaatactttgttgtttggggttatataaatgcctgaaaatctgcaatgcaacaatgtataaattaagcaatgtggattaatattagaaatcacctagaacaatgccttacacatttttattatgatgtattaacatttaagaagcagaaacctaataaaaagtgactgcgtgataacataatagccacgaacaaccagatgaacaagcggtggtagaaaatgctctggataaggacgtaagggaagctggtgctcctaccaagtgatcaatacaaatagctcacctgggctcagtttcttctgcaaaggagttaagtgtactaatttatttctaatgattgataaagactaaaccaactctcagttctctgaaggcacctaccctgggcccactctggccggagctcctgcgctcattctgcctgcctgcccactgggccacacttgctgggcccagctcaccccaacatggaacaaacgggggtgctaagcagcttagcagattcacattcatatctaagtggaaagacaaaaggaactgctgccttccctttataggtagctgttcaaaacctgctctgctcagtataaagcttctattgttacttcaataagaagtacaaaggtttccatacttcctggtttaaaatttcaattttcagtttttgttagcctgtatcttctagccgcactacccaaagggcctctttcattgtcctctctctggctacagcccctaagacaaaaagcctctgcctctgctggagaaagcgattccccagggcagggaacagaggcagagagcagcactctgggccccagcttgtttaggtctgatgttggcaccacccctaaggtagccttgtttcacccaaccttgcagtgcctcagtttctccagtgggtaatagtagtaccacaaggaactgttaaaaagatcacatgaattctgtatgcaaagcacttagaagaggtggtggtaagtgtcgctaagtcttccctattctgttgctccaggctgtttcactctccacctagaagcacatgtgtgtgcctgtgcatgagcatgcatgtgtatttggcacattatcatattagcatgtaattatgcattctctgccctcctccattgtggggaaggtgttggagggctttttatctttcactgaggaccatccacagcacccagcagacccgtgggcacgcctctggctccacatgtgctctcggcaggaccgagtgtgcagagcgcagcccagctgttgtgttcctccctttctcacactgttatttccattcttttgctgttttgaaaaagggatgccataaagtttgtttaaagtgtgtgaaactagcaatcaggatgaatccacaagccaggcatggtgggtgactcacacttataatcccagcactctgtgaggccaaggtggaaggctcacttcaggccaggagttggagaccagcctggtcaacagagggagaccccatctctacaaaaattaaaaaagtagcctgctgtggtggcgtattcctgtagtcccagctacttgggaagctgaggtgggaggatcacttgagtctgggaggtcaaggctgaaacaagctgtgatcataccactgtactccagcctgggtgacagggcaagaccctgtctcaaattacaaaaaaaaaaaaaaaaaaaaaaaatccacacaggtaaaatacctccttcttccttgtcagaatcctatctgcccccggagcataaagtcagccagaagtgactctgaagatccacctgaccccagatactggggagccaaaggaccacagaccggtggtatttacctctctatgcagcaccagaccaggccttgccaggagtaattcatccaacccaaggtggggagaaaatacaacagtaagtcaggtgttgttttgttttctagtttaaccatgagataagtacttattaccaaaattgttttggtactattacctttgaatgtagccttttcacattgctactaatcatagtattcttactgcagtcattttatgttgtactgtaggaaatatttacatttgttctcatagtctgttatagctctgttgactagaaataatattttctaaaacaaactataactcactataaataatcacaaatataattaccaacattaaaaataaagaaataaaagtgtttagagcctattctaccttaacatgtctttctgatgatatatatattatatattatatatataatatatatgtccttcctttttcagactggagtcaacatcattaaaatcaaaccctgcccagggaatgtgacatagccaaggtctcaggattcccagtctgaaagccagagcttaggtgtcatatcaaacatgaatctgcaatcaatgagtgaagataaaggaattatgtatatttgatggtcatcattacccatctattattgtgcagatgtcttattaataaaacttacattttacataacgtaattctaaatgttaaatagttaacacctaaatcatgagttttaaataatttaaaattttttatagttattatgaaaagttacctaccatgttcaagacatattcctaaatcctgggggatataaagataataaaatacagaccatgaaaacctgaaaagttactgaaggtacctgaaaaggtagctacacaatagagagagcatttactttggagtcagagtgaaaggtcactgcacataagctcttgcataagtcacccaacatctgctcccagggaaaatgatgactttatcagaaacttcgttagcatccttaagatgctaaagacaaaagcaagctaagactctttcttcaatagagaaaaaagcgatgtatgattttaaaatattactctcaaattacgtagcgcccctgtgacttctaaacatcaccaccatcaaatatttataaaggcaaatattagtaaatagaataatcctcaatcccaagcaagtcaaatcacactgactaattcagtcattttacaaccaactgcatagactctttaagattcatttaaattgaaaaccagtataaaaaataaaatacacgataatttcattctcttagagaaaaatctgttcagactgtgaaaaatatcagggttcaaatttcttgccatggtctggagggatagcaggaagaaaagtaaaaattttgatcagaacatgatagcacatgactggaattgcttaaaggaaaaatcaagttggtaagttggaaagaacaacgtagaaagttatagtcacacaattgaaaaatagagggaaattaaaatcagcattgaaatgatgatttcctggctaatgcccaataattgtctctctttaaaatatttatttaaaacagatttttttagtactctgtgatctggcattttctctctttcctcttcttcataatcagacttacttaacagccaagcgaagatttaaagtttgccttcgactatcttacagtctttgagccttctcaaaataatgagcaaattagaatttcattgtaccataccagaaataagttcttttacatacaaatgtctgtcataaagtaataatctaaagatgcaacaaaaaatgtaattttagaacctaattttattggtatgctaaaaatgtgctaatcaccactatcaaatgacctgcattaatgaggaggcaataacaaaaattattttatcatagataataacgagaatgaacacatataatacttgctatgcacctgccactgttctgatagttttctatctgcctacttacctgtctatgtctacctgactactcatctatacaactacataaaccgtgcaaccttagtggcttttattctatctgatgtatggatataaaaactacagtttggttatgaaaagaaaaccattctctatctcaatccatgcttctaaaacctcatttggtaatgagggtgctctaatggcaacagctgtcacttattgtggtgagattcccagtttggctgacttgcagagggccccttctttctctaattttttatctctacactaaactactccctctgctatcctcacagctttcccaggcagcagatatgtgccctgtttggagcctccaaacaaatacccaagcttgctgcactcggtttttacctaacagcacctggcacaggtaaacttagttatgtcagcaaccattcaagagtagacccagaaaagtgtaaatacaacctctttcaaaagccaatcagctcgtcaatgtgaaccaaagaggcaatttctattttgacaaatatttaatttaaatacccaaatcagtaaacctagtaaaatattaatataacttcatatacaagccagtttgttatgatgaaccaaagaggcaatttttgtgataaaaatgtaagtggtgagtgatggcagaaagaatcaaagctgttgtcatccaggccctgtccactgagcagcctttgatgtctgctcacattagctgtgctttcttgaggttgcccagtcatacttatattgaatccatattttctcacaatagagattaaaaaacttacaagagcacatttaataagtttttttaacatcaacaaagcatatatctttatttgactggatatttttgatttgggtaattataaatggtatattttcctgaaacaaattaatcatgaaccatgtgtaaagtagcaagccaactgtacttttaggagtacaattaaatttctctgtgactttgcttccagcgattctggataaatttgaatactagcaggtcactagtggttaccaagttaaagagataaaattcagagcagggcctccaaaagataaaatcaagacacttggaaaaattaacaggtgagatttaataggaagtcagctatttttaattatttgtatatgatcatccaatttactgaaaattttaaaaatcttaaccttcattaggcaattatgtctatgtggttaaggaatacacattgaatatcaattatgcactactagacaatatatttattatatttcattatagtggcaagaaacagaagataaaatgtcagaataaaaaaaataccatgagacgaggtgaggtcagcaaacataaaatagtaggtagctccaaggggtcctcagagaaacattaaaatatcaagcagtaactgtcaaaaccaacttcgtcagaactctaggaaagtcaaaggtttacagcaacaaagcaaaggctgaatcaagaaaaagacagcttataaattgtaagaaagctttgtggtgtttttacttgcccttgccccacccccatcctgggttcaaaggtagtcttgaaatcagcagtccagggtcctgggccctggttctggaaggagcaaagcagattcattctcagagaattctcaaagtatttgtccattcgaacctgtctggggcctacctaaaagactgagacaaggtgcttgtcttcatttcactgaacttagaattcactcagggaagaaaagcagcagccattcctcaaaaccattctaaagccaaaaaacaactcagggacatgtgggcacaagattatagtgtaggcaaataacagagcagcaaaagcctagaaggaaagttgagaaaagggtttcttcggaaaattaggatattcaaaattgctgtgtacactgggaaatttagaaagccacaagcatatccaggactgaactcaggctcagaaaagacccaagaaaaccctgtttgcattttttggctgatctcttggtttaacacaaacagaaagtaaagactgagacagagttgtaaatggtctggctaagcactgaaggagtccccaggcacaagtcaatctacaagctttgggagaggcttctctcttcttctttatttctttctttctttcttttctttctttcctttttcatctctctctgttttcttttcttttctttttttttttttttttttttttggagacagagtctcactctgtcacccaggctggagtacagtggcgctgtctcagctcactgcaacctctaactcctgggttcaagcaattatcctgcctcagcctcctgagtatctgggactatagatgcatgccaccacacccagctaatttttatatttttagtagagatggggtttcaccatgtaggcaggaggatctcgatctcctgaccttgtgatccacccaccttggcctctcaaagtgctgggattacagacgtgagccaccacacccggcctctgttttcttgtttttatttttcattttgattcctggcattagggaaatctctaccaaaattctagctggacacaagtaaaaagaacagtcttcagagactacatgtaacaaaaagaagactttacaaaaaagtagtttagaaaagtcactaacagcaaacagctacagaccatagcaaacaaaaacaaatcttgaagaggggaaaaaaactgatttccagagtcaccatattatctattcaaaatatccaagttgcaacagaaactatgagccttgcaaagaagcaagaaagtttgtccagtttgcaaaaggcactaatgaaaattgtccatgatgaaacaaacacaaacattggactaactagacaaagactttcaaatcaactgtcttaaatatgctttaaaaaaagccaaaagaaaccacggcaaagagataaaggaaactggagaacaatgtatgaacaaatagagaatatccatagagaaatagaaagtatgtaaaggaagcagacatagtggagattaaaaatataaaaagacatattgtagctgaaaaatacagtagccaaatgaaagactcactagacagtttcaacagcacatttgagaaggcaaaagaaagaatcagcactctggaagataggtcaactgaaattatccagcctgaggagcagaaagtaaaaagaatgaagaaaaatgaacagaacctaagagactgtgggacactatcaagcatgttaacatacacataaatgagaaatcccaagaaaagagagagagaaaaaggaaaataaagaatacttcaagaaatagtagacaaaacctttccaaatttgataaaagataagaatctgaacatccaagaagttcagtgagttccaagaaagataaatgcaaaagatccgcagagagacaaattattatcacattttgatagccaaaaacaagagcatgtttaaagcactaagagagaagcaacttgtcatgtacaagcgacccacagtaagattaacagcagatttatcatcagaaaccatgcagacatgaaggaaacagaatgacattttaaagtgctgaaaatttttaaaactgtcaacaaaagtcttttatatctagcaaatgtatccctcgaaaatgaataataagatggcatactgcccaaagcaatttgcagattcaatgctattcgtagcaaactacaaatgacatttttcaaagaattagaaaaatctattttacaattaatatggaaccaaaaaaaaacccatatagccaaggcaatccgaagcaaaaagaataaaactggaggcattacattatccaacttcaaactataatacaaggctatagtaatcaaaacaacatggtactggtacaaaaacaaacacatagaccaatggaaaagaatagagtccaaaaataatgccacacacttacaatcaattgatcttagacaaaattgacaaaaacaagcagtgggaaattacttcctattcaataaataatgctgggataactggctagccatatgcagaagattaaaactggatgccttccttacaccatatataaaaataaattcaagatggattgaacactgaaatgtaacatgtaaaactataaaaaccttgtaagataacctagaaaatatgattctggacataggccttggcaaagattttatgacaaagatgccaaaagcaattgcaacacaaacaaaaagtgacaaatgtgacctaattaaactaaagagcttctacgcagcaaaataaagtatcaacagagtaaacagacagcctacaaaacgggagaaaatatttgcaaactatgcatccaacaaaggtctaatatccagaatctataaggaatgtaaagaaatcaccaagcaaaccacaaacaaccccgttaaaaagtaggcaagggacataaacacttttcaaaaaagtcatacgcacagccaacaagcatatgaaaaaatgctcaacatcactaatcattagagaaatgtaaatcaaacccacaatgagatactgtctcataacagtcagaatagttattatctaagagtcaaaaataacagatgctggcaaggttgtagagaaaagggaatgcttatacactgctggtgagaacataaattagttcagccattggggaaagcagtgtggctatttctcaaagaacttaaagcagtattaccattcgacctaccaacctctttgttgggtatatacccaaagaaatataaattgttctgtcataaagacacatgcatacttatgttcatcacagcactattcataacaacgaagacacagaatcaacttaaaaggccatcaacggtaaactggataaagaaaatgtagtatatatacaccatggaataccgtgcaaccattaaaaagaatgagatcatgttctttacagcaatatggatggagttggaggacattatccttagtaaactaatgcaggaacagaaaaccaaataccacatgttcttacttataagtggaagctaaacaatgagaacacatggacacaaagaagagaacaacagacaccagagcctacttagggtgaggaatgggaggagggaaaaaaattgagaaactacctattgggtatgatgctcattagctgggtaatgaaataatctgtacaccaaacccccatgacatgcaatttacctgtattacaaagctgcacatgtacccctcaacctaaaataaaagctttttaaaaatgaagatattaagacatttccagataaacaagagctaagagattttattgttagtggacctatcctacaagaaattttagagggaatcttttgagctgacatgaaaggacactaaataacagctctaaacaatacagagaagtgaaaatatccagtagagataactatataggtaattataaaggacacaattattaaatttcagggtttaagtcttcttttgatttcccatatgatctaaaatgtaaatacataaaataatagctataaatttatgttcacaggcacaccataataaagatgtaatatgtaatagtaacaacataacagtggaggtacagattgtatagggcagagtttatgctattgaagctaagttgatatcaattacctcgtgtctcatttctcaaggaaatgggatcagaatcaaaatagtaaaataaaaaattaattaaatgcaaaagaaggtagtaatggaggagaagaagaacaggaaaggtataaaacatacagaaaacaggaaaatgacagaagtaagtcctttcttaccagtaattatttttaatataaatagattgagttctccaatcaaaaggcagagagcagcagaatgacttttaaaacatgatgcaaataatttttttggctatgactccaaaacaacaaacaacagggccccaaattatatgaagaaaaaaggaccactgaagagagaaagtgatagttctacagtaatagttggagactccaataccctacttttaataatggatagaacatgtagacagaagataaataacaatatagaggacttgaaaagcactgtaaatcaactacatctaacaggctatattatttacaccacaacaggcagggtggggtggctcatgcctgtaatcccagcactttgggaagctgaggcaggcagatcacttgagcccaggagttcaagactaccctggtcaacatggcaaaatcttgtctctacaaaatgtaaagaaaaatgagccaggcatggtggcacatgcctgtagtcccagctactcaggaggctaaggtgggaggatcatgtgagccaagagttcaaggctgcagtgaactatgattgcattactgcctgggcaacagaatgagaccctatctcaatcaatcaatcaatcaataaagtatttaaaaaataaaaatatttacaccacgatgcagttatagaataaacattttttcaagtacttatggaacgtttaagatggaccacatatcaaaccataagtaagtccaaagtattaataagctttaatagattgaaataatacaaaatatcttccctaaccaaatagaatgaatttagaaatcagtaacagaagtaaaactggaaaattcataaatatgtggcaattaaactatatacccttttgttttttgttttgttttgttttctgtaattttagattttctgttattttagattcagggggtacatgtgtaggtttgttacatgggtatactgggtgatgctgagttttggagtataaatgatcctgtcatacagatagtgatcgcattacacaatatgtagcttttcagtccttgcacccttccctctctcaccattctaataccccccgtgtcaatttgttcccatatttatgtccatatgtacccaatgtttagctcacacttacaagtgagaacacatggtatttggtttttctgtttctgcattaatgtgcttaggataatgagctccagctgcatccacgttactgcaaaggacatgatttcattctcttttgtggatgcatagtagtccatggtgtatgtgtaccacattttctgtatccaatccactgttgataggcacctaggttgattctgtctttgttatcgtgagagtgctataatgaacatatgaatgcatgtgtctttttggtagtacagttgtttttcctttgggtatataccctgcaatgagattgctgggtcgaatggtagtttaagttctttgagaaatctccaacctgctttccacagagactgaactaatttacattcccaccaacagcatatatgtgttctcctttctctgcagccttaccagcatctgttgttttttaacttcttaataatagccattatctgcagtgagctatggtcatgtcactgcattctagcctgtgtgacagagcaagaccccatctctaaaaagaagaagaagaatagccattctgacaggtgtgaaatagtgttttactgtggtttcaatttgcatttctcagatgattagtgacgtggagcattttttcatatgtttgttggccgcttgtatgtctttctttgagaagtgtctgttcatgttctttgttcactttttgatggggttatgtgtttttggcttctttaattgtttaagttccttatacattctgaatactagactgttattggatgcacagtttgtaaatatttccttctatcctatagcctatttattctgttgatagtttcttttgttatggaggagctctatagtttaatcaggtcctgcttgtcaatttttgtttttgttgcaattgcttttgaggacttagtcataaattatttcccaagtccagcatccagaatggtatttcctaggttttctaggatttttagagtttgtgatcttatatctgtatctttagtgcaatttgagctaatttttttatacagtgaaatgtagggatccagtatccttcttctgcatatggctagccagttatcgcagcaccatttattgaatagggagtcttttccccattgtttatttttgttgttggctttttcaaagatcagttggctgtaggtgtgaagctttctttctgggttctctattctgttccattggtttatatgtctgtttttgaatcagtaccatgctgttttggttactatagcctcataatatagtttgaagttgggttatgtgatgcctctggctttgctctttttgcttaagacttctttggctatttggctgtcatttggttccgtattaattttagaatagttttttacaattctgtgaaaaatgacatccgtagtttgataggaacagtgctgaatctgtagattctttgggcagtgtggccattttaataatgtttattcttccaatccatgagcatggactgtttttccatttgtttgtgacatctatgatttctttcagcagtgttttgtacttttccttatagagctctttcacctctttggttagatgtattcctacatattttatttttttgtggctattgaaaatgggattgcactcttgatatggctcccggtttgaacattattagtgtatagaaatgatattgatttctgtacattgactttgtactgtgaaaccttactgaagtcacttatcagttctgggagccttttggtggaatctttagggttttgtaggtacagaatcatattgtcagtgaagacagataatttgacttcttcttttcctatttggaagtcttttatttctttctctagtctgatttctctgaataggactttcagtactatgttgaataggggtggtgagagtaggtatcctgtcttcttctagtttttaaggggaatgcttccagcttttgcccatccagtatgatgtcagatgacaacacactctttaaatgacaagtgggtcagagaagaaatcatgagggaaatttaaaaatacttaggacaaacgaaaacaaaaatactatataccaaaacttacgggatgcagtgaaagcagtgctgagagagaaatttataactgtaaaggcctacattttcaaaaagtagaagatctcaaatggataacctaactttacatctgaaggagttagaaacagaaaagcaagctaaatgcaaagcaaccagaaggaagaaaattaagattagagtggagataaatgaaacagagaagagaaaaacaataaatagagtcaatgaaaccaaaagttggttctttgaaaagatcaatacaattttaaaaactttagctaggctaaccatgaaagcaagaaaaataaaaagtgaagacaatactactgactttattaaaagagataaataaaatatgagagtactattaaaattgtacaccaacaaattagataacctaaataaaatagagaaattattagaaatagacaaattacaaaaactgtctcaaaaaaagcagaaaatctgagtggggggcgaagtactttttaagagattgaatcaataatcaaaaacctcacaacaaagaaaacctcaagaccagatagtttcactcgtaaattttatcaaatatttaaagaattaataccacctcttctcaaaattttccaaaaaaatagaagaggaaagaacgcttcttaactcactctatgagtttagtattagcctgctactaaacacagacaagacaccacaagagaagaaaatacagagcaatatcttttagtaatagtgatgcaaaaattgttcaacaaaatactggaaaattgaataaaaaacataacataaacattattcaccaggatcaagtagatttaacctaagaatgcaaggatagtttaacataagaaagtcaaccaatgttatgcaccacattaatggaatgatggaggagaaaacacaatcctatcaaatgatacgtaaaaagtatttgacaaaattcaacacccttttataatcaacaaagaatactcaaaaaacaagtaatagcaggaaatttctgaacataataaaggacatttattaaaaatccagataacattatacttaatggtgaaagaaaccttccccctaagatcaagaacatgacaaagatgcctattttcatcactactatttaacgctatattggaagttctagccagagcagttaggcaataaaaagaaatacaggcatccaaactggaaaataagaagtaaaactatctctattcacagatggcataatgtgtatctagaaaatctcaaagatttcagaaaataactactatagataataaatcaatttatcacacttgcaggtacaaagtcaacatgcaaaaatctgctgtgttctgtacataagcaataaataatctgaaaagaaaattaagaaaacaattatacttatcatcaaaaagaataaaatgtctagaaataaatttaatcaaagtaaacatttatacattaaaaactacaaacattgctaaaagaataaggaagacctaaataaatgaaaaaggatttcatgtttatgaattggaaagcttaagatgttgagattacaactaccaaagtgatacacagatgtaatacaatccttataaaatttccaatgactttttttttttttctgcagaagtagaaaacctgtcctgagtagtggttctcccagcatggagtgtgagatctgagaatggacagactgcctcctcaagtgggtccctgaccccagagtagcctaactgggaggtaacccccagtaggggcagactgacacctcacacggctgggtacccctctgagatgaagcttccagaggaacgatcaggtagcaacatttgctgctcagcaacattcactgctctgcagcctccactgctaattcccaggcaaacagggtctggagtggacctccaggaaactccaacagacctgcagctgagggtcctgactattagaaggaaaactaacaaacagaaaggacatccacaccaaaaccccatctgtatgttaccatcatcaaagaccaaaggtagataaaaccataaaaccacaaagatggggaaaaaaacagagcagaaaagctgaaaagtctaaaaatcagagtgcctctccccctacaaatgaacgcagctcctcaccagcaatggaacaaagcaggacagagaatgactttgacgagttgaaagaagaaggcttcagacgatcaaacttacctgagataaaggactaagttcgaacccatcgcaaagaagccaaaaaccttgaaaaaagattagacgaatggctaactagaataaacagtgtagagaagtccttaaatgacctgatggagctgaaaaccattgcacaagaactacataatgaatgcacaagcttcagtagccgattctatcaaccggaagaaagggtatcagtgatggaagaccaaatgaatgaaatgaagtgaaaagagaagtttagagaaaaaagagtaaaaagaaatgaacaaagcctccaagaaatatgggactatgtgaaaagaccaaatctacatctgattggtctacctgaaagtgacagggagaatggaaccaagttagaaaacactcttcaggatattatccaggagaacttccccaacatagcaaggcaggccaacattcaaattcaggaaatacagagaacgccacaaagatactcctcaagaagagcaactccaagacatataattgtcagattcaccaaagttgaaatgaaggaaaaaatgttaagggcagccagagagaaaggtcgggttacccacaaggggaagcccatcagactaacggcagatctgtcagcagaaactctacaagccagaagagactggcggcgaatattcaacattcttaaagaaaagaattttcaacccagaatttcatatccagccaaactagcttcataactgaaggataaataaaatactttacagacaaacaaatgctgagagattttgtcaccaccaggcctgccctaaaagagctcctgaaggaagcactaaacatggaaaggaacaaccggtaccagccactgcaaaaacatgccaaattgtaaagaccatcgaggctaggaagaaactgcatcaactaacgaccaaaataaccagctaacatcataatgacaggatcaaattcacacataacaatattaaccttcaatgtaaatgggctaaatgctccaattaaaagacacagactggcaaattggataaagagtcaagacccatcagtgtgctgtattcaggagacccatctcacgtgcagagacacacataggctcaaaataaaggaatggaggaagatctaccaagcaaatagaaaacgaaaaaaggcaggggttgcaatcctagtctctgataaaacagactttaaaccaacaaagatcaaaagagacaaagaaggccattacataacagtaaagggatcaattcaacaagaagagctaactatcctaaatatatatgcacccaatacaggagcacccagattcatgaagcaagtacttagagacctacaaagagacttagactcccacacaataataatgggagactttaacaccccactgtcaacattagacagatcaacgagacagaaagttaaaaaggatatccaggaattgaactcagctctgaaccaagcagacctaatagacatctacagaactctccaccccaaatcaacagaatatacattcatgtcagcaccacatcacaattattccaaaattgaacacatagttggaagtaaagcactcctcagcaaatgtaaaagaacagaaattacaacaaactgtctctcagacgacagtacaatcaaactagaactcaggattaagaaactcgctcaaaaccgctcaactacatggagactgaacaacctgctcctgaatgactactgggtacataacgaaatgaaggcagaaataaagatgttctttgaaaccaaggagaacaaagacacaacataccagaatctctgggacacatttaaagcagtgtgtagagggaaatttatagcactaaatgcccacaagagaaagcaagaaagatctaaaactgacaccctaacatcacaattaaaagaactagaaaagcacgagcaaacacattcaaaagctagcagaaggcaagaaataactaagatcagagcagaactgaaggagatacagacacaaaaaacccttcaaaaacatcaacgaatccaggagctggttttttgaaaagataaacaaaattgatagaccactagcaagactaataaagaagaaaagagagaagaatcaaatagacgcattaaaaaatgataaaggggatatcaccaccgatcccacagaaatacaaattaccatcagagaatactacaaacacctctatgcaaataaactagaaaatctagaagaaatggataaattccttgacacatacaccctcccaagactaaaccaggaagaagttgaatctctgaatagaccagtaacaggagctgaaattgtggcaataatcaatagcttaccaaccaaaaagagtccaggaccagatggattcacagccgaattctaccagaggtacaaggaggaactggtaccattccttctgaaactattccaatcaatagaaaaagtgggaatcctccctaactcattttatgaggccagcatcatcctgataccaaagccaggaagagacgcaaccaaaaaagagaattttagaccaatatacttgatgaacattgacgcaaaaatcctcaataaaatactggcaaaccgaatccagcagcacatcaaaaagcttatccaccatgatcaagtgggcttcatccctgggatggaaggctggttcaatatatgcaaatcaatacatgtaatccagcatagaaacagaaccaaagacaaaaaccacatgattatctcaatagatgcagataaggcctttgacaaaattcaacaacccttcatgctaaaaactctcaaaaaattaggtattgatgggacatatctcaaaataataagagctatctatgacaaacccacagccaatatcacactgaatgggcaaaaactggaagcattccctttgaaaactggcacaagacagggatgccgtctctcaccactcctattcaacatagtgttggaagttctggccagggcaattaggcaggagaaggaaataaagggtattcaattaggaaaagaggaagtcaaattgtccctgtttgcagatgacatgattgtatacctagaaaaccccattgtctcagcccaaattctccttaagctgataagcaacttcagcaaaatctcaggatacaaaatcaatgtacaaaaatcacaagcattcttacacaccaataacagaccaacagagagccaaatcatgagtgaactcccattcacaattgcttcaaagagaataaaatacctaggaatccaccttacaagggacgtgaatgacctcttcaaggagaactacaaaacactgctcagtgaaattaaagaggatacaaagaaacggaagaacattccatgctcatgggtaggaagaatcaatattgtgacaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactataccacaaggctacagtaacccaaacagcatggtactggtaccaaaacagagatatagatcaatggaacagcacagagccctcagaaataacgccacatatctacaaccatctgatctttgacaaacctgagaaaaacaagcaatggggaaaggattccctatttaataaatggtgctgggaaaactggctagccatatgtagaaagctgaaagtggatcccttccttacaccttatacaaaaattaattcaagatggattaaagacttaaacgttagacctaaaccataaaaaccctagaacaaaacctaggcattaccattcaggacacaggcatgggcaaggacttcatgtctaaaacaccaaaggcaatggcaacaaaagccaaaattgacaaatgggatctaattaaactcaagagcttctgcacagcaaaagaaactaccatcagagtgaacaggcaacctaaaaaatgggagaaaatttttgcaacctacttatctgacaaagggctaatattccagaatctacaatgaactcaaacaaatttacaagaaaaaaacaaacaaccctatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactcttggtgggactgtaaactagtgcaaccattgtggaagtcagtgtggcgattcctcagggatctagaactagaaataccatttgacccagccatcccattactgggtatataccaaaaggactataaatcatgctgctataaagacacatgcacacgtatgtttattgcagctctattcacaatagcaaagacttggaaccaacccaaatgtccaacaatgatagactggattaagaaaatgtggcacatatacaccatggaatactatacagccataaaaaaggatgagttcatgtcctttgtagggacatggatgaaattggaaaccatcattctcagtaaactatcacaagaacaaaaaaccaaacaccgcatattctcactcataggtgggaattgaacaatgagaacacatggacacaggaaggggaacatcatactctggggactgttgtggggtggagggaggggggagggatagcattaggagatatacctaatgctaaatgatgagttaatgggtgcagcacaccagcatgggcacatgtatacatatgtaactaacccacacattgtgcacatgtaccctaaaacttaaagtataataatataaaataaagtgaaataaaataaaaaaatgcaaatcaataaacataatccagcatataaacagaaccaaagacaaaaactacatgattatctcaatagatgcagataaggcctttgacaaaattcaacagcccttcaggctaaaaactgtcaacaaattaggtattgattggacatatctcaaaataataagagttatttatgacaaacccacagccaatatcacactgaatgggcaaaaactggaagcattccctttgaaaactggcacaagacagggatgccctcactcaccactcctattcaacatagcgttggaagttctggccagggcaatcaggcaggagaaggaaataaagggtattcaattaggaaaagagggagtcacattttccctgtctgcagatgacatgactgtatatttagaaaaccccattgtctcagcccaaaatctccttaagctgataaacaacttcagcaaagtctcaggatacaaaatcaacgtgcaaaaatcacaagcattcttatacaccaataacaggcaaacagagagccaaatcatgagtgaaatcccattcacaattgcttcaaagagaataaaatacctaggaatccaacttacaagggatgtgaaggacctcttcaaggagaactacaaaacactgctcaatgaaataaaagaggacacaaacaaatggaagaatattccatgctcatgggtaggaagaatcaatattgtgaaaatggccatactgcccaaggtaatttatagatacaatgccatccccatcaagctaccaatgactttcttcatagaattggaaaaaactactttaaagttcatatggaaccaaaaaagagcccacattgccaagacaatcctaagcaaaaagaacaaagctggaggcatcaccctacctgacttcaaactataccacaaggctacagtaaccaagacagcatggtactggtaccaaaacagagatatagaccaatggaacagaacagagccctcagaaataataccacacatctacaaccatctgatctttgacaaacctgacaaaaacaagcaatggggaaatgattccctatttaataaatggtgttgggaaaactggcctgccatatgtagaaagctgaaactggatcccttccttacaccttatacaaaaattaattcaagatggattaaagacttaaatgttagacctaaaaccataaaaaccctagaacaaaacctaggcaataccattcaggacataggcatgggcaaggacttcacgtctaaaacaccaaaagcaatggcaacaaaagccaaaattgacaagtgggatctaattaaactcaagagcttctgcacagcaaaagaaactaccgtcagagtgaacaggcaacctacagaatgggagaaaatttttgcaatctactcatctgacaaggggctaatagccagaatctagaaagaactcaaacaaatttacaagaaaaaaacaaccccatcaaaaaatgggtgaaggatatgaacagacacttctcaaaagaagacaattatgcagccaacagacacgtgaaaaaatgctcatcatcactggccaacgtggtgaagccccatctctactaaaaatacaaaaaattagccgggcatggtggcaggcacctgtagttccagctactggggaggctgaggcaggagaatggcgtgaacctgggaggcagagcttacagtgagccgagatcatgccactgaactccagcctgggcaacagcgtgagactccatctcaaaaaaataaataaataaataaagttaaataagtaaaataaaacaattataatattttaaaaagatcacatttgatcagagaactaaaagtgaaggagacagttatgccagtctctaatagtctgggtggagatcagggcaaatatataaaccctgtagcaaaggcacatttttacatatatatatatatatacacacacacacacacacacacacacatatgtatatatatacacacacatatgtgtatatatatacacatgtgtgtgtatatatatacacatatgtgtgtgtatatatatatgggttgtttttgtttttgtttttgttttgagacggagtctcgatctgtcgcccaggctggagtgcagtggcactatctcagctcattgcaagctccacctcccaggttcacgccattctcctgcctcagcctcccaagtagctgggactacaagctcctgccaccgcgcccagctatttttgtatttttagtagagatggggtttcaccgtgttagccaggatggtctcgatctcctgacctcatgatccacccgcctcggcctcccaaagtgctgggattacaggtgtgagtcaccgcgccgggatgatatttatatttttaaaaaaataaaagcctatagtagcagcagcagcgtgaagggggctgagtctaggagctcacgtcagaaaagggccccaggctgattgtagacggccacataggttatggcggggacacggatccataggtggaagagaagacttttgaatcagtcagggttctccagagaaacagaaccaataggaaatacatggagacataaaagagaagatttacacaggaattgcctcacatggttgtggaagccgagaagtcccatgatctgccctctgcaagctgaagacccaggaaagcccgtggtacagtctgaaggcctgagagctggccggctgttggtgcagattccagttttgaagtctgagagccaggagagccatgggcaaaagatggatgtcccagctcagcattcaggcagagtgcaaattcctcctccctctgactttttgttctatgcaggccctcagtggataggatagcacccacccacactagggacagccatctgctgtcctcaggccaccaattcatgcttatctcttccagaaacaccctctcagacacactcagaaatcatgtctaatcacatatctgggcatcctgcgccctgattaatttaaaattaaccatcataccatcaacggatggtgttgagcagatgattgagatcatataacatctatttagaggatcacacggctgcttgaggagctggtaaaaagagacagggagaccatttaattagctttggctgtaggtgaaaggcagtgaagccagagtgactgctgatagcagtgaggtggtgaacagatcagatctgtagtacatttaaagatagaatgaagtgcatttgctgatagatgtagggtttgaggtaaagagagattagaatgactttaatattacaggccacctgatagaataaaagtaacacagcctgaaatggagaaatttacaggaggagcaaatttggtaaaatatatgaatcaaaagtttgattttataaatactgagctcgggatgctgacaggcctcagatgttgtgcagacagttacgtgaaatcgcagttcaaagtcatagtgaaaacataaatgtggagggcccagtgttgaaaaccatggtgctggacatgctcaccttgaaggtgagtgtaaggaaagtgctgcgtgctgagctgtgaggcattgcagcataaagactgagaagaggaaagacagagggaaaggaaaacaagagccaagcaatgagttaggaggataccaaggaaaggactgtgttatgggatgaactgtgttccccgaaatgggtatgttgatgccctaacccctcacgtgactaaatttgcaggtagggcccctcaagaaggaattaatgttaagtgaagtcttaaggacactgccctgatccagtgacactggtgtccttataaggagaggaagagacagcaggatatctgtgtgcagagaaaaggccagtgaggatgcagggagagatgacatttacacaccaaggagagaagcctcgggagaaaccagacctgctggcaccatgatcttggacttccatactccaggactgtgagaaaatacacttctgtttttaaagccacctggtctgtggcattttgttgtgatagccgtagccagctaatacaagtgataacacaaagtgcaattaaggaaaatatttcaaaaaggaggagttgaccccctgtgtcagatattgctgattgggcaagcaaaacaagcactgaagaatacccacgagatggggcacttccatggcagccaacggttacctttcagtggcgtggtagtgctccagactgacctgggtaggtttaagagaggaagggaggaaagcacacagatagaatgagaaatgacaacacttctaggagccttgctcctaaggggagcaggaaaatagggagatagcaagagagagggaaagaggtgtcagatcaaaggaagacatgttacagaaattattaaatgtcagtatgtttgtgtgaaaagtacaaaagaaaatgacaaaccaatgattaggagagataggggacaaccgcaagaatctgccactgcctgggagagaaaggaaatgatccagggcacaggtggttgtagaaaggggccaggacggtttattcagtgcagcaggagtggagagagagccgatggcctgggagtgcaaatgtctattactactggtacttcagcacatagatatactgtaaaaaggatacaacgtacttttaagagaaatgtatgctcttgggtgttttcaccattttggagctttctttttggaagctaggatgtatcatcccttatacagggtctgtgaattctgagtaacataaattgaggcaaaggcaaatgataagaagtctctaaggagacttcatgacccaattagtaaagcccacgccttagagccaagaaatatcttggatgtgccaatcagagaacggcaacatagagtttttataagccaaattttcctggcatccaccccagaaatttctctctatttctggccagtatcaaaataccgacacatgacaagaagttgggccaagggggaaatgaaggtgaagagaacttctcagagaaggtgagtgatggtaattgtgctgctgaagcttcacctatgtgttctgggagttccccaaaacgaggcagagagaaactaaacaattccactgagcactgtgcaagccttttgaaaaatacagcaggttctgtatttgcattatgtagaaaaatatgagtcatcattttacaatgcagaagttaaaatttccccaaatcacaaagagatggtagtatatgaggggcagtattatggagtggctaggagcatgaactttgtagccagagcgcctgtgtcaaggaaagatctaccactgcatttttctgcaagactgacaaagttaactgacttctctgtgcatcagtgtcctcagctataatataaggatcatgatagtgcttcatgggctttattaaatcacaggtaaatgaaaaacacttacaatagtgtctccataatattgactttatttttaatatttattattagaatttataattagacacagagaagggactcaacaatattagcttctttctttttactttttgcctattttttaatatcaagaaaagcactgtaaaatattgaatatttgattcttagatggtatgacatcttgggcttcatataacgtttgcttttatggtgttagtttccaaagtcacataaaggatagcctttttcatgcatcattcttctttttgcaactcaaaagtagggtgtctaaatatatgtcactcttacagtacaactactataattactctcattacgactattactaccaccgccaatcataactaatgataataaacttttacctttctgtagtaggctgaataatggccacccaaaaatatcaggtcgtaattcctggaatctgtaaattttatctgataaggaaaagggatcttcggggatgtgattaaattaaggatcttgaaatgggattattcagagtgggcccttaatccaatcacaactatccctgtaaaagagagactctacagacactgaatagaaagcaattcttagtgagagatagaggcagagattggagtgatgtggactcaaggcaagaaacaccaaaggatgccagcagggcctggatgctaaaagaggcaaggagaagtttctctcccagagcctctggagggaaggcagtcctgcccacaccttcgtttcaggcttctggtctctagaattgtgagagaatccatttctttccatttaagacaccaaggctttggtgattttttttaaagcagccctagaaaattaatataacttctttgcattccttacactatattttacatgtattattttgtttaatcattacattaattatatgcgctatgattatcctcttttatagatatggaaactaacatcatacagctaatgaaagtcagaacttgagctctcacccaggtagaagattctaaaagctatcattatgtttatacttatgctgttataatgatttcatgtgtttttactaaaatgttttactatgcttaaaaactttgtcaaaaatcacatttaaacaacataataaaaaattacaaatgggtagaaattccaaatttgatttagtgctcatacatttcctatttatatactttcctttttcttctactaacaggacacacaagtgaagaacaatgaataagaggatgaaacaattaatatgggtgcaaacatttcatcattaatttttaagggatttttaaagaaaagctagtaaaatttccgtgtcaaacaacatgctttaagaaaagagaaacctctttggctggtaactgtgtcttcagcccttcagacaagacatgctcgaggaaaaaaacggcagtagttgcagcaccgacatagaccccagccttggtttaattgtcattttctcatgaatctgaaaacagccttttcaccttgaaagaggaaagtcggcaaataacacacgtgttatgagacttgaaactttcccattaaacgtactgtgttttttaacctgtaattataacaattttccttttaaatcttgtctagagctgaatcttttattcttttggaaattgggtaaatgtttaatactagaagacataatctcttagctttgtaggtgaagaaactgtgatccaaggagtaaaacaatttactcaaggtcacatatttagtcattgtaaagcacctaccacaacacttcacacataacatgtttacaataaagagaaaatccccttataatttttaattttatatttctagttgggggggagtctgtaatatatttagtattgctaattgtgcatacattaatgctatttctttctttttaattatgtttttattttactttttatttttgattaaacattttattgactttagaaaaattctcattattgatctgttttgcagatgaaacattctttggacagtgaaaatccaggccaggcatggtggctcatgcctgtaatctcagcactttgggaggccgaggtgggtggatcacctgaggtcaggagtttgagaccagcctggccaacatggtaaaacctcatctctactaaaaatacaaaaaattggctaggtgtgctggtgcatgcctgtaatcccagctagttgggaggctgaggcaggagaatcacttaaacccctgaggcagaggttgtagtgagctgagatctgctaccgtactccagcctcaacaacagagagagactttgtctcaaaaaaaaaaaaaaaaaaaattccagttagtcacctttgaattgattccataggagtactgtatcttaaatgctcctttattatatacagcaaaatagtattatatacagacaaagtcaagagattaagagtaatattcaaaatttaacaatgtacaggcatagattaaaaaaaaataagtcttccagtagattttaaagtcaactatttactaattggaagtttcctttgatctgccctgactcttctcactcaccctatagccacccaaaacgtttctgccatgatcgagtataaaagtttgaaaaatagacaagaccacttaacttggttttattctcctgatgttgtgattttgttttgtaggataatgaggaagagaaatttattaggaagagatcagccagagtcttttttacattgccttaccatgaccattttccaataagctagcactgtattcagtgctcaggccctgttgcttgtggaaattgccctaggagaactacctctaggatcagatcaggtcaataggcagaagacttggtctcatgttggtgaagttcagtgcaatttatgctgcagtgccaagtttgtggagataaattagtctattagccactagtgataaggttgattgttgaacagcaaaagtgagaatgatgcatttagttttgaatttggtaagagcaaagacaaaatgacctaactcttatcagtggttttgccacaaatcgatcactagttcatcatatgccactatcttctcaatacaagctttacaaaaaaagctacagctaatatcacgtgctgtcccctgagactgtatacagattggaaaggaaaactgtttatttccaaaggacatgattgtgtaattacaaaaatccaaaggatataagcaaatgagtagaattagtgaggattaatttagtaaggtcactggatacaatatcaatatacaaaaatcaattgcattttatctactagcatgaaataaatagaacatataatttaatgccatttaacaataatattaatacatacattaactaattatatgtgatatttagttaaacactctacaaactgcacctgtatctatatagcttacctaggaataaagcgtagtatataatttggaagcgattcggccaaattagaataaacacacatagatgagtgtggggagacagagaaacgtgaatgtggcaaaatgttaactagtgaattttacgtaaaatgtacaaagcaattatcatgcccttcttttgagatttgggtagctttgaaattttcaaaataaaacgtcagaggaaatgttagtaaacttaaggtttaaggagttaaataacttgccacacttcacaaaacaattggaaggaccagaaataccccccaacccctcccttttgacgttcttctcaaggttcttttcatcttgcttttcaattaggccttccttccagaaggcagatgagtgaggagtatcagccctagaatcagatcttcgtatttctgttgttgctatttaaatagtggcatgcatttattttatttttgtggtatagtctaaccttttgtccttggcatttattagcattgctcttcctccagggctcaatcatcttttttataagcatgactgtgttgtccagaattgaatttgagcctgtttcccaaatgtattactcttatcagtgtcatccagaaactggaaggcagaggcaccctggcaagtcacagagctctgccaggcaccacttggctgtgctgcagcgggtgaaattcagggtctgataacagatccttgatcttaccctctagctcttaggctccagcaatacataacatttccggattttttattaagtaaacctcttagcaagctctgtttaatacaaaaatgccaactgtttttgagaaaaccctctcttttacaatatagaagcaatgtggttggcatttttttaaattgtaagaaaacattggagtttctgtgcaatttactataaaggcaacccaaggaaatagaatcaccagatgcttgatttcattttgtgatgctgtgttcatataagagccatatggtcaaaatttttaatattcttcatgaaaaatttaactttattttttaaaaaatgtgtccttatttcttttgcttttacaataaattagtaaagacctttggatcttcacttaactggactaacaaattcctctgaagtctcaggagtggtaagtgtctcattgcttaactcattttctagacagaaatctctctctctctctctctctctctcttactgtctgtctctctgtctctctctctctctctcacacacacacacacacacacaaacacacacacacacacacaccaaccacatgtacacacaacttactgtttaaatgatctaccatctgtattccagggaagtacttttcctgaatgctatcatgagaaaccatatagtccagcagttaacagatcaaactctgtggaaccctgactctgctcttttctatctgcctcaatttgggtaaattacattacagccatgaacctcaatttcctcatctgtaaaatgaacgtagtaacacctaccacaaagcatgaaagaaaggaatatagataatgtatataaagcaactagtataaaatgaggcttgcaattaacaacataattactattttattacggttttctaataaaaaatatttagaaacaaattaatattatccatggtttctgccaagtgaagaagtggattattcatcaataattagtgttcatcaataattgtgtactgtaactccaaaaagtggccaaaccccaatagattttatcagtttgtcacactccttgaattttttaaatggcaactatctctaatgaaaatattttataacattttatcatattcacaatttaatcaatggataaaatatttgattatctatcatatacatgtttcagtagacagtggtgaaaggcttcacccagaaatactcattagaagatactcaatagcctgggcgtggtggttcatgcctgtaatcccaacactttttgggaggccgaggcggatggatcacaaggtcaggagattgagaccatcctggccaacatggcaaaaccctgtctctactaaaaatacaaaaattagccgggcatggtggcagacacctgtaatcccagcaactcaggaggctgaggcaggagaattgcttgaacccgggaggcacaggttgcagtgagccgagattgtgccactgcattccagcctgggcgacagagcaaggctctgtctcaaagaaaaaaataataataatcaaatgcagatctttgggcccatcctgagaagtcctaaattaggatccctggggaagagggctaggaatttgcatgtccacaagcactccaggaaatgttttcgtacattgcactttgataatcattgctttattgtaaaacaaagaataaaccctgcagtccttactttcttatgttcttacatcatcccaaacagagatactgtgataaaaatatgtgtgttccggcatcagttactggaaagaaaccagatgggagaagcacaagtgtaaagttatgatctcaactctaaagttagaagggctagcttggcctgaatatggtgagttcagccaagttgataaaattgctaactctatcatgagaatattatgacaagaagacaaacacgcccacatgggtctagcctcactgaagattcttaactttcagtgtgttcactcagtggattaatctaaatgcagcataggaagattttatatattgaacctccagtcatcatctctcataggtctcttctccttatagcacttactatacataggaattttttctattacagacatattacagttgggtgttggctacctgactgccccacaatgtcagaccatcagttgtatcatagcaggggcatgtgcattcggatccaaatacaaaaccagccaactggtagcccacaatagataatagatactgttaagtgaataaaataaatgcctttaaacttggaaacatttatcagtgcttagccataaagttgtcatttttttctctacatgatatgttttcatttaagactatcataaaacagcatctctacatgattctaaagctattctttgttttagagtatcacaaataagaaggcctagtagcatactgagtagagcatgggctttgcagttagaaagttgtgaattttaatttcatttctattgctttcttgccatgggactcatagacaagttacttaacccctccttctccctatttcttcttctcatgaagcttttctaaaccaatagaatacaaataaattggataaataagaatctcttccatgttcaaaaggttataaaaacataggcagtgtaaagaagcagcagaattttcccagttataagacatctacaaggtgtcattcttctactagctgttcttgacactcagaatgactttcacggtaaattgccatccaaccagcatataattttaggaaccttacagataagcaataagtactcacagtgtgttcaaattcttgagtttcttgaaggcgctccctggaatttctcttattctgttaaacctcaagtctctgggaacataaaaaggtgaagaacgattataatatgttgactgcattctgccattatttccagaagcttgaaggctaaatctccttttatgatcaaacatacagtactaaaggactaaatataattaagacagaactagtgcacatcatacactaatcattagggaggtgcactgtttatagcaaattttgcatctctggggccatatgcttgtcacaggatgccagacaaatgtggctatttatagagctctgcaaagtgttaaagacagttacaccatttattttaggttttatttgtatgccagtaaaacaaattctatacatggcaatatgtcagttgagtacatttagtttggaaaataattgatatattagatgtcacatatcaactcaacaccactgtttgaatttagcaaaaattattaattacttaatttttcttcacagtacaggaatacaatggccttctacaaagtattaaatcaacagaacaattagtttgagagagacgttactccacaaccaacattctctttcatgagtccacatcttttttattcagcatgtaaataattgcgtgtcagctatgtgccacctatcatgttaagtaatagggatgcaaagataagcaagatagggtccctgctactgagcacagatagttcagtggggggatgtcaagcaagttattacaggactagggtgcatagtgtttgtgatacaacagaggatcaaacaaatgccatgcacacttggaagacttagggactgctctgcctagagcccctctttcagttggagaacgaggcgccccactccatgtcattatggtaaagacgtcaagcaggggcctcttcctgcccggaacagggtggttaactgggggcagcatctccacgggcatactgtttcttccatggggaacatatgacccaagccaggccagctggagttgtttttaagcattgacatggctgctgaataaaagtcatgttctctctctggggttcagagctctaaggaaaatgaacatctagggtcactacctcatcttgtccactcaagaaagcgccagcctaggaataaaggcccagcagaaacacatagggccaaaatagcaaatgaaagaaacaaagccctggacccaggattgcctgagaccaaatttactccttgactttccagatccctgacaccagatgctgtcattttgataaactaatttgagctgaatttctctctctaacgcaaggagtatagaagaaagatgaagttatttgcttggaaatgttaggcccaaggagaagtatatcagggaaattttatagggcgctagaatggcagtaatagaataaaatgaaaacaaaaactatttacttcccctcaattaatttctcaaaacaaaactcttcaccaccataaaaagttgttctatcttagaatacttgactcacaaaactttataagagtaccttaaaatctatcatctatcacttcatctttctctagactttgccaaaatgagcaaaattttataggagctattattttcaattaaaattattaaataactcagtgactatacctccttgctaaatggaatgcactgcttatacaccatccattgctgtttggtatgtctagactatatcagtaaaagaaactgtaagctatatgagatcctccctataaacatataagacattaagttatgtagacccgaataccctggaaaccactggtttctcttaaaaacagaagctaaaaattaacagttatagaaagggctctcctcttgcattaaacaataatcctaataattctcccaaaatgagattccaatacaacaaggaagcaaatataaaaagataaaccattttccttattttcggctttgaaatttctgaaaaattcagaaaagtacaaatgagaaaataataatccttactgtctacatccagaattaactactattaatatttataccttgatatagttgcttctactcataatttcacgtgtgtatgtttactacacaaattatatataaaaacacattgtagataaaatgaacatcttttaagcaccatcttaattttagctttgcctcccactccagatgtaaccactcatgtatttgatgctcctcttcagacataacatttctatatatgtggataaatataagatgaaatgtaaacacatgcagatactccttgacttatgacggggttatgtccttataaatccactgtaagttgaaaacattgtaagtcaaaaatgcatttaatacaactgaactaccaacatcatagcttagcctagcctaccttaaacacgctcagaacacttgcattagcctgcagtggggcaaaattatctaacacactccttattttataataaatgttgactatctcatgcaatttactcactaatgtacattacatcaaaattgtaaccatttcacaacacggtaaagtcaaaaatcataagttgcaccattgtaagtcaacaactgtctatatatgaaaataaacctaatatataggcaaatttaaaatattttgtgcttttaaatttacaaaaaagctatcaaatgttatatggttgttaaaacttcccttttcccttccactacatattttctatgttgttccttgtctacacataaaggactaggtatttttgtctaacttctccacagtactccacagtgcagacagaccacaccgttcctttatagattcctttactgacagacagtttggtcgtttccaaatttttgcaacattatttactaacaatattgcaataaatatgcatgcatgtctccttgtacacttggaaaaatgtttgcctatgctaaatatttggaattgggattgctagattatagggtaggtacattttcagttgtacaaaatgatgccattgcaaatttattttcagctacatacaatataatggtaatttaactgaaaataatgtgaaaagatgcttgaactcatcaccaaattatagatttaaacttatcactggattgatttgaaagccaaggtgctatatgtatctattatcagaattcccttcttgtttttctccacaagtaagcagacataagctcttctgccataaagacagtcttgcttgtaagctggtgccatagaaaggtctccagggtacccaggctcagtggactgtaagactctgcccactgactttggccacaccctattctcaccagtgaggcatgctcagggactcactctcttcctgagaagcagagtgtgggctgggctgggtgcagtagctcatgcctgtaatcccagcactttgggaggctgaggcaggaggacccttgagcacaggagttcgagaccagcctgggcaacatgacaagacccatctctacaaaaaatacaaaaattagccaggcatggtggtacacacctgtggttgtagctactcaggaggtcgaggtgggaagatcgcttgggcccaggaggtaaaagctataatgagccgtgatcacaccactgcactccaacctgggccacagagtaagaccctgtctcaagaaaaaaaaaaaaaaaaagaaaagaaaaggaaaaaaaaagaaaaaaaagtatgattggacacccaaagattttctcgagatcgacttaaactccaataagtcacattcaaatataccaaaatgaatatgttagcactcgatcctctttggctagtacattctggcacataaatttttataggtaagtacattataagctgaaattctaggaaaacataccccttcctaatttgaatcccaggtctttaggattgcatacagggccttgcacagtgtattacctatcgtagggtaagtatatttctgaaaattagattatttaaattcaaatggccaccaaatttggataatgatactgtgtaagtatgtacatttacccagaaatacaattcatttcccatgttatatggttgttaaaacttcccttttcccttccactacatattttctatgttgttccttgtctacacataaaggactaggtatttttgtctaacttctccacagtactccacagtgcagacagaccacaccgttcctttatagattcctttactgacagacattttggttgtttccaaatttttgcaacattatttactaacaatattgcaataaatatgcatgcatgtctccttgtacacttgaaaaaatgtttgcctatgctaaatatttcactcaagatcggtcactagcaatttcatttatataaaatttgtcattcatataaaacttcccttagcctaaaatgtagcattgtatttttactccttacacagagtggaaattaagttattatatctccttcatcccattgtaatataaataatattgatgaaataatatttatgataataacaacccttgtataacacaattttcatcccattcattgttctttggaactcagttcagaagcaatcctagtcattgtaccaagataaaagttgggcacatggaatttgctgggagggttagacaagtgtgtctgtctgtctcctctactctccccagcacaagctgatgaagctggggaagaaatgtttaatgctcttctgcagaagcaattcggaatcaacatttttaactaataagatgtgagtttctagctcaaactcaattcagaaattcctgctgccaaaaagagatgaaaatgactccccgtggcagattgaggatgaagaaaagggatggacagagagcaacatgaactagctccacgcgaactatcatagctccaagtcatgtcagttggtccccgagttaacagtgcacaccagactcacctcacagcccattatgcctcctctcagtgggttacatggagttacaccacatggatgtgcagaaatgtgcagagaaagacctagcagagtgatagaaaagcccaggccttgtctaaaatccagaagttcccagtggattttagggcaaattttacattaacaataaacaaacagaaatttaatataaagaatacagttatctatgactgtccaattcacaaattgcagtatttatttatttatttatttatttatttatttatttatttatttattttgagaaggagtcttgctcttgtcgcccaggctggagtgcagtggtgagatcttagctcactgcaacctccacctccgagttcaagcgattctcctgccttagccccctgagtagctgggattgcaggcgcccaccaccatgtcgggctaatgtttgtacttttagtagagacagggtttcaccatgttggccaggctggtctggaacacctgatctcaggtgatccgcccacctaggcctcccaaagtgctgagattacaggcatgagccaccgcgcccagcccacaatttaagatattaaatagtgtgcgcagtacagatggtgcagtccagtgtaagttgtaagataaatgtgatccttttgaaatactatgtgtagctgagactgaatgcaaaatgtcgttaagacataaaatcaagtctgaacttgagccccttcctgaggatacccaggccacatagctcatccagtgaggtggggcctcctggtaatccctgggttgaacacagtctccagatttgttgtgagtagatgcttggctatcatagctaagaatctcatgctcagagagcaaaacaaatgagctgaaacattcagagagtgccgtcttaccagactgatttctgtttgcgtgtggtacttgtttgtctcaaatccgagaaatattctttctgggagaaagcctgtcttcctgagaaaaagatcaaccagatctgtacctgggccaaaagcattcctattgaaggtaaggatgcaattaagtcactggaatggcacaagcctgccaccgcagaaagaaaggcaaacaggttcctgtctccctgagctaccatgaagggcaggagggagaagctgattcctaaaagctgggctgttattttattgggaaacatgcactcctgtgcactcctgccctgcagcccatttttggcatcagagtgagggcagactctactccctgtagccaggccgtcagtcactccaatcagccctgctccagctccccgccacaacccctccctcaggcgatgccctttgcgaccgccccccatccagcatttcaggacggtgctgggacactgtcgggacactgccgcactgcccggccttggagtcaggggaagaatcaaggagatttttccacacctctccctgttgctctaaaacaagtcgtcttcatcatttcatttgacagccctgtcattgtagaaattggaaatacattttccaggcttgagacaagcatctggaggacaccctccatcttgcccgattcccagtcatgttcccagctgaggaaggctcctgaattttctcgaatctccagtgcacttcctgcctcccagctgccagagcttgaggccatcttccgctgttgattgctggcccagtattaacctgctgtggtggttaattttagggatcaacttggctaggtcacagcacccatggaactcagcttttggccaaaaaccagtctagattttgctctgaaggtattttttacaatattattaatatttaaatcagtgggctttgagtaaagcagatcacgctccacaacgtagttgggcctcatccagtcagttgaaggccttaagaggaaagccccaggtccgctgaggaagagggaagctgtcctcagactgccttggacttgatctgcaacatcagctctttcctgggtccccagcctgccggctgccctgaagatatcagagcagccagcccccacaattgtgtgagccaattccttaaaatctccctctccttatacacacgcacatcgcctgctccctggtgtgcagctgttggtctggcaaaatctgtagggagaccacagtgtgaggaaagccagaaaggaagggcattccctgtgggaaacttgtctgcagttagtgtggggcaggtggcagtggggtgattttttctttcttttcttttttttttttttgtacatgtttgatacttatctacagatctccaacaatggctaaagcagcacttatacataaaaaggaatactataaaggcttcaaagaagacactcaaacaactttgtaaaagttcttctatctagcgtcttcactttgctcctcaatgaaattcccatcccacatctacactattttccagaaatcagtttaattccctctcaagctcatgaattagaccaaggagagctgagacttgctctgctaaagtgcttgttcacaaagtccctgggatcagaaaatcaattataattggccttccttattttcgggtctgcagattcaatggactgcagatcaaaaatatttggaagaagcaacaaaaaataaaaatatggccgggcatggtggctcatacctataatcccagcactttgggaggctgaggcaggcagatcacaaggtcaagagttcgagaccagcctggccaatatggtgaaacccagtctctactgaaaatacaaaaattagccgggcatggtggcaggcccctgtagtcccagctacttgggaggctgaggcaggagaatctcttgaacccaggaggtggagtgagctgagattgtgccactgcactctagcctgggtgaaagagtgagactccatctcaaaaaataaaataaataaaaaataattttaaaatacaacaataaaaatacacattttaaaaaataaagaatcataactatttgcacagcacttaccttgtattagttataagcaatctagagattattgaaagtatgggggagaatgtacatagtttataagcaaatactacaccattttccatcagaaatttgaacagctacggattttgatatcctgggggttccagggaccaatccccctcagataccaaaaaaacagtgtactttatgagtcttactgttgagcgctgtcaggcactcatgggaagttaaaataggtcagcagcaagggagcacacatatgtataaacataaaaactaaggggtgcacatttcatcaacatcccagtttttataaacatccagtactacttttataaacttgaaagacttgatcttttttaaatgaatctggcttgccaatgaattggcccagcctttggctttacctaagagaaagccaaaagggaagtggagagaacaggaaggcactcacatactcatcccagctgaagctccacacaccgtttcaaggcaggtgttaacatgatgattttagaactgaagaagttaagacccagaacatcagattcccctcaaagcaaagccagtggacccgggaaatggccctcaagtgtatctgctgacacagcaggcactgcctccattgccctgcctgcgcttaaatgtgttgtgaggaagctgagaccccagtgatggaccagcaggcccaccattggctgactaccaagggcccgaggctgcaccggaaaacccatctcctgatttccttgttagtacaatttccccctcattatcctaaaccaagttcccacttttctcaggcagggcaattagtgttccacgttaaatcccttctttttcagggattatgtggttacagcttacaaacaccctttatttcctctaatgaactgacattgaccgagttaatggaaggtgttaaccagttcaaggcaagtcagcgttgacaggggtatgcggccaccttctccagatcattaaaagcatctgaaagtaaggagaacattgcggttttgacggtggtatccctgtatgtgggaacccagagtaaactgagaaaacctggatagaaagtcccttccagatttcttcatctgctacatacctggttctaccagcaggtgtcactaaaaggtagccctctcttacaggtcagagagctgatcaagagagatgagggggccacggtgggtgctgtaatcccagcactttgggaagcccgagacaggcagatcacttgagatcaggagttcatgaccagcctggccaacacagtgaaaccccgtttctactaaaatataaacattagccagacatggtggcacacgcccatgatcccagctacttgggaggctgaggcaggagaatcacttgaacctgggaagcggaggttgcagtgagtggagactgcaccactgcacttcagcttgggcaacagagcgagactctgtctcaaaaaaaaaaaaaaaaaagagcgagaaagagagaaatgagggggtttgatctgtcctgaacgttgcagtgggagaaggactaggctacatctgaacagcgtcattgggtcacattcattggcgtgtgaaaatagcttccaactgcaaagtctaactcggaggtcatcatataccatgttatataaagtaatgtctttcacttggaaacaagaagctctaagtgaatttttacacaaaaccaaagcataacctcttgaattgctaactttgtcattctggagaaagtgagtttaaaagtaataagatttaacttttcaaatgaattaacataattcacagttttaggatcattgttatattatgcaatgatttccactgtttctgtgccccacactccatgttaaatgtggctcctccaaatgcccgtgtgcctgggaagacagactggcattactggatctcactagacaataccagcccatttgcacgtgagccaataaacacagcatgaagacagaaaatgatggtatcgctgagatcagacttggctgtatttttatctggcattatatttaccttgatagtccttcctgtctcctactgctcagctgctgcttgactctgggggagtcagacacatcctcccagcctggttcttgaccatttatatagtgacctgggacttggcaggagtgagatgcgctcccaggtgccctgcggtcccactgtggatgaagctgagcctgtctgcatggctgtcacccatctccacaccctggcctcccccagccctcccaggcacactgaacctgctcatcacagcctggtcatactgttttccagctctatgcaggtgcacatgtggttcctcttcctggaatgcccttgcctttcttctctccttcctacatccatggtgaagtcgagggcaccacatctcctgggagcacccgcacaggaggtcaggagacgcacagatggtggcagctgccctgccagctgcaccatctgctcgggtgcctcttgctgccaatgccaggactggctgccacactggaatgtggatttcaaatttacccttcctttccttagagagacattccctgacaactgtgctctgggaacccctgtgctcccctaaggcctttgcaatggaggcagttagcgcagtggttgggagtccaggcttcagccaggaaagcgaacccgcggtgggtctccctggacacccctgagcctggcagcttggacaggcccacactctcaggactcctcattataaaataagcataatgatgctcagtactaaatgtgaggatttatctagagcatttagaatagtggctaataagtgcttgtagtcatgacatgaccaatatcaatacagatattgcttttataacattttaaacaccatgttgtcattgtctcctaacagtgtctctgttcccacccaacacaggcaaactgcgagctcttgaagagcagggaaatgtctaactatcttccttatatgcaaaataaagcataaatactgacacagagtattggaccaaaataatagcaataataatattgctagtgaatgaatcacttatggctcataattggcgaaattcaaagtattctttccttccaatccaaaatcaattaaggaaaagaaaaatccagttaacagaatgtacattcctctacaaggatagccaagctggtcactgtcacttgcagttctgtgcagatctgcctgagtgttgggaaatgtgtactgtacaccacaaaaatcagatctccatacaccaaccatttcattcctgtgatgatgtgaggaagctgacagagacagtgtattctgcaatagtctggaactgtcaactatgcgatgttcttttgggaaactatatttttctgtcaaaattttagtgacttatttaacatttttgctttatctcttacaccgatatttggataccaatgataacaactgaaaaaatatttagcaattttgttgcatttcttcttcaacccactgcaagctaacctcctcctttaccacttcgttcaaatcatcctggcctacgtcacctctgaactcttgatgcatagtcagtgaactggagtcatcattttacttgatctttcggtggcatttgatcatgttagctcccttcctttttaagctatccttgatcttcccctttctctttgaacagtctgtctcagactctttttccagaccatgttcttctgcctgcctctgtatgagccctcttccctcttcccttgaccttcctttagcaattccatccactgtttggtttccatgcagctatatataagtaagtaagcagaaagtatatgcatgaggaagcataagtgtgtgtctatacttagggagatacatatacatatatacatgcatatatccatatacatacacataaaccaaatctttccctttctcttagatattgactatgcccttcatacttgatattcatctacccatttgacctctctaataaatgggcgtaccaaagatacctgtcaactttacccaaagtcttaaaaaatgcttctcttctcactatttttctattctcagcccagacacaaaatcagagtcctaggagccacccattctttctgaccctacacatccatgcagctaccaagtcctctgcacctcccaagtcccatgcctgcataatcactgtcctgatgggccattctcctgcactctatatgcccctcttgcatgcagctgtgggggatttttgtaggaaagcaaactatgttggtttttctgtcaatttattttaattctcccagtttaaaatccttccaggcatggctgtccatcaccagcagaggctaaccatagctgcctgtgtgttctgagacccaccccgattttctgtttccctcccttaggcttgcctctgacaccctgtgcatgagcccagcccagtgcttcccaccctagcacactgcaggacatgtcatactcatcatcatcccacccaatttctttctagaattccttctcaccatccaatcctagaaaatacccatctgtcttcaaaaattctgctcaatcatgatctcttccgtaaagccttgaatctgataagaaagcctgaatatgccccgggtgtgatagcccctcccttggctactattctgtaagtgccccgacagcccacagcttctgtgccgcacagagcatggccccaagtcactgtgttcattcaacaaaaagatgaattaatgaatgttttacactccttgcagttccaacaaaatctaccttttccaaaaacagtgtgcttttctttctcaaccctccatgttagttttacacgtgatgtaaactactaactttacacgtggtgaaaactgcacaaaatgtatttatctactacttacgcaaaaatagttgccctcttttcttcaccaatttgatatttttcatggctggtttactgcaacagtatttttgtgctgtaattttccctacagtgagatcagtaataacttctcatccaaagagctatggatgccaaatacataaatatctacaacctcactacactatagaactagatagcaacccagagaaatcaatgtgccaagaatgtgaccacaagagctaagggctattcacagcagaactgtttggaagtacagcttcagttcttcttgctaaaaacgcacaaggagggggttgctttttctaaatctgtttgcactagaggcatgcttagaattagcctctagtatatggttacatcacatttgctcattccatggcaaaaaccttttgttttaaaggtcagaaatgagttttcacaaatctgcttccatctgcattccatgcctgaaaatcattctgtgtgaaatgtcagctgacactgaactcgcctgcaacatagctgaacaccgggtgaggaggcaccggactcacaatttctgatgtcacaggtgaggaattcttgtaccaacaccagaatttaccaccaatgtagccacttaaaagaagagccgaccagctgggtattttgatgaatgttattcttcctcttccacaagtttttaccataatacaaggcttccttctcgctctctctttttttttttttttttgagacagagtctcactctgttgcccaggctgcatgcagtggcgctatctcagctcactgcatcctctgcttcctgggttcaagcaattctcctgcctcagcctcctgagtagctggaactacaggcgagcaccaccacacctggctaatttctatatttttagtagagatggtgtttcaccatgctggccaggctggtctcgaacccctgacctcaagtgatccagctgcctcggcctcccaaagtcctgggattacaagagtgagccaccatgcctggccaccaggcttatttctgacaggaccatggtaataagacaaaaggctaaaaggagaaaagcactcttacgagaaggattttgcttaacctatggtttcagcagggtctacaacatgtctgtacaaatgtatatgactgctggtgctgtatttcagttcagaggatccaatcataattcatatcacagaatattctccatatcccatttacatacacaattctggcatcattatcaatattactaaaaattccaatagtatattaaacaatatcatcttcttttcaaaaaattattcttcctttaggtgacatgtgtggtaaacactttaacatatttttgtcaattattccagaaatttatagaaatattagctagtcagaaggtccataaacttttaaatgttcttgcatataataactgatcaataaccatttgttgacaaatgatagatggatggatgggtggacaagtgcatggatggatggatgtaggctctttggagaaaataaatattaattaaaataagtatcattaaaaataacacagtagcttgcatactgaagtcactcagatattctatgataaataaatcaatgaattaatgaataataatgaatgaatacattaaaatgtcaacttattttctttcaggtgaactaaaaacaattatttcaacattatgctgaaagaaattttgttaatcaagtattttgattcagattttttaaatgcggaaacttaatgtagaaagttcacggaattaactaggatcaaaaagagaactagactttaagtcttctgactttgattaaagtgatattccattagagcacattatttacttctagtaactaaaaagaaaaaacttctgttatgacctactttcagaatgtattataatgagtgaaggaatactgtacaattcattgtagtttctagtcagcagttttattgtgtgactggaatgatggaataattataattgcttacttaggttttggaaacatttccaacctcccagccaatttgtaatttaaagcatcctttagtctcttaagagatggttggttggtcagactttggaggggtaatttcagggtttcatatgggctgtagattggcaggaatttaccacatatatgggcatacacatacacacaacacacactccaaaagttagatggaattcctgatttaattagccaaggattagaaaatgactatcaaaagcaaaatgtccatgctgggcagaattaaatttagctgagcttccctgaccgctggaatccaaaacaaagacacgctaatctaatggatgggatttcttaaccatttataaaattgtactttttcacacacatttaaaaaaataactccatgaataccttaagaatataaatatactccatcttttcatatgttcactaattcaacaaattgtgaaccatgaagtaataccattatgaacatttcttgcttcaggctgagcacggtggctcatgcctgtaatctcagtactttgggaggccaaggtgggcagatcacttgaggtcaagagttctagaccagcctggccaacatggtgaaaccccatctctactaaaaatacaaaaatatagccggttgtggtggtgcatgcctgtaatcccagctactcgggcagctgaggcaggagaattgcttgaacccaggaggcagaggttgcagtgagccaagatcatgcttgcactccagcctgagcaacaagagtgaaattccgtctcacacacacacacacacaaaagatttcttgcttcagttggaagaattacatgaagagaatacaatcatgcctgacttaatgatggggatacgttcatagaaatatgttgttcgatgattttgtccttgcgcaaagatcatagagtgcatttacacaaacctacacatggtagagcctactacacacacaaactatatagtgtatagggtgtaccctattgttcctaggctacacacgtgtacagcatattattgtactgaatattgtaggcaattgtaatacaatggtaactatttgtgtatctaaacatagataaggtataataaaaatatgatattataatcttatgggaccaccatcatatgtggctcatcattaaccataacatcattatgtggcacatgactgtatctccaattttttatttatcatttttaaatttttcattgctgataaaatgtgatgcagtagaaagatcactagattttactatgagatttgttaacccactgcatgacactggcaactctctttaacatctagaaactaatgtgtcccccagtgaggaaaacaggaactgtatttggctctgtactaagtggcactcctggcaaatttaacaattatgtataaaattataaaatcaccattagtctgtattagcttaataattcttaccgatatcttttcattgccatgcataaagaagaatgccatgactcaatattctattgagacatcttaagaaacttcaaaatgaaacaagactaagaaaaataagactttaaaccaagtattgggttcaaagaatatgcaaaatctttgtaaaggtcatttctgttagccaagaaacaattgttgtgtgacttgacttgaactagtatgaattttgctgtatattcttatttggaagacttgactcgaaatagtatgaattatgctgtatatccttatttggaagagatcgacagatagaattccattcaattgtaattgaagctggtgactagaaagaaccaatgttttcgtgggtacacaaatacacatattcatgcacagagaaaaacagcagttgtgcatggtacttgaaattcattttccccaaacaaaaattttatagtgtcctcctttggaattagaagctacagttcaacctgggaagttttctccttttctgatcttccagaaataacagcaacagagacctctataatttttcactttttacaaaatctatttaaaaaaataaagggttgagttttctccagagtagaaaaaaattaaacattctaccaccaccatcatttttcaaataacctactaattttattttcagagtttacttacagtaaaccggaaggaaaaccagaaactaagtggaactgttcttcagtagccccaggcccctgtctctccagactgctcccccaggactgtggccccagaccagctcccagcaggctctgccaaacacttgatcacttacagaccttcataccactctcctttatcccaaattgccctgaacctccatcctcactgacttcatcacgtgtcagaacactgcacactcactttctctccgtctcctccctatctcacactcaccagtatatagtagtcataaacatttcagaattagacaaatttgagttatttgaagaaggttgataagcgcatattttaaataatgattaccaagaattagcatggtttcaccgagaataaattaactattgcaagtcaaaacattcttatttttttgagacagagtctcactttgtcacccaggctggagtgcagtgttgccatctcagctcaccacaaaattcgcctcccaggttcaagcgattcttgtgcctcagcctcccaagtagctgggattacaggtgcacaccaccacactcagctaatttttgtatttttaatacagacaggtttcaccatgttggccaggctggtctcgaactcctgacctcaagtgatctgcctagcctcagcctcccaaagtgctgggattagaggcatgagccaccgtgcctggcttcaaatcattctttaacagagtcttggaaactgactaatgcagcaaacataatagaagtggctttaagtaaattatctcacaaggaccaggtggaaatgttgtcagaagttggtccatagctgcaggatgaatggattaatttcacattagaaggaggtttctacaagactgctggaatcctatggcttcgtttctgcctggctcaacatggtattaatgaaaagaagaatagtagagaaggaaatgtcaaaattacaaataacctgaagctcttggggaaaggtcatatgttgcctattacagtcatactctaagtggttgttggaatcatggcacattttaaatataaaagaaatataaaagaattaaatgttctttccaatacaaataacatataagtctagggtgaggagaaataactgtgggacttaatttatattataaattagtgcctttaaggactacacactaggtattccctgaggttctataaactaaaaataattagttctgtggaaagctagtattagccagtattagtcaatgaaaagaactaagaaaataggatactgtattatcagactatagaagaaaattcaccaattttaagaaaatatattcctgatttgctgtgaaattctttggttgtgggtgaaagttacaagaaaacaggattaaattcaggagaaatagattcagatggtgcaatgcagataaatcatattagaggagaaacgattgaaaaaaatctgaggggtgttaaattttgaaaacacttgggaaatacgcacacacattcttcaaatattagaaagtatagaaattccaagttttacacatgtatgtttaactgaactaagtgaccaacaaacagagaatgataaattatggtacatcaatatttaatgatgtggggaaatgttcacaacataaaatgtagttctgaaaatagcgtatcaagccagagttcaattacaattttgcagctgaatgtgtttataagcacatataggaaaacctataagaaaagatactaaatgataatagtgactcttgctgcagggtagaaatataggtgaatttcattttcttttttactctgttacattttccaaactttacacaatgaacaaatgcttcttttataagttcaaacaacatgagttacaataaaaaatatacttataggcttcctccaaaaagataagaagaaagatcagaagctgtagagagacagatttcagctgaataaacattttaagtttctaaatcaggaaaatgaatgaccttgagaagcaagcaatgcccttgactatgggcattttgataaagactaaatgatgacccaactggtatagcataaagaaaaatcaattaacagatgtttttaactttttcaatccttttaatgcaaagaatctataatcccttaactgcgcaaaccaagattagaaacccaagaatgcaaaagccctgcctctctacatagtttagttaaatatggagatgatgaacagaaaaacatcaggccttcagcaatttagacttaaaagtttagccttttataggtttttcatgtgggcataacttttttcatatgtaattaaggcatgccaccaggtcacagatgccaaataaaataaaaatccctgaagacttaaataagaacttaagaagttatttttaaatgcattggttaaaacaataagactaaaaacttgaagctgcattgagtgtatgggccctacatgtattttcttgctttcgatggttttcaaccatttaatttcagaaatgccttttcatctctttaatactcagtgcctctgaattacatacatttttcttctatttcctatgtactaggaacaggatttaagtcattgcctctcttcctccaactattgctgagaaggcactctattgcatatcctaaaaagacaaaaagattgcattgaggctttgtgaatctgctcagtgacacatgaaactcaggctgactggtactgagatggattcgatgactccagctgaatagccctgggagctggaacccctcagcactcgttaactgaaacgtaaaggaaataatggcaaattgactgtcttgaatcaagtataaaggagaatgcctgaaataattagatgtcatgaatttggaaagagaaacttcttgcagattgcttccttcagataaccttggactcaggagttttgtattgttcacttaacataagtgactatgattgagttataagttctctagggaaagcagcacactgaaatgggttatatcatgagtttagcctggatgaaagtgtttactccgaaattccaagtggcattggtgtggctattggggcagcttgctgtgctgaggagcatggacctgagcgtcagagatttggctcctggtcctgccatacccatcacggcagcaaaagtgactaccccatgggcgctgtgcagccttcttacactttgccatgttagactggcatgccgctcctattttatataaaatgtaactgaatattaacttgcccaagcataaaccaagcccagtttcaggtccagatttgtctcattccaaagtgtttagttaacactctgctaccctttgttagatgtggacaaattacattatttcccctggacttagatttcttaattcgatgacctggaaggccttctctagtagaaatggtccatgagtccttgggaaactgagaactaactctgagctattacctgccatttattctatgtggcccatcatttgctacgcactctcctacttcttcaatgcacctgttccacacccttggaactcacttgctcttataaaccctagtcatttctccatttggagcactgttgctccccttttcgaggtctgaatgtctcccctccaaaattcagatgttgccaatgcgatagtattaagaggtggggcctttaagacatgattaggccacagaagctcctcttttgtggatgagattaaggcccttataaaagaggcttcctgcagcattggattcacttgctttccaccttctgcaacctgaggatacagcattccttccctccagaagacacagcaacaaggcaccaccttggaatcagacagcatccctcatcagacaaccaaacctaccagccctttgatctcagacttccagaactgtgagacataaatttctgtcctgtagaaattgcccaggcttggccagatgcagtggctcacacctgtaatcccagcactttgggaggcagaggcaggcggatcataaggtcaggagttcaagaccagcctgaccaatatggtgaaaccctgtctctactaaaaatacaaaaattagctgggtgcagtgacatgtgcctgtagtcccagctactcgggaggctgaggcaggagaatcactcaaacccgggaggcagaggttgcagtgagccgagatcacaccactgcactccagcctgggcgacacagcaaggctccgtctcaaaaaaaaaaaaaaaaaaattgcccagactcataatctgttatagcagcacagatagacaaagacacccttcgatgattttcctgctgcaacggagctccacttcagtcaatatagaaagcagactttctaaaagtcacgtatatagattcataacccattacatctcttacaattcttatctggtcatccattgcataacattcaataatctgtgttgtttggagcaagttactaacagctctaagcttttgttcctccttataacagggttaagataatcacatggaagaacagatatagatggtaagtcctcagtaaatgtgccttattacttagattgttgttgactctattactgatgttgttatctttacctcctaagaatgctccacttgcatcttctaaaccctttggtgccttcacctatgctggccatttgctctctgatgagtgtccattttctctgtggttctcccaggatgtattcactttttttttttgagatggaatcttgctctgtcacccaggctggagtgcagtagcatgatttcggctcaccacaacctctgcttgccaggttcaagcaattctcctgcctcagcctcccaagtagctagaattacaggcacatgccaccatgcctggctaatttttgtatttttagtagagatggggtttcaccatgttggccaggctggtctcgaactcgtgacctcaagtgatctgcccgccctggcctcccaaaatactgggattacaggcgtgagccaccatgcctggccggactcatctttgaccaccagtcctccctatcctgttctccaacagcccctgtgccagaactgtctagctgctcctacctggtgtagaattaccaaaccgtgtggaaataatgtatctcttgccaaatgcctccatctcttctatcacaattagttttttgaataattaggacaggttcattttcatattcttttctcatcactatgtattatcaagctcagtgtcatatatcccttggccaagtaataagcattctttgattaatgaaaaagaagaagatcaataagtaaccctgtcaaaaattttttcagacaacccaggaataaacacctcagggctaagagtagcattccaggtgggaatcagctcctgaaatgggtcaagatacgaagaaaaacgaaccagagagcacagaggcttatcctcttaactgaatcattaagccaaaacagttccagttgcagtagctgcaggattcaaacaggattgtttacttgaagctctaatttagaagatgaaagcctactgctttgtttctaattacttttcccatttgttttggtgaagtggaggaaaatacttagtaagcatttctgttgccaaatagctgagtaattttctgttgttcagagcctggcatcaccctgcatacctcttggtcattatcacatgatctcctgattattttttgacacaaacagataatctgtgtaatatattacatacgtttcctataatcagccaaatcattattctctgctgcttaaagcaacagaaaaaaatgtattcgtctactccgttcaggagaagataaatgtttcaaatgtttgatgaggatttagagtgataacctagttaaaacctaaagacttgcttgatcatacagtgactgaccagttccagtgcataaaatgactcaatccagagttatctgagagccttgcttataaaacatcattttgtgctatatttccggtatgcaatagaactgacagctcctgtattaattaatggacttaggtgttaaaaagttaaaaataaatgagtaaataacaattattttgaagtcaccatttccaaaacaaatggcttttacttaggaaatagcctaaaacataatgtagaatggtggtttcttctaaatagacatatactacttcatataaaatcttttcccaaaataaaatctttggataatttataacttttctaaaagcacactaatttatttatcattccataatgaaagtaaatatagaaccttcagtttaactcctcaagtatttggtagctgcactaaaccataaggatagctgggttccagctaatactgctagaaggaacagggcctccttcctcataaaggctatgatgagttcctggagtatgtgctgagtgacaataaagagtttgcagggcttaaaatcacataactaagaagggccataaagattttctcataaaacctcttgtaaagagaaggcatgttgctcacagaacatcgtgtatgaagaaggatatctttggatctccattgtggcataaaacattattcttgaagcatttgtcctgacgcagctctggcactcctcagtataaggagaagtaggaggcatatggtggatcttcaagaaccaaacttgaaggagaattacattcttgggtaccttagtatcatcagttctcagacttgtttcttcagtagagatcactgaaacgcttaaagcatagcacctgcttgtcatgttgtaatgggttacttacacatttagtccacacctatttttgtgtgtcccgaaggtactctgtagaatttaacattaaaaaatggaatctgataatgattttattgcggcactattcacaatagcaaagacttggaaccaacccagatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggcggggtgggggagggatagcattgggatatatacctaatgctagatgacgagttaatgggtgcagcacaccagcatggcacatgtatacatatgtaactaacctgcacattgtgcacatgtaccctaaaacttaaagtataataaaaaaaaattactacttattttaactggattgttttgactacataaaaccaaactcaatctatcagcatttgtttcatacctaccacatgcctgacgttgttctaagttctggagaaatgatgagtgagacacaaatctttgaagacaagggtttcaaagaatctggtttggcagaaaaaacatataagcaaatagtcccaagaaatcaggtggatgcagtcctatgatcgaggtaatgcagaggaaaaaactggcacttttcccattctaaagttataagcattccttcttccttttagttgaaaatttgttttaggctagacaatgcatcctctttattttgaagcctgggaaatgggctgttacagtggaaagagtacacacatattggacagagaaacctgctcagaagtctaggcctcgcacttatagtattatgacatcaggtactttgcataaaccccttaagccccagtcttctcatctacaaatagggattccatgagatactatgatacatatagatcacctaaaacaccctaggtcagtcataggtcttgtgcaaccttgaacaaattacttaacatatcatttgtaaataggagtaggatttgctaaatcaggggtggagaatatagagattgctgacattaagcgactgacacatcatgctcaataatttatatctactattagtagtagtatgactttatgcccatccttggatctacatgcatcctttttatttaatgtggtcattcctgaggagtcagggactagacattttgctttgcatgtgggcttcatgctttgacttccagagggacattttggcatgtggtgtagtgttgtgcatgctttgttagaacttcaaagcctggtagttgaatgtccttaccttgcacagaacaatggcctgataagtgctcatttcatgaataagcatcgccttcaggaagctaagcatcccatcagaacaacttcaccagagtcaggatgcttcatgaaagggccaaagttatccctgtttgtgcactcataactctctcctgggacacatgctcattagctacaaagaattgtttcatttaattttaagttattccctgaaacttgtatgtgaatgagacactgtaaagttcacaggctacttctattcctatcacttatatttgatttatgcttgaaaatattcacttgatctcttcatttacaataagctctgattatttccttccaatttatgatggagcatccaagtcttgaggctcatgctgatgacctagcactgtgatctcatcttatccacaatggagagtcactgcgtaggcagaaatggtttcaccaaaggccgggtgtctgtgtggtgcctggatgtggggtgcatgtggcttgggaagaggctcttgaggtgtgaaatagagttgtcgtcttcaaaacacagaaaactaggagtaatactctttgcttggctctttcttgaattttccagagttttcatgagtgccttgacaatgaagtttatatctaatagtgcacaggcatcttccagtgacaattttataaatgaaggtgtattacagagaaaaaaattgtttcttgatatatttaatcttgtatatgtgtgtttaaaaaaactgattacatatatacatattttcaaaaacaatgttttgttggtattattcagtgaaactaagtcctagtggcaaacacaaatttacttttattgagtggggaaaaaaacgccagtaaatctctggtgccttcctgtcatctcacggaggtgcgaggccacagcagtgaccatgggtgccctgcagccgggtggccagacagcgagtctcccatgtaggactactgctcgctcgctgtgtgatcttgggcaggtttttagcgtccctgtgcctcaattttcttgtcaaattgtttctgtctcataggactgttgtgaagatatgtgattaagggaattaatgaggtggaacacgttcagttaatcagcaggagatggtgctattttagtatggaatttcccctcacaccacatttctagaactaactgaaccctagaagaccagggttttgggatttgcccagaaaagtcagtgggacatgttgtggttttcgtccagacacatgtggtttttcgtgcagaagagagagctaactgtcacccccagagccagaaggggatcttaagactgtcgattcaatacaggactggtgcacctttttcagtggacctgagcatgcatggagctgacccattcaatggaccaaactctttgtaagaacacaggaaaacaaggaaagaaggaggtttcttcagatttcataggccaaacacaaaccctcccatccccaagaccccagccccctaacgccaccagtcaccctacggaagtccccataagagaactgctcttcatcgttgttttacctcttatttccacactccacccccaccttgcctatcagtaccaatcccggaattgtttgtgcatttctctctgaactttctctcccacttctggtcccacagaatcaaaaatgggtatctggctccctggtatgtattcattcttgaggttccctagaggagtctacatgcatcctctggctttcctgggcaagggccctggggccctcagcccacatgctgctgcagatctgggggtaaacagggctgcagagtcacccagggcctggcatgtgtcccaagccctgctgccctctcctcccaccctgtctcaggaaatgtccagcatatggccacggacaacaatattgttatgaggttgtgacattaattgaaaagaacactagcattttcaaaataatccaacttgtaaattgaagccatagctttactgcagttttgaagcatttttttccacatatgtgcgatgccatatttgtagcacatggtctgcacacagcacccactgggactccacctctcagtgggcaccatgtttccactgggcatgagtacactcaacattcttgattatgagatctgtataaatctatcatacaaatgacagcagataggctaagatcatatttaagatatatttcataatgtactagtatacgctcattgtaaaaatatttaaaaatatgaaaagctataaagcagaaaagtacgtagaatcataccattcagagataactgcaagaggaaagtgatttttacattccaatgctaaaaaaattttagcaaattatgttatataaatgctatggtttaaaaaaacagctattatatcttgaacattacaaagaccataaaatgatctgcatggaatattttaaatatgatcttacatgctcagaaagagttttatagaaaaaaattccagccagggaatttttatttgaaaggactgccaaaacagttggcattttctggatatgtttgctactgtgggctactgtctaccattgcactgttcaaatattaaaaaccaaaagagaataggcaatgacaccaagaatcttacagcatgtcttttgcctcatctcctcctgcgagtgctgaggaactctttgaagggggtgaggggcccttgtaattggtacggtgtccacatgcctggagaatgagcagctctacgtatgcattcagggccctctgttcacacacagctctgtccttaatctgtttgctgctgaatgactgggctgcacatctgcgacagcctcatgccacttattctcccctaacctacctcctcttcagctgcagtcaagcttgcctttgttaacccaaatagtctgttttcttagaaatgtgtataatgttgtttattgctttttcagtaagaagctcagagacaaagtagagaaacaaatgatacagatatgaccatacgagagagagagaaagttgtatgatttgactaaagcagtggttctcaatccagaggttatcagcatttcccgaagggcttgttaagaagggattgctgggccccaccctagaggttgaagaagtagtagtgctggagtgggaggctgggaatttccagttctaacaagttcccaggtgctgccaatcctacaattaaggaacgaccagagcgctaatatctcttcgagatcctgatttcaatcatttttgataaatattcagaagtggaatttttggatcatatggtagttatatttttaattttctgaggaatctccatactgttttccatggtggctgcaccattttgcattcctaccaacagtgtacaagggttccaatttctccacatccttactaacaccaattgtctttcatatatatatatatatatatatatatatatatatatgcctattagaaatgcacatcaaagccacagtgaggtatcacctcaccccaactgatacctcatttggtatcaattgaggcgatacctcactgtggctttgatttgcatctccctaatgattagtgacattaagcgatttttcatctgcctgttggctatttgtatgtcttctttggagaaatgattcaagtctttagcctattttaaaaatcagatttttgcttctttttgctactgagttatagaatctccttatatattttggaaaataatcctttacctaatattggggagaggggaatggggaattagtaagaagcagacataaagtctcaattatgcaagagggaagagatccagagatctgctgtacaacattgcccctggaattagcaatgtggtattctacacttaaaattttgttcataagtaagatcctggaccaaagaagctcccctaagaggtggttttttcttgtcttctcctctaagctcctctaaattccctgaacaaaaaagcctcttgatagaacatgctttcaggctgtcctgagttttagcaggactataagaaaagaggcagagattccaaggcatgcgagactgatgtgtaggcaaacagctccagtgtagcaaggaggaaggcagaaagcacaatcagatttcaaggttcactttcctcttccccttcgaatatattgttcttaccttaagtgttccaaaatggattttctgcccctttccctcccacccacttacatgtcaaaacctccagattgaataaaataatgtataaaagaaaattacacttgacaaatgggccagtttaaattagcagttcagaatcactacaatatgacaccaatatctatgctatgtgttcccacctagagggcagtaaatcaaagctgcgtttggttttatggctgctagcacatgcatccacatgcttataaagtatctataatgatttctaacaggaaaggagcagtcattgtgtccagttcacagatctcacataatctctttgcaactgatccactgtcaaggccaaagcaaaagttaagactaggatttaccaggtctgattaagtattccatcgtcaccatgaacatgtgtcccagcgcaaagtagtctggatgcttctagacagtgtaaaaggcattaattccaggatagcccccaagattcccatatcctcaactttcaaaatttcccagcagacattaatcgatgtggaaaacctgtgcataatgatctaagcccagaacccaactccattttacacactgcatatgcttgtataattctcttccattcagtgtgggcagagcctatgggatgtcactgtgtgattatactgttacatgcaaaaggaattttggagatatgattaaggttactaatcagttgactttgacttaataaatgggagtttattcaggtgggcctgacttaattacatgagctctttaaatctgggtccagaggtcagaggaaaagtcagtgattggaagcaacagacattctcttgctggtcttgaaggagcaaatggacattttgtggagaaagccacatggaagagagcagtgggcagtcacgaagagctaagaatggtccccagatgacagccaggaaacaggacctcagccctatgactacaaggaagttaattttgccaacagcctgcgtggcctgcaaagaaccccagcctcagatgagacagcagtccaagctgacacaatctcagctatgggagaccctgagcaagaacctagccatgggatgcccagacagctgactggcaaactgggaactaataaatggatattgtaggcaggcactcagtgttactcagcaatagaaaacaaattcagacaatttctgtttgtttttgtcattggcacaaaccaatgtgtctcactgtgctgcttttattctcttcccttcctattctgattataggtatcaccacactctgacaactctactagaaacctcgtgtagaatgcaggtgagttctgggctcagatcattatgcacagtttttcacctagattaatgtctgctgggaaattttgaaagttgaggacatgggaaagttctttacaaattaggtctgccccacataatacaggttgtctaacaggccatgccttcattcttcaaatgccagttcatgttccccaattactatggcaaccaaaatcatagccctacatttggcaaagccctcacgagtaaagccatctccccaaaaaccactaatttagccccatatagctgggctctcctagtctcaccgctgcctacttagcctctctgggaactctgctgtcacttattctctgggtcagggctaatatcattttctccactctgaattcttctctatcctcttcaattttaaccctttctttgtttacctacatacacacatacatacatatacacataggcattgtggtgtttaaaacaaaattggcttcaaagcactcatcaaatctgccttcctcttgaagtctcagaacctcatctcccttattcatacacactaatgaacatgttgtctcccaacttcttgaatccattttttacttttattgctatattatttatcaagaatattggcatattgttatgtttttgtgttatctgttacgttttccattacatttttaaaggtgtacccacagcaacaaatatttaatgaattaatgagtattacataaggagtataagtaataagtaacatgatatattttagcatcgatttagatattcaaatttcagaagttcttcccattgagtaaattcaaatactcttgccacactctgagatggaatgcttaaagattaacatcctctgccactaatattctcattctttctaatgagccatagggaagtatgtgtaatctctgtcctcagttcttcttcccaatgggatgaggaggagatcagtctgggaaacagattcactttcgagccaagtacactatgaagttgtttttaaacagtcctctagaactctcttggtaatgtgataacagcccaaagcaatggcttggcatgtccatgtccctggagataatgtaatataagaaaccacagccatgctttcttcccagcctggaatgattcatagtggccatgagccggtacttggagtaacagaagcatggaagcctctgctgccccactgcctcatacaatgaaatagaaatcagcaaaatagcagtaattgctagtggttctcctcctgttccccaatcgggggggcaaggtctctaatttaataagtcctacttgactagcaggctcccagaccagtatttgcagcactcattgagcaggatgcctggagacaacagtagtttttataatcgtgttgctttatatgcatgagaattaacctagaattaatggaaaaaagttaaatcctcaactcatctgaaatatcaaaatcttttccaaatagataagaagttaaatctaactcaaaaaaatcaaatagtaaaaatataagatttgaatgatgaaatattttgtgggcataaaaaatgaaacaagtgacaaatgattacttcaaaagatatgtataactttaaaaatgtaatacctcacaataaaaaataaaaagcaaaaggcaaacaatctaagaaatgactattataaattagaaagggttaatagtcttattattttgccttttacaaataaataaggaaaacatcaaaaactccagtagaaactttgataaagattaataaagggacatttttcagtaaaataaatagaaattaattttagacttaagaaaattgtcattcttattaataaccaaaggaatgcaaatacaatttctcatcttgtgataagatgtgatatgacatggtaaaagtttaaataataatattaaagagtcttaggaagtagtaactacaaaacaaaatatatacgtttctacttaatataggttaaatagtcagcggtagcaagaatgtagcaaaaccaaacactcctgctatgaaaacagaaattgtcaaccacccttctctaaagaaatttgtcattatattttaggagtctcaatatgtcagatgctttagtctaacaattgcatttctagaaatatgaaaaataacaagatatggtaaaaatgttgatgatacaatgtttaaaaattatgtctatagtcattatctcaactgtattatatacggtatatagctagaagtaaacctagcagaaagtgttaattataaccacttccaatttgtaaaaatgagtgttgcttcttttctaagttttctatgtgagaatgtaaataattttattattagaagatcacaaaagacctactgaatggaattagaaaagtcacatgactgattccacttgacccaacagttttattgggttctttctgtgtggcaggccaagtgtaatcaccagagattgaagttcttgtgttcatggaactcatcgtccaatgcaggagactgataatttttaaaaatagttattgtaataaagtatgacaagagtgataatgagaatggagctgtcctagtgaagaagccaaagacattccatgggagtggagggaaagtcaggcctcagtcaccaaagctgtatgtaatgagtgaaccatggcccatgtgccaaatatagcctgaataacttcactttagagccctcagcatatttccagcatgaaggattagaaagctgtgaatgtgttgccatttttaaaatagcacagattttgacatttcaatttctatacaattccaatgatctcaatgatattcttctgctcagtgaagtaggaaatgtagattacaagaaaatatagatttcctagagcaagagaaaatcatttacctttggcaagaaaaaatcgtgatcagtaaacattttttccttacatgtcttaatatgacaaatcttgctacacagccactgcggcagatcagtatgaccagaggcaatgccactgggtgaggggaggggagccagtggcatgggtgcaggaagaccggagtcagaagcatgtcagcctcatagtcaggcaaagagactgtgaccttatctttcaagtatctagtattcatttaagaatttttaaaaaaagaataaaataatctgatttgtgttttagaaagggcattctgttggctgaggaatttacaagaaccacacacagaacacactgcagaacagaaagtgaggtcaaagcaacacattaacaatttatggaggcaggtctgggttcaatgataagaaagttgaacaaacacaatttggtgaccctgtggactgcggccagttggaggaagagggcagaatcttgggtgatcctgagttttctgacacaggtgacagcaacaacatccaatggtaacatttaatttttattagcccctctatcctaacctctaatgcttgcagttcccatcctgatggcatggtgccacaaccatatctgtacagtcactactctttaaggagaaatcaagcactagccaatctgaagacagaaaatcaacctgaggggaacagatgtttccaaaataaaggagggcatgcatattttttaaaagaataatctaactacaaaagctaacttcattattactgcaagaaagccaggtggattagatctccaggaacagcaccatctttatccttgagcagaaatcctcgtaacccaccaagtttcagggccttgctttacattgctgtaaatgaggaagttcagacatctcttggctggatgggccccagcacgtctcccttgccacgccattaggaatcgggaatcggcctttcagacactcctggctgggaatcacccaacaggcgcactcctggggctgcctgtatggggcccatctgttcaaacagcaggttgccagcccacaagtctcttggagcccagccacaggtcaaggatgaagccacacagagtcttcttgggcatctattgaagtgtgggagctgctctgcagcaggaggatcatctgcccaagcaaccatgctgtcagcttcttcatgatttctttcagctctctgcactcagctccaacttatgggccatctcagacatccagatttttttttttttttgcttcattttggggattaatatgtaaatctactgcagaacgtctttaaatatttatgacctgcatttcacaacctctctattgatcaaaccaacgcagggcaaatctttctatcctcttttgactcattagtttactttgcttggggaagtggttggttatctcttccacatgtgtaccagttagtcttatgggtgatgccccaagtaatgatatattaagaggctattatccgactcttttttttttccctaataaggtaactgctcccttaatttcccaccccagtgcgccctatgctgaaggaagagaagacagaccatgagtatatttacgagaaaaccaaaacaacagggaagtttctggaaagttatgtcctagcaactttgattccggtaatataaggaaataacatagagaggagcatggttctaagaaaacaggatttagccattctgagaagaatgacgttccactgaggcacagtgtgggccgtcactcaactagcacagatttagcttttaacatctctgataaatacgagccttcggcacaggttcactgccacagggatgtctcctcgaggttcacaggctgcatattcaatttcctgccaaacagctagtggagaaagtctaataaagactatatcagactctgtgaagtagtaaagaaatactaaagaaagtcatgtcctcctaacctctctgataataaaaccgagctttttatattttccttcgtgcaaagaccaaaccaacacaactgcgtttggattgtcaatggctgatgagctaatctcatatgtggaaaaaagtactgtttttctttttttgttgttattattattatactttaagttttagggtacatgtgcacaatgtgcaggttagttacatatgtatacatgtgccatgttggtgtgctgcacccattaacttgtcatttagcattaggtatatctcctaatgctatccctcccccttccccacaccctacaacagtccccagagtgtgatgttccccttcctgtgtccaagtgttctcattgttcaattccatctgtgagtgagaacatgtggtgtttggttttttgtccttgcgatagtttactgagaatgatgatttccaatttcatccatgtccctacaaaggacatgaactcatcatttgttatggctgcatagtattccatggtgtatatgtgccacattttcttaatccagtctatcattgttggacatttgggttggttccaagtctttgctattgtgaatactgccgcaataaacatatgtgtccatgtgtcgttatagcagtatgatttatagtcctttgggtatatacccagtaatgggatggctgggtcaaatggtatttctagttctagatccctgaggaatcgccacactgacttccacaatggttgaactagtttacagtcccacccacagtgtaaaagtgttcctatttctccacatcctctctagcacctgttgtttcctgactttttaatgatcgccattctaactgctgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgttctttcttgtaaatttgtttgagttcattgtagattctggatattagccctttgtcagatgagcaggttgcaaaagttttctcccattttttaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttgttctagggtttttatggttttaggtctaacatttaagtctttaatccatcttgaattaatttttgtataaggtgtaaggaagggatccactttcagctttctgcctatggctagccagttttcccagcaccatttattaaatagggaatcttttcccctttgcttgtttttttcaggtttgtcaaagatcagatagttgtagacatgcggcgttatactgtttttctaaaaaacatggctattaactagagacaaacatttacaagtaagtttgacttaagaaagttaatttaaaatgaaaaaaaaaacacctaaatataaaataaagtttaaagttgaacaaaaccttctaaggaaggtcatgaaaagtcattaagacaaaggcacaactaattaatagtaccactaaacaatgccaagacaatccctctttcttcccttcttttctttcttccatgatgcatacttctaaaagcactaccttatgaacgtttttaccatatcttgttatttttcagaacacttatcctcagccccggccagcagagggaggaaggcaaatgtgtgattctgtacatccatagaggaagtttcaaaggttgcatttcaaatccccaccatcttaggtgatctaactaagcagtctcttattaattcaggtctccattgaatttataacctaaatttgaattgttcataggtagaaccaatacaaccataagcatctgaggcaaaagtagactcgtgctgttgcaagtagcagcaagggcccctgattaaggtctgtaatataagccatccctctccatcccctctttacctaggccaccctgtaaaagacaactagccttaaaagcagagtctgagactttttattattcaattctttctgtcaacgtgtgctatattacaaaactacaaggatctgactgatgagcataaaacaatatccaataccaattagatttgctaattatcattggttctcaaaaatctctttccaagaaacacaaaaagaagtccagagaaagacaactattaaattatttgaatattaaattatttgaatattaaatcatttaaaatattttttagtcagtatccacatgggaatttggagtggtaaatgtagtaagttcaaggggaataaaggaaacagaaaaattaagttttacatgaggaaagtccatgaaagtataacacattttctttgccttttttacaaaaacccctcaaacaagtctttgaaaatttagaaataaatcaaaaggtcaaagaaatgagaggttatgggtgggggccaaatttcactggagaataacccaagagaaaatcaaggaagaagtcattgaagtcaggaaggggagctgcttccagatggacatatcttcccatgccaacaccgtaattctaaggcttcaagtcaaaatggactaatttcttaactatgattaaaccatagctcactaggtgtggtacaccacagtctaaaatgtgacttctcccactgaaaatactctttgctttaacaaacaagtaaaagttctcatcttccccatggaaaacatgccctagcagagttacgtaagttcctgtctcaactgttccaaattgaaacacaaaaattacacaaaatacaatagttaaatacattttacagattatatctatatttaggctcacatcagaagtcacaattttatagcttcaatcattattcttgctggaaaatttgaaatttattttcaggcagatcctccagacttaaacataatctatgtcttcaaagagatcagagcctctatctgtccaaagaatattactcagtgatcctaatacactcaaaataactgaaattgtttagtcaattctaacataaaaagaaataccatgaaagttgcagacaataagaaaatcttttccctttagtacaggagggcagcacaaaagagtaaacagtccaatttgttcaaaacacaaagcaagcttagtgtggtaaagaatgtactgaagatttgtatctaagctctaaatcactgctaccagtgtatgctgtcattacattaggatcagtagcaatacaaggtatttatttcatgagaaacactaggtttatgctctacattatttatcctcattttacacatgagcacagactgagtttaagtttcttgcacaacataaactgttcaatctttcaaatttgaaacatggccaggcacgatggctcacacctgtaatcccaacactctgggaggcggaagtgagcagatcactgagcccaggagtttgagaccagcctgggcaacatggcaaaaccccctcccttctaaaaatacaattagccaggcatggtggtgtgcgcctgtggtcccagctacttgggaggctgaggtgaaaggatcaattgagcaagggaggcagaagttgcagtgagccaagctcacgccactgcactccgccctgggtgacagagcaagaccctgtctcaaaaacaacaataatagtaacaaaaaggaatttgaaaccagctctactatctctttgattcaggcttttaatacatagactataaatgacacaaaacatctttcattgttgataggtatgtgatcaaagcatatgttgttttgaggaaatctctagaaaccacaattttatcttaatgaagatgataatatattcaaagtcaccaaatcacacttctgtttttcaagtaatattccaaagcatcactctttttggggaaacagccactttcttcttatcaccttccacccaccaatgggaggcaacatgtgttagcctagtatcctgcggaaaaatgcttcaccatgggaggccgaggtgggcggatcacttgaggtcaggagttggagaccaactttgccaaaatggtgaaaccctgtttctgctaaacaaaatacaaaaattagctgggggtggtggtgtgtgtgcttgtaatcccagccacttggaaggctgaggctggggaatcacttgaatccaggaggcggaggttgcactgagccaagatggtgctactgccctccggcctgagcaatagagcgagactccgtctcaaacaaacaaaaaaaaaaagggtttcactaataactctgtgacacaactgagggatcactcacattcaagcctcgcagatatgttaaatagaccaacaggaacttaggtgcccacgttctcacatttacagtaacccttcatcaaagagagctgctgatgccttaaatcttgattcgtatattgtctgacactaaaagaaccacgtgactcccaaactaatctctagtatctaggcattgtcaatcatgcaagagcaatgaattctaagcaaagtcatctggggtttttccctggcttttctattagcaagctgtgtgatctcaaacaaagcattaacctctctattctccagcttttccatttgtaacataacaaggcaagattagacttaactttatttaaagttaaacaaacagacaatgagctgtaaggtagacattaggaccatctgagtgtactttctagaataaaattttatgaaatctacatacatccaaatcttatgatgttttatggtacattgcatttaaagtatattgttaatgtttaagctctgagacttctattgtctttttctggctacagagaagttgaaaccaataaaccatacatcgtgattctatctgagtgggttcagagcctctctgaaggctgggccaataggtgaggccatgtgcataactatgtttattagaaatgaaaggatggatgctaagggctggataccttcagaggctgtgtcagcagaacctgtgctgctgtctgtacctgctgtgtttctgtggtttgttctgactgtaacagcacttttatttaatcatagttccctttacttcccactaccccacttaatcaatatagttttttgcttaagaatgaaagaaaaggtgaaaataaatgaattatcatttcctatcagtagtcatgcttagtttctcatttaataggggttacgtttaccttcagcagaggatttttgcaagaatgaactgttatcacctattaaagcacttagcacagaattggcacatattaggttcccatcttatcattattattaccaattatatcagggagacagatcagagcagtaaattccagtgctacaacacacacacgcacacacgcacgcacgcatacttcttgtgtttggtgtcattatgttttggtcttggtgtcataatgattatttaacaaattcgttgggtgagtgagacctcagagacaacaatccatagcacagggcaccccagcatgctcattaactgttccctccccaagtgaaaatggcagccatttgtatgaggcagtatggttcccctcacttgcacattaaatgattcaacttgttcgttattttaagaaaacatgagctttcttctgctagaaaagctaagatgactctgaaagcaagtgaatgtgagagctgagaagcttcaagaactgagtgcctggggactctgataattggaaggttatttgatctctaactccatgctccctcgactattactgagtatccttcacaggctagtggtttggacaaccagcttttgcagtttcctcggggaacagaacagggctgacacaaagaagtacatttagaggtgaataaaatttcagctcccaatttcctaaaatactgcacaaaggtacaaattcaggcctgacattgtctgaaacaaatgtcatgcatttcatttcaccctgatctactttagttcttggccttgtacacttgatacagcaatgaaaatagcactggtttcatcttaggcaacaaagagaccctggctgctgtggacttaattgtgtccccctaaaattcttatgttgaagccctaaacccccatctgactgcattagagacagggccttcagggaggtaattaaggttaatcgaagtcataatggtggagccctgatccaaggaactattgccgttataagaagaggaagaggcccagatctcttgctctgccatgtgaggacacaaagagaaggcggccgtctgcaagccaagaagattctcactatgctggcaccctaatctcaaactcccagcctccagaacggtgagaaataaattttggtcatttaatccaccaagtctgtggtctttgttatggcagccctcgctgactaaaacactgattcaactgggaggatcttctgggcagagcaggatgtaggaacctgctccccgctagacacaactcaaggcccatgactttctctgtgccgacaggaaacacacagatccattcacaggcatacgcacatccacacacatccacacacaggtccacacacatccacacacacaggtccacacacatccacacacaggttcacacacatccacacacaggtccacacacatacccacccacacataggtcttcacaggtccacacacatacccacccacacataggtcttcacacacacacacacacacacacacacacacacaggtcctgacacacacacaggtccacacacatgtgcacacacacattctactctgcaacagcctttgctgattatattgttgctgtttcaaagcagaaaccaataaacactaatagatgcatctctcaggaaagttataggtgaagaaagctttttagattttcacttaaacatggagaaataggccaggcacagtggctcacacctgtaatcccaacactttgggaggccgaggtggcaggatcacttgaggtcaggagttcgagaccagcctggccaacatgttgaaaccccatgtctactaaaaatacaaaacttagccgagcgtggtggcgggcgcctgtaattccagctacttaggaggctgaggtaggagaatcacttgaacctgggaggcagaggttgcagtgagccaagatcgtgccactgcattccagcctgggcgacagagcaagactctgtttttgcggggtgggggtgggttgtgaggggaagaaatatactaaataaggaaatagcaaaggtaattatttttattttcaaaagattcactgggtttattggcttacatatatttaatacaagcatatatagtgtgacaggtccccacagggttacttaaggatgtatgtccaatgcctgaaccctgcaggccaggcagtgagccaaggccacagttcccagtcaaggagtagatgtccctgagagctcaaacatcttggagagtatctgagaacctaccaaggaaaacagtgtcttcacacacacatattaagcaaagagccagaaaattagattaaaagtagcttagagacaggggtgatgcaggtccctagagcatccctgcaccatccaggagtgccctgtctgtaagtcttaataaactcatctattcatcaagctgaacttgtctgagtcattctttggtctcttggctccttcctagtttcaagggagacattacagtcccaagtttttctcataacagcatagtttggagatattgtgggttccattccaggccaactcaataaagcaagtatcacaataaaatgagttaaatgaattttttggttttcctgtacaaacatgttacgtttagactatactatggtcttttaagtgtgcaatagcactgtgactttaaaaagtacttaagtaaaacatactttactgctaaaacgtgctaatgaccatctgagccctcagcaagttcacaataaattttgctggtggagagttttgcctcagtgttgatggctgctgactgatcagggtggtagttgctgaaagcttaggtagctgtaacgattcctcaaaataattcaataatgaagtttggtgcattgattgactctttcatgaagaatttctctgtatcatgcaatgctgtcagatagtattttacctacagtagaacttccttcagaattggagtaaattctctcaatctttgctactgccttatcaactaagttgacgtaatattctaaattgctttgttttcatttcaacaatgttcacagcatcttcactgacagcagattccatctcaaagaagccactttttttgctcatccataagaagcaagtcctcatccattcatgtttgatcatgagattgcagcaatttagtcacatcctcaggctccacttctaattttagttctcttgctatttttaccacatctgcagttatttcttccactgaagtcttgaagccctcaaagtcatccatgaaagttggaatcgacttcttccaaactcctgttaatgttgatatttttattataccttctctcatggatcacgcctgttcttaacattatctaaaatggtaaatcctttccagaaacctttcaatttacttttcccaggtccctcagaggaatcattgtctatggcagctatacacttaagaaatgtatttctgaaattataagacttgaaagtcaaaattactccttgatccatatgctgcaaagcaaatattgtattagcaagcatgaaaccattaatctccttgtacatctccatcagagctcttgggtgaccaggtgcttatcaatgagtggtaatattttgaaaggaatctttttttctgggcagtaggtctcagcagtgggctttaaatactcactaaaccttgcggtaaagaaatgtgctgtcatccaggctttgttgttccacttctagagcacaggcagagtacatttaacataattcttgaggactctaggatcttcagaatggtaaaagagatgtggcttcaacttaaagtcaccactgcattagcccctaacaagagagtcaatctgtccttcgaagatttgaaggcaggcattgacttctcctctctatctatgaaagtcctagatggtattttcttccagtagaaatctggaaccaccttcatcaattatcttagctggatcttctggataactcgatgctaagcacttgcacttttatgttatagagatggctttttctcttcaacctcatgaaccaatctctactagcttcaaattttcttctctagctttctcaaatctcccagccttcatagaattgaagagagagggtgtgggccttactctgtgttaggctttggcttaagggaatgttgtggctgatttgctcttctatgcagatttctgcaactttcttcatattagcaataaggctgtttcgcttattcatgtgttcactggagtagcacttttagtttccttcaagaacttttcctttgcattcacaacttggctgttcggcacaagaggcctagctttcagcctatctcagctttccacatgccttcctcactaagcataatcatttctagcttttaatttaaggtgagagacatgcaactcttcctttcacttgagcacttatgggccattgtagggttattaattggcctaatttcaatatcatgtcttaaggaataggaaggcctgagaagagggaaacaaattaggtaacaaatagctggtcaagtagtaagaacacacaggacatttgtcagttaagttcaccatcctatatggacatggttcgtagcaccctaaaacaactacaatagccgcatcaaagaccactgaccacagaccaccatgacaaatatgataataatgaaaaggtttgaaatattgtgagaattaccaaattgtgagactgagacaggaagtgagcacatgctgttaagaaaacagagccaacagacttgctggaggcagggtagtgacaaaccttcaacttgtaaaaaatgcaatcgtctgtgaaatgcaataaagtgaagtgcaataaaacaaggtatgcctgcatacacacacacacacacacacacacacaccatcacacacatatacacagatgcatacagacacatatacatacccacacatatacactcaaacacacacacacacacatatatacatacatacacatgtacacatgtatacacacatacaaaaataaatacacacatatacacacacatacatacacccacaagtatatgcacatgtatagacacatacacacagagatataaatacacacacacaaacatatgcacacccatatgcacacacatacatatatacacacatatatctacacacacatgcatacacacatatacatatatacacacatataaacataacatatatacacagacacacacaaatacacaaacatacatacatacacatttacatatatacccatatacacacatatacacacatacagacacaaatacatgtgcacacacatacacacacaagtatatgcacatgtatacacacatataaacatacataaacacacacatgcatacacatacacacagacacacatagacatatatacacataaatacacatacacttatacatactcatacgcacacacatatacacacatacacacatataaacacatacacacaaatgcatatacacacatatgcacacatacacacatatacacatacactcacaaatatatacacatatacacacactcatatacatacacaatatactcctatacatacacaatatactcatatacatacacaatatacacacatatacagacacatacacacatacacaaattcatatacacacatatacatacagacacagagatgcacacacagatacacacacatatacacacagagagaaattctaatacaatactatccaggtttcttatagaaagcttcctaacattgaacattgtcttttttttctcaaaattgtatgattacaagtacattcaggataccagtttctacattagatgataaattgtatgaattattattagcaattcagttgctagcatttaccatttttgccttcatattttttcaataatattatatgtatattacaggtgaaaataaaaactgatggatgcaggcgaatttcaaacagtgagtcactggcctccttcacccaacctgcattatatacttctctttcaattcaataggtcttcagatattgttttgaataatttgcagtgactatcacttcaatacagatttaatgcattattcaattataatcattttctccttgccatagaggagggtgagttagaaattccagggcttagctttcaggccaaaaaattacagaactgttcttccattctactttgcctatactaagtgatcctcttggttttgagccttggtagctaattaaagcaattagcatcatctctgcagtcatatatttcacactgcattccacattgctgtaattaaatcgattaccaaaacaattgatttacattagtgagaattctcttttccattataaatttttctaattcttgcaaaacaaattttatctctgacagtctgattgcttttcaataaagggaagttgagatactcaactatatcttgatttaaaagcaaggacaagatttttcagacattttcgaaatgcagtctctttgtttagaaccaagtccagtggttcttggatgggaaatcttgaagccagtggttctcagctcagactgcccatgaaattcacccaagtgaatttttaaactcctgaagcctgagccccatcccagccattaatcaacttattttttgttacaacactgaaagtgaaaacactgtattaattaaaaattacttatttaaatatgtttacaatactagaaaaataaatgttttccatccaggctcacttttgaaacaacttattctggtttttattttttcccaatttttcaaatacagaatggtcaatttgcataatgtatctgataaatattgcagaggcacaccctgttattttatccatttgtcttctatagtaagctggatgaagaaagactgacttttagactgacttcagaatgacttgtttgctagttggcatcgactctgctacttccgtaagtgatggaatgctggaactgagagctgaagtggaaacgtgactcttccacatcagagccctgggaaatttagggtaagaattgaatgagaatagaggtaaaggtttcagtaataaactctggcaatatggtagagggaaaaacttattttaaatccaagtacatagccatgcgaacaaaccttgcagttttcactagaacttgcaggtcagaatcaactaacacgctccctttttccaacaatcctgttcgaaagattctagcatagttattagggtgtgaatttcgatcctgctttttattaactgtgggacattgacaaggtacttaagcggggtgcctcaatctccccatctatcacatggatgtaataacagtacctatggcattccactgataggaagattaaataacatcaccgacttcaagaatcaatgtgaattgttatcatgttcccagaactgtacttagagcatcagaatttggtctaagtacatcaatggcccccacttgatcagttgttgtcaaatgtatccaatcaatccagaaatatattgaaacgcagaaacaaaagaaaacttccggggtctgttttctatttcaacataatctatttggccacaaagagggattctggaatctgaaaacttgggtagattccacatttttcattatctcatttttatcatcacgtttcctctatattcagaataatctttttcagtgacaatctttttctacactttacattcactaatgctatctgaactctttattaatcagctaatgttgaatgtgcatacagtaccaggtatactgtgtgcaaagctgctgaacccatgacattttgccattaatcttttagttttcagggaacttcttttaattttctgtgctatctaagtaatttaaattgaatacattaatcaaatttttcattctacacaggagtaatttaacagtagagcacagattcttcaatttgaggctcttttcataccaaaaaaaaaaaagatagtggcatttcttattaacatctgtgcacagaatgcagccaaagaaaacatttcaaaatatttccccaacaattacatgttatttatggggaattgatcattaatttgtctgttaattttattgcatttttcatataaaccagtacaatcgtatctttgccaacaatctcaggatttgatttgtttttgtttttgtttctctaccttttatttgccatcttgcaaactattaatgtcaactttaacccaaagcttctcaaaatgtggtcactagaatacctgcatctggtatgcttgataaaaacactagaatccagacccagcctcgctgagccaccctatcagaaactgtggccagcaagtactgcctagtcctgcgagtaacttcttgtgtccactcataatcaatccctgtaggattttctatttaatttaatgtgttcatacattttaaagaataagcaatttaaatgcagcatgattaaaaatccttttgtaaatttgagttgcatagtttttcacgccaaaatcttttcttggacaattaatttagaatgtttgcctttatttcttctaatgttttccagagcaaagcagtataaaattatgttagtatttttattttatctgtgttttagttgggaaaaaaactattatcacaagtctttccgacttggcaaatcccaaaaccaacgtactacaaatatgcatgtactcatggcattgcctataaaatagagaactaccaagaacattgaagtcccatgtatgtgcccctttctggtctcatgctcccatagagatgcaatcactaacctacacttttctctttgtcccttcctggattttctttcaatttaccatataaatgtgtacccacagacaatatatatttaagttttatatgttttaagcactatataatgtgggatcatatgcatatattttgcaaattgcttttttaactgatgttttcaggagtcatttatgtggatgtgtgtagtagcagttcatttattttttactgctgtatagtatttcattttgtgagtataccatagtctgtgcattcaactattcgaagatatttgggttgctaagagttacttgctgttacaaagatgtcattagtagtcttgttcatatttcctagtgtctgtgtgcaagaatgtatctaagttatgtacctggaaattaaattacctgccctaagttatgcatatattccactttactagttaagaacaaattgtttccctgagtgtttgtatcagttcagactcccatcagcagtgtataacacttctcattgctccacatggatgaccacacttggggtactcaaactttaattttagccaatgtggaggatgtgaaatataccttattgctgttgcaaccaacttgcaacctctgatttctaatgaggttaagcattttttggtggtttattggacatgaatgtgatcacttacataaaatgccttttgtattgtagtttcccttctactcttttttcattcttattgatttctaggactgtgtatattctagatcttaatcattagtctgatgtatgtaatatatatacattttctttattggaccttagtaaacagcacctacacataaacactttatactaaattctcttctcagggatactggagccattcaagtaatgtgaattcatgccccaacactgtgggctggcttatggttaggatttctcagaaaaaaaataaataaatggtttccgttttttcacttggtgataagactgagaccagaaagaatttgtactgcccgctggatcatcctttgactgaagctttgattctcaggcatggggggtctccacataactgaagggggccctgggccaccagggaagtgacccaccctctaggagacctctgccccaggactcagtcacttctctatgtccgggctctctcttcaccttaacatttgagaatagccctcattttttctcatgtctactgtaaaattaaaggaaagctcttgctacacgtcttgtactggaagagctccttaggttacttggtctggcatattgctaataaaacatccaagaaattaaattaaggactaatgctacagggacaataacatggttcatagtgacaataagcttcatgggaagctcatggtcatctaaacagtacttgtactggctaactctgagggagaagaaggagaaagagtaggagaaagagaaggtgataatttctctatcagaaagcgcatattacttaaacaagataaattaatgcggtgagataatgtgtgtaagaaataatattttctggattaggaattccttgttttacttagatttgtagtacatttaaaataaaggagtgagcgtgtttattctctcagtcaattgatttccttctttaatgtcagctacagcattcagcttctggcaaagacagaccaaatagttcagacaaaccctcctggtgaaaacactgtgtgtgtgtgtgtgtgtgtgtgtgcgcgcgcgcgcgcgcgcgcgtgcatgcacatgtgtgcagattcttacatgcacaaagatattcataatttacatttatttaaattgcatttccagacaaagtggaaagaataagttagaagcagtatttaaaagataatggctgagaattttccaaaactgacagaaggcacgaagatgaaaatagctaagacttggcggggtgcagtggctcatgcctataatcccagcactttgggaggccaagatgggcagatcacctgaggtcaggagttcgtgaccagcctgaccaacatggtgaaaccccttctctactaaaaatacaaatattaggtgggcttggtggagggtgtctgtaatcccagttactcgggagactgaggcatgaaaattacttgaacctgggaggtagaagaggtggaggttgcagtgagctgagatcgtgccactgcactccaggctgggtgataatgagagcgaaactccgtctcaaaaaaaaaaaattggtaagactctttacctccaatacttcacagtctatttagatcaatgagtaaatgcatagttaaaatactggtgtcaagggaggaagtagggaattcacacaggaggaacacccaatgcaaattggagccatcagaaaaggcttccacagtagattttgtgagagctaaagcatgaagagaacaactacttattttaacatagttatatttattttcattaactaccataataatttgaattatttttatggtaatcattttcttatgcaaatgaaggagtaacaggattgaaatagtaaagttgagtttacaagctgagcgccagaaaaacaaataaaagagactaatttttaacatcttacctatttgagtttcaaagattccctcagaaaagcttagatttgtcaaacatttgaaataaatgccattggcaaatcaaacttcaatatgaggtttcttacgctcctctttgctaagagtgtaattttcccaactcagtgaatttcttaaaaagcctatcaaacagacgtcaacctttgaagcttcaattctcaggtatggagggtctccacataactgcccactgaaggggtctctgggttttcagcagaaaaaaaatgcttggattccaatgagttctgctctctgtagcattcaaaagagaattgcaccattactgaatctacatagacggttttactacttatgatagcctgaaatttaaacccagttctcataaacaaatttatgaaataagctattttaataatttgttttggatcatgctcacttctagtagaactgagcatctctgatattttcagtggtttgttttgctcgctctctctctgtccagtggaataaataatcctttaataaaaacagaggcagacacatgacaagcagttcatcatgtgaggaaattcacatttagacaagcatgctttcaaatatagagtccctttttaaatctttcaggggaatttttaagctctattgagacatagttgatatttgcatatttaaaatgcacttaatgtatatattttgatgagtttggacatatgcctatactcatgataccacagccaagtagtactaaacatactcatcacctccacaaattttcttgtatttttgtgtggtttcatttttgtttggtttggtttggttttgtttgtggtaagagcacttaacatgagatctatcatcttaaaacattttaaagtatacaattctgttttgttaaccgcagatactgttctgcaaaacacatctctagaacttatttgtcttgaataattgaaatgtcatacctactgagcaacaaatccccatttcctcctccccacaacccctggcaaccaccattctattctctgcttctgtgaatttgactattttagattcttcatatgaatggaatcatgcagtgtttgtccttctgtgactggcttatttcacttaacataatatctttcaggtcagtttatgttgtcacaaatggtaggatttccttttcttttaaggctgaataatagtccacgtgtgtgtgtgcgcgtgcatacatatatatacatgcacacacgcacatacaaatatatatatataatattttctttattcattcagatgtccttgaccttttgtgtagcaaaggtcaataaataaattgcatcataagaaccacatctaaattaaaatcttcttgatatttactcatgcactgattcattaaatcaataaatatttctaaaaggcccactttgtgccagtctcctgtactagctcctgagaatatatgtcgagtaagagaaagtttttgtcctctcaaaattccaagttgaaagagagaaaaacaggtaagtcagagtatgatgagcacattgatcgtgattcacctggaatgacagagaagggcacctgagtcaccctggagcaggaaggggaggccctggatctggcctgtcaacaagacaactggctccaggaagtcactgtctgtagtcatttatctttttatcttccataagcacctactgtaggctctgcacaatggaggtgaaaagacaatggagctaagaaagcagactaaaataaaaagagagttcacagagagaagaataatgtaaaagaaacagaacccttatgaacttaaattgtaggaaattgtaaagaatagaattgccattgcagagaagtgaagtacatcagcaatgtggagtacaggctgaaattcaaaggaaaagaacacagatataaaaatcagagagctcatagatacggaagaaaaataatggagaccctttgtaggaataattagaatccttgaagaagagaaccgaatctatgggaaagaatgctcaaaaacatgatagaccaaaacgttgaactgagaggagaccttaggttcaatttataccaaacaaaattgatgaaaaataattaattgctaaacctgtgttccataggacgttagttcaagtgttgaagtttcaggtaggcactgaaattcggagagaagtcaaagctggagttataaatctgggagttactagcatgtcaatatttaaaatgtgggaccagatgagataattagggaggggggcaataggagaaaaagaggatttgaaatgacatgtttggggattccagcctttggggtttaagcagaagacgagcagactgctaagggatgaagaaggagccctgctgaggaagaggaagtgagtcaattagcagataaatgtagaagtgtggtaagcctcatttgtaatcaaataaatgcaaattaaagagatcaaatttgattaattgtattggcaagaattagtaaatttcattactaatgtcagttggaagtcaaacttgcaaaatgtaattataaattttgaacatcttttgaccccaaatcccttttttttttttctttttgagacggagtctcactctgttgcccaggctggagtgcaatggtgcaatcttggctcactgcaagctccgcctcccgggttcacgccattctcccgcctcagcctcccaagtagctgggactacaggtgccggccaccacgcccggctaattttttttatttttagtagagacagggtttcaccgtgttcgccaggatgttctcaatttcctgacctcgtgatccacccacctccgcctcccaaagtgctggattacaggcgtaagccaccatgcctggcccccaaaatcccatttttaagaatttattctaagaaactgaccagacaagagcacaagaatgcaaactcatcacagtattgtttataatcagtaaattactaaatttctacaaagaaatgaaggataagttaattatggtacatgaacatggtgagattttatgtagtcattaaagtaaaaaggatatccatgtacttaactacatatgtatatatgtatgtaccaacatcatttacatgatattcacaatatagtataacaaaaatattgttcatagaatatcattaaacaaaattgattcacaaagttttgcacattatctatgtgaaattttagtcaatatgcaaatatctatgcacacaaatagtccagaatgatagactctaaatgttaatgaggagtaggagttttgacaactttgattataatgtttatattatccataagcatttttataataaccatctattgcctttttagccagaggagccaatcaaggtatttaaactttgaaaaaagagataaaaatatttcctgtccttatttcccagctttcccttttgtctgctctgctaatccctttaactgcaccactcccagtgtaggctctgagactccaccaaaaattgattctgggcagccagacaaaatctgtcttgctctagattttatattgtatcacttttatagaagcaaatagatttctccttccattcaagtgaacatgaaattgtctctttttaaatttttagaatctattttaactgacaaagaaaaattatacatatttatggtatactacatgatgctttgatatatgtatatattctggaatagctatatcaggctacctaacaaatctattacttcacatatgtatcaattttttggggggtgaggacatttaaaatgtgcttttatagcaattttcaaatatacaatacaatgcaaccaactatagtcaccatgttgtacaatagatctcctgaacttatttctcctaatgaaaactttgtatcctttgaccaatctcttcacatactccacctcccttaggccttggtagccgccattctgctctctggtactatgaatgagtctgaccattttagatcccccataggagtgagctcatgaagtatttgtctttctgtgcctggcttatttcatttagcataatgtcttctaggttcgtccatgttgtcacaaagggcaaaaaccatatggtcataccaatagatacagaaaaagcatttgacaaattttaacatctttttataataaaaactcaacaaattagatatagaaggcatgacctcaacacaaaaaaggccatgtatggcaagctcacagccctcacactccatggtgaaaaatgaaaagcttctcctctaacatcaagaacaagataagaatgcccactctcaccatatgtgttcaacgtagaactgaaaatccagagaaatcaggtaagaaaaagaaatatataaaagatatccaaatcagaaatgaagaagttaaattgtcacagtttacagatatcatggtattaaatatagaaaactagcaattaaaactttgaaattatcttttttattttatttttgagatagagtcttgctctgtcacccaggcgggagtgcaatggtgcaatcttggctcactgcaaccacctttcagattcaaaggattctcttgcctcaacctctcaagtagctgggattacaggcacacaccactatgcctggctaatttttgtattttcagtagagatagggttttgccatgttggtcaggctggtctcaaactcctgacctcaagtgatccacctgccttggcctccctaagtgttgggattacaggcatgagccaccggacccagccgaaattatctcttgaacatatcaatgtattgtgattgtttgcttcagttatacatatggcttgtcttcaaattataaacattacaaagatctaatacagttgagagtttgtcatgaagctccagaattatgaaaaagaaataatacatggttgggaaccagagagctatgagttctaaaaactacatgtattctattctccaattacttttgtcaacttacttttgttaagtgactttgttttgttaaggaactttgtattctacaatttccaaatggaaatgctggcctagaccactgtttccaaaagtatatatatgcagtatacagttattttataatgtgtcaacaaaaaatacttgtagctgtctaattttcattaggcatatctgactgtccttaccttattctcatttttctttttatccagcatttattgttactgaaacaccaggggtttgttctaggtcctgctgcttgcagcacagaaagccaatcactgagacaacaagtattgccaaagaagaagttttactctggtactgcagccaaggagatgggaattcagtctcaaatccatctccctgattgactaaaactaggggtttaaatagcagggaagaaatgcaacaatgtataagaaaccaggaactaggagagagacaaggaagcaattatgaggaatgaggcctctggcatgtcattgtctgggtgtggtaacatggtaagtttcagttctttgattttttttttcttttttgagaggcctgaaggccatttcctgaggagggaactcagataaaacaaatgtaagtttcaacctttaagaccaaaagggtccatttctgtgtttatctaaaaaaaactacctatggtactactgggctgatttcagctaattttcattaggcacatctgactggctttactctactttcattttttcttttatgtagaattccttaccatctgaaatactatagcatatgtttatttattgtgtttctaatgtattttctttctctctctgctaaaatgtaagcccaatgagggcagtaggttttctctgtttaactcactcatatcccaagcacctagaatcatgcctgggacatagtactaacttaattaacatttgttgaataagtatttggacactgatcacatgtatcaaagttaatgtaaacagacaaccttagttattacagtataagaaaatataatgactttagcttctatagtataagaaaaaaagtctacattctatctatggcacattttacagacaaatctagattaaacacaatgctcaggaaactgtataattgggtttattgaattcctggcaactgttaaaatattcctttcaaacttctgttttgaaaatacttctaataccttatgattaatgggtaagaaaaatatgacttttttcaattattcatgattttgcagagtctcagagcactcattctaaacattacttctcattatgcaacaataaaccatagaaataaaaaatctggaaggctgagctgaaagggtactcatcacaattaaatctctaacgtgagctaattttaagattatttttatctttctcctaaaaatgtgagtcaataaaaattctgctaaactagtatttggagtttaaatatgtctggctatttctaaatgacttaatatgaaaagcattaacttaaaacaagcatacatttgaatcttcagaaaatcatgttagataaacttgtgctttaggaagtatttataatatcagcttgctgctatgcaaaggcatagctgccctaaggctaaacacatagaaaatttcacctgaaatagatagcaccacaaggcattccttatctcaggtttgatatgcctgtcttttttaaataaaggaactttaaattcctaggcagtcttatcataagcagcagctggctaaatgtagaatgattatataacttggcattcaaacaaggacacttgagaatgaaatgaaatacctttaaccatcacccagaaacagagccttctgtcacccaccccagttgaataggcaaggctggccaacgttgtcctcacacctcgttgagccggtttctctcaagtaatctgaagataaaaccacaggcccatgtatattaagggccaattgtttcaccacaaaaaattcattaagtgtaaattaatatgctaaaagacttggttagtcaaacaagctttatccttttgtaatcaaagtagaaaaaaaattcaatgaagaaataaactgcttgccatttttttgaggaatcgtttgtagtataagaagagctgattagcaaaatctgatttactgttgcaggcctttaatctcaattagggttgaaatgtattcccaacagataataatgttagatccaagcaaatagtcacttgttttattgtaataaaagtgatctaccaaaaaaacccacaatcttacctttcctccctatcactttaattccctacatatttatgtttgcaaaatccatataaataaaaccatgaattgttttttggagttttcaaatgaagaaaattttacaaaataacaagagccggtaatttttatcacactgaaatgctttttaaagctcttcaaaatggatagtacattgagttcaactcctttctaagattagaatattgtaataagtaaaattaagtcatccctaatgattatagcatacattggccacattatgtagaatgttatcctctaggccttatatttttgacttaacaaatatgcccatattttgtgcacccagattctctcttttgccacatggaaggatgacttatcattggctagattgcactttaatgaattcaagacatcatttctctgttttagtaatattgctgcgctattatccaccatcttcatttcatagcactgaggaatagcattctattaccactatactgttggccatataagtacatctagagcaaacagacacttcagtcattctgggaggctctctgtgcttttaatttattttctttttttaatggctcaatgggaaaaaaagattttggggttataatattctggaaaatgcttaagtttaaatatggagattgttaaatattgatctcccattacctgttgctattctgaaagcatttgaaaatcaagaaggtataacattttcacacagagaacagttcagaggagaggataacagtccaaaggaaaaataaatgacaagaggggaaggaaaatggtaacataggtatttgttccattgcaccattttgtaaagtaaaacaaatctcctgaatggacaaatgaaatacctttccattcagacacctttttgctttggtattatcctctattttcctactcaacttacaaattcaaaagctgcaattgtcttttttcaaggaaacagagaaaacattactgagttgttaatattcttccttctaccaaagaataaattgtaagtgccataaagagagcatgtccaacttctacagttgccaaatgaaaacccttcatgagtttccactatggggaatatcatgagagcagcattagttgccaatattttttgccattttcctcagctctttaaaaggcctctgttgcttcttaaaagataaatattaaatgtagtatatatctgataagggattaatatcaaagtattttttaaaactctgacaactcaacaacaaaagacaaacaacccaattcaaaaataagtgaaggacttgaatagacatttcgccaaagaagacatacagagggccaagaagaatatgaaaagatgctcaacatcactgatcatcagggaaatgcaaatcaaaaccacgataagatacacctgattttgaatggcaaaacagagagggtgagagattgagttagttgcagaaagacatggctagtcatcagcgaagcagggacttgaactctgactgactccaccacacacgattttaatcactacactaagcagtagagaagaatgaaaaaaatgtcttttgagtcagacacattaggtttgaacgtcaattgtgccatttactagctaagtgactgagataagtgttaacttctctgattcttagcttctccaactccataaacaggcacctcactgacctcctgcggcagaacgtaacaaaagagcaacacgtagcaaagcacctgccatatgaggaggtctgcaaatgctacaatagaaataatttattcaccctccaaagatccttatgaatatagggcggggtttcttgtcaagttaatggtgcggaggtaccaggtgtcagctgactcaggaggtacagtaacctaaggcaggagtaacttcattgctttggctattggttcttctgatcagcaacccagggttttatctgtgctgcctgtatttctcatcaggcacagtaaatgacattacctgaaagttcaacagaagtttaaaaaaaaaaatgctattcagtccacttggaagaatcttacaatatgcaaatttaaattcaaaagtttgcctctacccttttgatttatagatatggatgctgtactatgattgctcaaccatagactggcttgacacctacagatctctgtatcatgaaaagttacagtcacaccctcagctaacattcactgacaccccataacaaaactccacggagagattcagtcattcgtcaatgtcagaaacaaaattccatgtgggtgcctgctttcaaaacattgaattcccatctggcaagatcctaatgaacaaaggaaagatctatgtttaatgaagcaataccctttcggtagatatttcttgacagctgtaccttggagccattgcatttctggcagccttgctacaccttcaaaaagacaaaaatcctaaaacaatcatatattcaaatgctgaagtgcacaacacataaattcccctttccctcttgctgattccatggaatgagactaactttcagtcaagctagttgaagtgaggtgcagttaactaattcacttcatgctatgtgtttttgtaaactactgcactcttgctgtgaaacaaggctgaatcaatgaaagccaaatgtacctttagtgaggaaaaggccctgtgagtgataaaagacattttagaatccataaggataatagtgtaagagctccaaacgtgtgccatgattttctccatattactttttgtgtatctaactcatatttcagaaagtaaataataatatggaaaagtaaaagaacaagaagaaaacattggcagcactggacctacaccaggcatccccaaaggcaggtggaaaacgattgcacccctagctcctgtaattgtcaggaagagcagagaaggctccctcgggcccttcatagcaagcaaggggaagagatgcaagatttttcaaaaggcaagattctaatcactaccctaagatttgtaaatccaagaactctttttttgttgttgttttctactctatcagttaggaatgatttgggctgcaaataacagaaaatcctaatcagacccaaacagatgaactatttgcaccatacaagaccagaggaggttgtctaggtggctgtagttgctcagcagtgtcaacagtgacaacgtttgtgctttattatccttagtatgtggccttcacactcatcatgacaaaatgacttttgtctttaccagtgggaatgagaaagaaggggcttaccaattttatctgtctcttccttttaaaaagatgccctggattcctgctcttgcagacatcttataatactatagtttcccagaaaacagagcttgagataaagacatagctgcagggagtttacataggaatgtgatctcagggagcaggtgtgaggaatgaagaaagctggaaagggggaaaaaccattctaaggacacattatccagttggccagcaccatagatgtcttgcaaaagaactgcagagtcttccaaatgcttctcagaacttagacctggcagataaaaggggacacatctgtctgttgctgccatcccatcagtcacaggtgctccacgaatgctaacatcccacatctctagtgtgggcttcccatgttgcaggatctgagaagccccacagcagaaaatgaaagccatgacctgggctggaagcacaagctacaaggttgtccctgcataatcagtgcttgtgtgtgaccagagaccacagggcagctggaatcagaggaggggctcagggaaaaggaaatagtgcccatgagtggggccaggataggcctcattggcccaacctttctggcctctgcagcagcaggagagggagagaagatgagtatttgtggtcaggcagtgtcaccctgcaggattctgttggcaaaagggaacgagaatggatgctgggcaagccaccaccagagtcagctgccactccctggctaattataaggggggtttccaaaaccttattgtcacctaaaagcaaagtgagagtcatgctgaatatgttttcttttaaactgttgtcctttgagcaaatgagctagatttttttttttaattactacaacttgtgctaaattcttctctaatcaagagaaagcagagagcagtcaccacttgtcttaaatgtcttgcttttgacacagctgcctgaggaggcaggcctggttggaaggaataggagcatgggcaagtacacaggaaggaaagcaaggcctgggattgattgtcccaagcagaccccaacaccacagccacaggcagcctcaggggtctggaaggagggagaccaccttccatgtgggggccagggactgagggggaggagctgggagattgtgggggaattccatctttagcactggacccagcagggaagctctccaccctttagtgagtggcaaggaatggggagcgccaatgtctttggctgtactggaggttaggtgaaaaaaagtagaagttatctgtaattcaatcatgcatatactttccagcattcatctttttggttttcttctcaaaaaagatagcaggcttccaaagtgaaccaagaaataccaaccgtggctcgaacttcatagtttgcctctaactgcattttcatacattgccctaaaggggcacacttctcattgcttactagtcacatttgcttcagttatagttttcatagaattcttttgaaaagtatgctgtgacatctcattccctgtgctataaaactcaaagatggacacatctgcttgaagtatcttgtttcacagtctccactgtgacagctcatatgccccctgaggactgcctcttggcccctctgtggtgtattagggtacactcatgctgatcatctgcatgagctcctccactgattttacactttaaaaggtggatattttcaattcaccaggatcctgaactagtcatttgtgttaaaaatcagacttcctccctcgcccagccagccgccccgtccgggagggaggcggggggcagcccccacccggccagccaccccatctgggagggaggcggggggcagcccccgatcggccagccgccccgtccgggagggaggcggggggcacctccgcccggccgccaccccgtctgggaggtgaggggcgcctctgcccggccgccccttctaggaagtgaggagcccctctgccctgccgccacccggtctggaaggtgtacccaacagctcattgagaatgatggctgttttgtcgaatagaaaaggggtaaatgtggggaaaagatagagaaatcagattgttgctgtgtctgtgtagaaagaagtagacataggagactccattttgttctgtactaagaaaaattcttctgccttgggatgctgttgatctatgaccttacccccaacctggtgctctctaaaacatgtgctgtgtccactcagggttaaatggattaagggcggtgcaagatgtgctttgttaaacagatgcttgaaggcagcatgctctttaagagtcatcaccactccctaatctcaagtacccagggacacaaacactgcggaaggccgcagggtcccctgcctaggaaaaccagagacctttgttcacttgtttatctgctgactttccctccactattgtcctatgaccctgccaaatccccctctgcgagaaacacccaagaatgatcaatttaaaaaaaaaaaaaaaactatttctaccttctaatgagaattttaaaaactataaacatgatttttttaaaaaaatattgagtttccaaaaagaaaggaacgaggattaatccagaaactccacatcttcctggattggagggtaccctatcattcaaaaattcttccagagtatcatatgtttcagatggattcaagcagaatattttttcaaagatcagtaagcggtgcgcttagaagagaaacagcctctctacatctaagactgtgagtattagaagccacatgtagaaagcacctgcctaacatagagccaaaccaaatacaagcagagccaaaggaactgagtcatgatgtgatcatttgaacttctggattcagctaggcctgaagcagggccgggactagggtgaagtaagtgaggcattaatttgaggggcaaattttaaagggatgcaaagaaacctcagtaataaaagaaaatacagtattttcttttttataataaaaatattttaattctttatttcaataaaatatattattccctcctaaaaaaaaaaaaatcagacttcctaagtttgggggaagttttatacagaagcaaattgttcttaaaaaacaacttatgtgacatattatcctttatgtctgaattgtttttttaaagctatgtttaatactcagtaattttttattacactttgaatatgtttttggaagggttttcattcatgtttattttcccaacttcctactttactgtcagctgttatttgtaaatagatactatttataaatcagacttattggcataattgtggtgttatttatatgaatcacatgtgaataagtatgttcttttttgagaatttatacatagtatttttatttttattaaccaaaattttaaaaagaaatgtgctatcctgatattctgtaaatattttgggtattttctgagcagcatatagatgaagtctcacttgaataatccctaaattcaagtttatcagattaatttaataaactcttgaaaattagatatatttctcacttcctagctggatattttggtgaagcatctaggacaccaacaccatcacctttacagcagaataaagagcatattcacacagtcggctagtggtcacggcgcttttccctcttgctgccagctccccactggccctgtgcaggctcctgcctaggccggtgaaggcaagataagagcaagtgttcagtacttccaggcacaacagagggaactccacaggctgacacagacgctcgatcgcatgcaaagaaaatctcattttcctcccaaagctgtcccaccacggccccaggatatccgtggctcttccagatagtgacagggacggagctgaagcactgtctcagaggctgcagagcccgtgaacaagtctcagagcctcctggctgaaccccaagactcagagctttggctccaggttgagcttcaacctgcagacaaccttcaaagggcacaccagcactccagaatcaagcatggatgaaagtgaggctggcactgaaaacgagcagagaccacgaaaactaaaacactcttcacactcaagaactcacttcttttgtttttaattaggcaaagaactctattcatctttgtttcaaactttattcccaggttttttcagcttaattagctgcaaagaatgaattgtgtataaacaaaaactaaaaacagctgcagtatccaagggacttgggcttaaaaatattatagatttagattttatgagatccataaacaattttgaaaagcagtcataatataaaatagcagctcccagtaacttcttcaacttctactttctttagaagttgactcaattctatacctaatgataaatgacgagttaatgggtgcagcacaccaacatggcacatgtatacatatgtaacaaacctgcacgttgtgcacatgtaccctaaaacttaaagtataataataataaaattaaaaaaaaaaagaagttgactcaattcactttgcctcattcttggaagcctcatcaaaattctccacaagatcgggaacttcactatcatcatcatcatcctctccagcagcaagtgctgcttttccatctacagatagtttggtggagctccagccagcctccttaaactagtcagtctgcaccaagctggtttacaatggtaaaccagctggtagcatttctttcagcagctttgtcccagcatggcctgtcatggtgaaagtgttcccagagatacctgacctttagggttgctaaagtggattgctgttcattggtttgtaaacatattcacctcttcagtaccagagatagtgtttacccctaacttctttaaggagagctgtagttttttctaatctgctgctgctgttctacggaccaccttcttccttccgcaagcagttgctttctcaccaatgcacactggtgcctgcagtcggctgagctttccctggttcatgattgttgctttcaaattgttggagaggaaaaggggtagcaagagggactagtgaaatgggagagttccctgatccaccttgcaggacatgcgacagggatgtggctcatctatttggccactatgcgcactccaacccctatgggagggggagcacacagacgagcaggtgcaggagccagggccagagctcctgggctctgaccccacagcggcatccaggggtggtagcctgagactcctgaagcccaagtgggcacatgtcacagtgcactcttctagctttgcagttcgcagatggcttacatgttaaccaactcagtgccctcttggtacctgggtccttgttcagcatccaggaagaatcaggtcacacacagactcagggatgaatgcagggtttttattgagtggtgaggtggctctcagagggatggatagggagctggaaaggggatggagtgggaagacgatcttcccctggggtttggctgcccagtggccaatcttgtctccaactgtccccagccaaactcctctcagcattcagacactccttctcttctttatgttgcactattctgccattcttctgctcttctgtttgtcccctcatggagcctggggtttggggtttatatgagtacaggatggggacatggcagaccaaaaggcagtatttttttttctattttagggagcaaaaataggagtgcctgttctcatttagggccatgggtttccaagcttgggggtggggcctttgccagggaacttcttttttctatccagtatttccctgtctccagtctgtatcactagggttggcactcaaggggtctcaggtagaacagctgagattaggtgctgtatgtggagatgcaaaatggcctcaagaattcatttctatagcatatacctgccccacacacaataaaaaaagaaaagaaaagaaaaagacacaagatagagctatattagccaaagtctacaagcagaacatctgggggaaaaatctataaaggacaattagtctcccttctggatagtattcagaaaaaaaaaatctttacttttctaattagtgtgaagttaacttagagaaaacaggaatgtggtaaaggaaacacaaattgagagtcaaatggacctggattcaaatccagactcgaatttactattcctaattcatctatgccttgcagctacagatgagaaaaggaaaaatcaaaagtgaaaccagactcagatgctggcttcccagaactcgtgccgtatcaggtaaaagagacactagacaggcagtcctgcacgggcgatatcagcctcaagcaagccctgagccaacccaactaccctagtccagaatgttaggaaaggctctgctgtggcccaaatggagagaagttcatcaaggagagaaacacattgtgtgcatttcctcagtcacagagacctgggagggctccactgtgacagcagttcagggtccctatgtggcgggagcaattcagcagtgagccacctgccgaaggtgggccctgggctgcgggagcaccagcaggtcgacaaagttcctctgagcgaggtggggctgtttcctaagggcagtcgacagccactgaaaacattaggcagggagggggcgcggtcaggcttgcctttatagaaagtttacttttgttgacaatgagaggactgcattgcggacagtaaaactggtagcagggagtctggtgggagccacttggaataatccaggagagagatgatctgcacctgaacaagacgactgtaaggcaggggtggagaagaggaaataagatggaggagtttgagggttgaattgaataggagtggaaggtgcagaaaaggaaagagggaggcatggagcggaacaggcctctcttggctatcgccggaccaggggtgggggtggggtgctactcacagagcagtgacccatctaagacaggagcaggttgggaggacgggtggagactgttggccagagctcaggagagagtttggggctacaatggctatttggggaatctctgcaaggttgttaattgatggcatccaagtagaagaggccacaaagggagcgtatgtagagaaaggatcctagaggacaggcctataaggaacagctgcttttaagagcaggcagagtaagagatgtcatcagaggagattgggaagcacacccggggctgctggagaacagagaccccatctgtttggttctccattgcagtctcaggtctccaaacaaggcctgagacaacagacatatctgttatgtaaattagctgctgatgaccacatgacatcgcagaaaaaaaaaggaaaaatcagatctcaggaagaagagcattctcaagagaacctgaagttgtgtttacctgtggagggtgtttctgcccttcgagagtaggccactgcgtgccaccatacatagttctccttagtccataaaatgccatggacactactagcaaagtctaccataggcagagatgagtaacaggctttgtgtgggtcgccccagccctgtagaagccatcttagcccatgtgagacctgaaatagtctgaaagctctcagctccctgtccatgctttttatcgtctaaggatcccctgccctgtccttgtgagtgccatgaactctattgcctttctcagcaatcactaaaattcacgtgtgtttcagttcaccccagcccagctcttcctccaggaactaccccctaattgctcccctcatccaggagccagactcctctaactcacagactccacctattgtccttggacacttaatttttttttcttttctttttcttttttggagatggggtctcactctgtcacccaggctggagtgcagtggcaccattatggctctctgcaggttcgaactccgggtgtttattactaatttctgggtatttgctgtcttttctattcaaccatgtaataaggtgctgagaacaagatcattttatgggttttctgcacccacaatgtctagaaagtatcagatcttccataaatatttgttgacaatcaatagccccatcctcattcccatggcaccatgtccgtcgatcacagaaataatacaacatttgccacagtgggtgggcatgtcggtgtttttgtctttcccattggcaagaaataagagcattagaaataaaagatgtgtttttattagtagtagtacttgaagaaatctgagtaaactgattgaaaattctatttatttttgtaaacgtgtttctaacaccacttattttattttctttgatcattttagctacaaaataaaagtagcacttccagaatagaaggcttctatgataagaacacattcagggtcagagtgttctctttccttcccgggagcgttgtcctggcctccaccatggaaggagaagaacatctcccacctcaggcccttgaagctcctcgttgcattagctgcctggttgtgaaatctgtgttaccaagcactcccaggcatgaattataagtcctgggacagtgggaacaactaaagaacattttgattggggatagaacccagttctctttagtaagacaccttaaggtgttttgcgttctgcaaggacagatagtaaatggtcaacaggcaagtattcacacacaggtaagacacaggtcatcttacatgtgtaagctgattttatgggccctaatttttcaaaaactttgcttcattaggcttaagtgtgaccactgaccatttcaacaacattggcctctatgttttggttcagtcgttaattattgatgtagccttgataaaatcacttcagtctctgaacttcagctttaactgtaaaataaaaaggatttgtccaatgtcatcttgaatctcttgaaattctgtccttgattctgagacttaaacattacagaaagaaatgcagcgttttttgatgccctgtgtgtatatctctattgcagctctaactgcaatctattcaaatcagttcttgaatagttcatttctcccactaaaacaagctccatgggagcaggaatgagtcccattacctctggcgccccaggtagagcgaagagctctcagcacccatgggcccaaagtcccttaactagtggatgaacacgccggctctatgccagctctcatacttctggatcctctagcctgcttacatcccacttcacctttggcttggtaaacccaagagaaatggaattcattgaaaggcccatgatggctgcccttacctccctgtcttacgtctctttgtgcccacagaaaccgcctgggaccagaaaaacatagacgtgactatgcaaacacacagaagatgaggaagacaggtcttcatacttgcctataaggcctttttattcatcactattctttgccgttcacctgaactattctttaactcacattctaggttagaagatagcagattcctagaatgttcaacgttacatgatacttaaagcagcacaaggcttcacctaaaataaatcttgcagtgacttacaaagctaatgaatctggtgtgactcctttcaatattttcattacattgagccactaaaagcttatttaaaaaaatctaggatttgaaaaaaataacctactatactgaaaagtttaatttcatttatcaccattttggaataatctacctgaataaagtttcaaagtactactagattcttagacccaggcaatactttacagttttagtaaggactttcaacccttttcctccagttcaagaaaggctctatcatcttcataaatgacagaacaatcatggtccttggcgggcctccctccatggccaagagtgtgaagcatatcttgaatgaaagtctaactactccatttgtacttataagatgacaccaatataatacaaattggaagaaatgttttgcctcaagaaataaattgttcctgagatgctacaaaacaagtatttataataagtgcagactaggaacaagatagtttgcatgggaatttcaaacactgaccctaaatgccttatgttgattgtactaaagagcatggcattttgttttgtaattttgcttttaatctatagtatcattttacaattacatacactcaaatcaaagtaaaagcacataaaaatgattccgtagtactactacacagtgggggtccataaacatctgtgccataaccaacataacaaaaacgaatgaagttaaacaataatgcaaaatactataaaaacatttctcttcatggcaatgctggtgtttacaattgtctactgttgcaggatcacttagaagaatacaaaacccaaaaatttactttgagaatatagagttgttaaagcaaataagaggagacccttggcctaaggtttcctctgtacccagagcactatgtaagcaaactgaaacttgacttggagggcatttttttataactgactaaaaaaaggaaaaaaaaggaagaaacacctagactcagtcaaccacaaacagtcaagcaccaggttagctgtggaactagggatctacaatcacgctatgcctaaatgaggcaaacacctatggtaggcaatcaggaaatgtcttaactttgcttccacgttcagcctctgaaagctcagtgctcactctagcagagcactctgagctctgccggttttgactgctcccaagttcatgaattgttctttgtttaaatagattctgttaaatttattttctctaaagttttccttttaagagagtaaacaaaaaagaaaagttaaaagtaaaattttgttctcttaaatttcacatatgtattctattgcttaacacattaaatacagtcatgcaccacataacgatgtttcagtcagtgatggaccacatatgcactggtggtcccataggattacaatggaactgacaaattcctattgtctagtgatgtcatcaccaaagtaaggtcattgtgtaatgcattactcacatgtttgtggttatgatgatgtaaacacacctactgtgctgccagtgttataaaagtctagcacatacagttatgtatagtatataatacttgataatgataataaatgactatgtgactgatttatatactcattatacttttaatcattattttagttactccttctgcttatatattttttcagagtaaactgtaaattagcctcaggcaggtccttcaaaatgtgttccagaagaaggtattgctatcataggagatgacagctctatgggtgctactgccccaaagatgttctactgggacaagatacggaggtggaagatggtaatattgatgatcctgatcctgtgcaggcctaggcgaatgtgtgtgtttgtgtcttcatttttaacaaaaagtattaaatgaaaaaaaaatttaaaaatttaagaataaaaaatgtatagaataaggagataaagagagaaaatatgtttgtacagctgtaaaatgtgtttgtgttttaagctgaatgttattataaaagaatcaaaaaagttaaaaaaattaaagtttataatgaaaaactttatagtaggcttagtttaattattattgaagacagaaaaatgttttataaatttagtgtagcctaagtctacagtgtttataaagtctacagtggtgtacaggaatgtcctaggccttcacatttactcgccactcactcactgacttcccccagagcaacttccatcctgcaagctccattcatggtatgtgccctacataggtgtaccagtttttgccttttatatggtatttttctgtaccttttctattttacatatgtttagatacataaatacttacccttgtattccagttgcctacagtactcagtacagtaacatgctgtataggtttgtagcctgagagcacaatgacagaatcacctaatgatgcatttctcaggacctacccccattgttaagtaacacataacttaaactagacttcactaaaattaaaaacgctatgtgaaagacactgtcaagagaatgaaaagacaagtgacagactgaaagaaaatatgtgcaaaatatatttctgataaaagatagttatccaaaatatacctaaaaataaaactcaacaataagaaaacaaaaaatgggtaaaagccccactaacacctcaccaaagaagatatacagatgagaaataagcatatgaaaatacgcttaatatcatagtcattagaaagttacaaattaaaacaatgagataccactacacaatcatttagaatggccaaaatccaaaacactgacaacactaaatactggtgaggatgctgagcagcagagactcttattggttgctggtgggaatgcaaaacagtagagccactttgggaaagtttggcagtttcttacaaaaataagcatactcttgccatataatccagcatctgtgctccttggcatttactcaaatagaggaaatcttaattcacacagaacctgcacacagatgtttatagaaggtttaatcatcattgtcaagacttgggagcaaataagatgtctttcatcaggtgaatggataaactgtagtacatccacaccaggaactattaagcagaaatgagctatcaagccataaaaagacatggaggaaactcaaatgcacactactaagtgaaagaagccaatctgaaaaggctatgtgctatgtgacacactatggcattcaggaaaaggcaaaactatgaagacaataaaaagatcaatgtttgccaatggttagaagagaagggggaaggataggtggagcacagaggacttttagggcagggaaactattctgtatgatagtataatggtgaatatatgccattacacgtcagtcaaaacccctagagtgtacaccaagagtgaacccaagtgataactatgaactttaagtaataaatatgtgtcaatgtaggttcatcacttgtaacatctcattcagggtattgacagggggtagcttacaggagcaagatggcatatgggccctctctgtactgtccactcaattttgccatgaacctaaactgctctaaataataaagtctgctttaaagtgtcaacataatcaaataaccttttctgaatttttttccttcattacacattttagatttcaaaaccaatttttatgtctagctcattctatgaatatatcattgctatattttcataatctgggtgtcatcaaactataagccttattttggagtgataggaagaaaacccccaagtaatctctgaacagtttaccaattgtctactatgtaccattgatgtgtctatatgccatggatgtagagatgattaagatgaaatctctgtccctaatggctaaccctctaattctctaacggaagaaggcagaaaagtaaacaatcaataaacatttatgtacaaataaacactgacattgtatattagtctgttctcatgctgttaataaaaacataccccaagactgggtaattgttaaaggaaagaggtttaatggactcacagttccacatggctggggaggcctcacattcatggcagaaggtgaaagagaagcaaagtcaagttttacatggtggaaggcaagaaagcatatgcagaactgccctttatgataccatcagatctcatgagacttactcactatcacaagaacagcacaagaaagacccacccccatgattcaattacctcccactgagtccctcccatgacatgtggaaattatgagagctacaattcaagatgagatttaggtggggacacagccaaccacatcattctgcccctggcccctcccaaatctcatgttctcacatttcaaaaccaatcatgccttcccaacagtctcccaaagtctttattcatgtcagcattaatacaaaagtccacaatccaaagtttcatcaaagacaagacaagtcccttccacctaagagcctgtaaaatcaaaagcaagttagttacttcctagatacaatgggggtacaggcattgaataaatacacccattccaaatgggagaaattggccaaaacaaaggtgttacagaccccatgcaagtctgaaatccaaaggtgtagtcaaatcttaaagctgcaaaatgatctccattgactccatgtctcacatccaggtcacactgatgcaagaggtggatttccatggtcttaggcagctccacccctgtggctttgcagggtacagccccctcctggttgctttcaggaactggcgttgagtgtctgcagcttttccaggcacatagtgcaagctatccgtggaactaccattttggggtccggaggacggtggccctcttctcacagctccactaggactctgtgtgggggttcccattccacattcccttttgcactgtcctagcagaggttctccattagggctctgccctgcagcacacctatgcctggacacccaggcattttcatacatcctctgaaatctaggcaggggttcccaaacctcaattcttaacttctgtggactcacatgctcaacaccatgtataagccatcaaagcttggggcttgcaccctctgaagcaatgacctgagctctactttggccccttttagccatggctgggacacagggcatcaagtcctgagactgcacacagcaaggggcccggaaccattttttttccttctaggcctccaaggcctgtgatgggaggggctgctgtggagacctcagacatgttctgaagatattttccccattgtcttggcaattaacactggactcctcattacttatgcaaatttctgcagccagcttgaatttatcctcagaaaatgggtttctcttttgtgtcacatcatcaggctccaaattttccaaacttttatgttgtacttcccttttaaacttaagttcctatcccaaagcatatctttgtgaatacataaaaccaaatgcttttaacaggacccaagagcactttgctgcttagaaatttcttctgccagatgccctaaatcatctctctctagctcaaagttccacaaatctctaggacaagggcaaaatgccaccagactctttgctaaaacatagcaacggtcaccttaattccagttcccaacaagttcctcatctccatctgagaccacatcagcctggactttattttccatatcactatcagcattttggtcaaagccatttaacaagtctctaggaagttccaaactttcctacatcttcctctcttcttctgagcccctcaaactgttccaatctctgcctgttacccagttccaaagtcgcttccacagtttcgggtacctttacaacagcgccccactctaccagtaccaatttactgtattagtctgttctcaccctgctaataaagacatacctgagactgggtaatttataaaggaaagaggtttaatggactcacatttccacatagctggggaggcctcacaattatggcagaaggcaaaggagaagcaaagacacatcttacatggcagcaggcaagagagcgtgtgtagggaaactcccctttataaaatcatcagatctcaagagacttgtccactaccatgagaacagcttgggaaagacccatccccataatttaattacctcccactaggtccctcccatgatgtgtgggaattatgggagctacaattcaagatgagatttgggtggggacacagccaaaccatatcacatgggatcccaggagggtttcaacaatctgttcttttctgttcactacaaaccccaggtgccctgtggccatttttagagcaatttgtcaccttgagtaagagtctaaattctgtttgtctgctttgttctggcaacagtgcctgtcacatggtaggtgctcagtagttatctgtggatgagcatgacttctagaaacagttgctttagaaccaaatccaagagtaaatctaagaggaaaaggaaaaccctgtagtgaccttacttgagactgtaaaacatattcactagcattctgaagaatacagataagtaacgtattttcctccgtcttccctcatttctatgaagcagtttaaggctatgggcttccaaaatgtaactcaagtgttctcacttggtggattttggttttataaaagtagaacaaagtaaaagatttgcacaccctatgttttagtttcttataaaactaagcatattcttgccatttcttggtgatttgttctcagaaaaggaggaaacatgaaggagggaagaacaaagtgagggaggaatataaataaaggaaaaaacaggccaggtatggtagctgacgcctgtaatcccagcactttgggaggctgaggtgggcagatcacttgaggtcaggagtttgagaccagcctggccaacatggcgaaaccctgtctctaataaaaatacaaaaattagctgggcatagtggcgggcacctgtagtcccagctgctcaggtggctgaggcaggagaatcacttgaacccaggaggtggaggttacggtgagccaaggtcatgccactgcactccagcctgggtgacacagcaagactctgtctcaaataatatatatatatatatatataatttatatatatatgatatatatgatatatgatatattttatatatattacatataaaggaaaaaacaaaagaagggatatgagaaggtttgcttgaattttgagtaacatatctgcaaaagaatattccattttatgttaataaacatcttgaatagatgttttatggttaactctagacatcattgacttagagtgtatctttcaagctgaggaatgatgttctcaccttatcagcaaagggctgttaattcctgtcattacatgaaacctcactatcagtataatgcggagctttgaaagatcaatagcatagcacctttttacgtttcttatttggataattattttaggacttaaagctccaaaattttttattttcaaaaaagagtttgttagggaagagtagagattaacagtgaattcaaacaaactagtttttaaattatacactgagaataagaatcaaagaaattaaagtaaaaaaggacatattagaaaatactctttcaacaccctaaattccttttggcatacggtttagataaattggtctatttaagtcccacttgacctttcaaaatggtggaaattatgtggttgtgatagttgggttctgaaacgggagtctaagttgacgagtgaataatctctaactctttaggaactcacagctcatcaacatcaatacataatatttatatgacaatcttaacatcttaatacaagagagataaaagacatagacaataaaaataggcattttgcctagcaatttcaaacaagtatttttctaaatacatggcagaaataccagacaaaaccatctggtatttcctatgttgacacctaataaatcaagtaaagacaatattttctactctgctctttaaaacctccaaggaaaattaaaagacagtgttaagtcaagcatgcagctgctgagactcaaagcaatattacatagcaaaattagaactgcagaaatctgagcatgaaaggcaaatacagtgaaggtcttggaagtctcaggtttaaaacattgaattgaaataaacataatagggttggagagattggggagatgttgatcaaaggatataaaattttggttaaacaggaagaataagttcaggagatcaattgtacaacatggtgactatggttaataacaacatatattcttgaaaattgctaagagagtatactttaagtgttctcatcacaaaaaagataagtatgtgagataatgcatgttaattggcttgatttagtcattctacaatgtaaacatatattaaaacatcatgttatatgccataaatatatacaatttttgtacatttaaaaataaattaaaaatgtggccaggtgcagtggcccatgcctgtaatcccagcactttgggatgtcgaggtgagtggatcacttgaggtcaggagtttgagatcagcctggtcaacatggtgagaccctgtatctactaaaaaaaaagacaaaaattagctgggcatggtggtgcgtgcctgtaatcccagctactcaggaggctgaggcaggagcatcacttgaaccctgaaggcagaggttgcagtgagtcgagatcctgccgctgcaccccagcctgggcaagagagcaagactgtctcagaaaaaaataaataaataaaattaattaattaattaaaaattgttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaaaaattgttttaatcataattaattcttcaacttaatagcctaaaaagagataaaagttctataactgtttctggacagatttaggggttcctcccagaaaatgttatctttctccctacctgcctaccaccacaccgtaaacctaataaactcccaagttgaattgttaatgacattttaattgaggcctgtacccttgagagagccataatttttaaagttagacatttagaagataacatcattgacatttttcctgtgatttttatgtctaaataaattaagagaggggatttcaaaatatttatcattcgcaagaaacagctctgaggagaggaacatacatttatgtcgcacagaatatggcattgtcatatacatttgtatagagtgaatgtgcactatgccagttgatgtttatcatagacctaagacagaaaataaattttttatgtgaggaatgtgaacctctttaaattatcaggcccagagaggcatttaaaatgtgacagcagacatatctcactccccttttaactaaaataatgaccccttaaagccacttgctaggcaggctccagactaactgactccaagtagctgtaaaatgccatacaccttatggttcaacagggtacagccaatcactaaccagtgttattctgtaaaccaatgagaatgcctgtcaaacaactttggatcagcccactccttgttcctgtttgtctttaaaaacctgcttgtaacaaaggcaaaggaagcattccccaaggcaacctgaaagtgtgtccctggcagctatcctcactttggctaaggtcaactctatacattatattttgtgccccagttttttcccttaggtagacagacctttgtggtacataagggcagttgtaaagaataaatgataagttcatcatttccttcatcccttatttcaacaaatattcattgctgaaatcttaattttaatgaaaatgttttggaaagcaagagtcttaaaactaatgaaagaaagcaattccacttcttcaagtgttaactatatacaaagttttaaggttgacatttttaatacctaaaatgaatttctttatccataagagcggttgttctttagataccaaaacaactctaaaaaattaactggcacataatacaaagaatttcaaactaattttcaaaatgtactccctggattgttttttcattcccacaaatttggcacctcttcattcatcaatatcctcaagattccagtttgaatttccagctgcccaaagacaccttgattttggccaccaaaatgactatctccttaccacatttctctcatttgaaaaagaaatgcaaataaaagataaaactctgtttttctgctaatggaaacatcatgtatcctctactctaaacacttacagtagtttcagtaagaatgacatcggattttattgcattttgttttgttctgcgacttcatatgtgacaaacttatatgcccaaaaagaagcactgcatgagactttaactttcatgtgggcaatgaccaagactacctaattcaatcccttaggcttatcattcaggtgcagcctggtacccagcaggcattaatgtgcatttcttcaatgaataaaggaatgagcaccctgctccaggcccagccagggccaagcactcccctttctcctctttctaccctgatgaagagtatctctcccaactagacaggaagacctcatggtctttgctcctctcacctgcataaccaactcatggccaagacttattcattctgcctctgagacagttctccatcctgcctgctcctccagttcaccctgctgatgtctgaaagatgttcacattcagtgcagttatctttctgcaaagttcactgtcagaccccccccaccactcctttctgcccatctcttctcactggcccccattaatactcattgctcctgctggcatgctttctatatgtagatgggattaagattcgctctcactgaatacctgtccctgtcgatttgtgaagcccccaatgattgacatggtatggccacctgcccacccaggggccccacctctcagtctcactcttttccaatctctcatgtgctctgtcctctagtcacgcagatgactggaaccacaaacaaaggactgtgatgctggcagcagagttcacattgagtattggacagacacaccaaagtcagtaatgtgcaccaattggaccccacagggctttctagcaggcttttctgcatccttttatcccacccacaatacaaatatagtgagcttttaaaagcaagtcttactgaccttcctcctaaaatctgtcagtgttttcctattgttttcagggttttgttttaagtagaaatttacagtgatttatgagactctgcccctgatagccagccctgctctccaggctcagctcacctttgctcttcagccaaagccaccatcttctgtctcccaaaacgtgctgtgctccttccagtatgcatatccagtatgtgactcttgcacctaacattccctctgccaagaacattccactttctccccacttggtaattcctctttactcttcaaatttgtcctcaaatgtcacttcctcagattaaatctttctagggcctcctctttacaattttatattgcaacttagctaaactggaaacacacgcacacacacacacacaagatactctatgggaatactacaaacaactttacgctcataaacttgacagtgtaaaaaaaaaaggaaaacttcctaaacaaaaaaatcacaaactaccaaaactcaattgggatgaaataaacaaattgagtagtcctgtaactattaaataaattgaatttgtaacttagaaattctcaaaaatgaaatagtcagtcccagatggtttcactggagaattctaacaacactttttaaagaataacacctacattacacaatctcttccaagaaataggagactagagaacacatctccacttactcattgatgtcagtattactctgacaacaaaattagtcgaaaatagtacaaaaaaaaagaaaactacacaccaatatctctcatgaacataggcagaagagttattggcaaaacattatcaaatcaaacccagcaaatataaaaggaattatatatttcccacgaccaattgaaatttatttcaagtgcacaggcctaattcaacattcaaaaaatcaaccactataaccaaatcacagtaaacacagtaaagaaaaaaatatataatcttatcattttacacagaaaaagcacttgacaaaatccaacatctgttcatgattaaagaaaaaaaaacttagaaaactacaaatggagcagaagtcaacctgataaagagcatctataaaagtccaacagtaaacaatggtcagtggtaaaagactgaaagatttcttctaagatcaagaacaaaaaaatgatttcccctaagattagaaacaggagtgtcaccgcttttattcatgataagtatcagaagttctagacagtgcaataaggcaagaaaaagaaataataggcataaaaattggaaagaaaaaataaaactgttgtaatttgtacatgagaaaatcacaaagattacaaaggaatatactaaaaacaactaaaaatctcctagaaataacaggtgatttcagcaagattgcaggatataagataaatacacaaaaatcaatttcatctcacgcctgtaatcccagcactttgggaggccgaggcgggtggatcacaaggtcaggagattgagaccatcctggctaacacagtgaagccccgtttctactaaaaaaaaataaaaaattagctgggcatggtggcaggcacctgtagtcccagctactcaggaggctgaggcaggagaatggcgtgaacccaggaggtggagcttgcaatgagccaagatagcaccactgcactccagcctgagaaaaagagcgagattctgtctcaaaaaaaaaaaaaaatcaattttatttctatatgctaacaatgaacttgtagaattcacaatctgaaacacaaaaccatttacaatcacaccaaagaaaatgaagtacttagaacatgtgtataggatctgtattcttaaaattacaaaatgctgattaaagaaactaatgaatatctaaataaatggaaagacatataatgtttgtggatttaataactcaacataataaagatgttactacgtcccaaatcgatcctgatgtgtaatgcaattcctatcaaaatttaacaaggttcttcttctagtaaaatgatatgattatataattttttctttactgtgttaatgtgattggttatagtgattggattgattacatgtccttgctagtgtgaatagtgctgcaaagaagataagtgtgcatgtatctttataacagaatgatttatattcctttgggtatatacccagtaataatattgctgggtcaaatggcatttctggttttagatccttaagaaagcagcatgctgtcttccacaatggttgaactaatttacattcccaccaatagtgtaaaagagttcctattcctctacagcctcactagcatctgttgcttcttgactttttaataatcgccactctgactggcatgagatggtatctcattgcggtttagatttgcatttctctaatgatcagtgatttgctttttttcatatgtttgttggctgcataaatgtcttcctttgagaatttttctattcacgtcctttgcccactttttaatggggttgtttttttttcttgtaattttgtttaaattccttgcagattatggatattagacctttgtcagatggatatgtgatgaattacatttattgatttgcatatgttgaaccagtcttgcatcccggtgatgaagctaacttgatcacggtaggtaagctttttaacgtgctgctggatttggtttgccagtattttactgaagattttcacatcaatgttcatctgagatactggcctgaagtttccttcttttgttgtatctcctccaggttttggtatcaggttgatgctagcctcataaaatgagttaggcagaagttcctccttttcagctgtttcgaatagtttcagaaggaatggtaccagcttctctttgaaacgctggtagaatttaactgtaaatctgtctggtcctggttttttgtttgtgtgtttgtttgttttttggttggtaggctatttattactgcctcaattgtagaacttgctattggcctattgaggaattggacttctttctggtttagtcttgggatggtgtatgtgtccagtaatttatcaattttttctagatttgctagtttatttgcgtagaggtgtttatactatacaattagtgtgtagaagtctaagtctctttgtatgtctctaagaacttgtctaatgattttaggtgctcctatattgggtgcatatatatttaggattattcattcttcttgttgaattgacccctttaccattatgtaatgtccttctttgtcttttttatctttgttagtttaaaggacagacaagtttattctaagttttacaaggaaagacacaggatctaaacagctaaaaaagacaactcgcaaaatttgaaaaagaagaatttaccgagaagaatcaatctaagaaatgttaaggattactacatagctacagtttcaagacagtgtggtattagaggagaagcagacatataggtcaatgaaacaaaatagagaaccccaaaatagagccatacaaatctattcaaataattttgacatcagaataattaaaataaaagattgtagtaaggtcacatgtcagtgatgcgggtgaactgattactcacacgtcgctggtgggaatgtaaaatatcacaattctggaaaataatgtggcagtttctcataaaactaaatgtgtacttaccattgacccagcaattactctatttggcgtttgtactagagaaatgaaaacaaattatcacaaaaatacctttacataaaagatcacagcgtttttattcataacacccaaaatgtggaaacaaccaaatatgcttcagtgtttaatcaaagggttaaacaacctgtgctacatccataccatggaatattactcagcaacagcgaaagaaatgagctcctgatgcatgccacaacttggctggatctcaagggaatgacactgagtgaaaagcccatctaaaatgttacatactgcatgagtccatctatgcagcactattgaaatgacattattaaagagacaagaagagattagtggttaccaggagctaggaaatatgaggagggatgacagggactgtaaaaggggggcagggtcaatccttgtgacgaaactgttattttgactgtggcagtgatcacacgcatctactcaggtggtaaagctgagtagaactaaactcctgtggttgggggagaacagtgtacacataaaaacagaaaatctgaataatatccctggattatgtcagtgttaatttcctcactgtgatattgcactatagttttgtaggacgttagttaccattaagggataccgagtgactggtatacaagatctctctgtattatttcttacaacttcatgggaatccacagttatctcaagcagttttttaaatttagacaaaaagggggacaaaacatcaacaaatgaagaaaatgtttatatatataaacattttatatatataaacaatataaaaattttacatataaatgtatatatatcagagaacaagatggcagaagtgaagccagacaaataagctataacaaatttcatggacagtgactgttttgtttgccacagtaggcatttcatgattgtcacatgaaaatagaaagagaatgtttcctgataagaagaaatgtgacccaagcccgaagcacttggcagatactgtaaagacaatcaaatgcagcatgctgaaagagcacaggctttggaatcattggagcctgttggtgatctataatttaatcaaaagtttcctaaaatttaataaactctgaaatataagtggaacaataggtagtcattcagttccagtaaactattcatgcaacattatcaatttgcagaagggcaaagggacaccaaaatgatcttctctcttcatttgaaattaaaattattttgccatctcattaaatgaaacaaaagaattgcctttaaaagtacactacctggaaatccacgtgagagccaagatggaatgaaggaggtaacttccacttttaataatccctacttttgtttttgtttttttgagacagggtctcactctgtcatccaggctggaatgcagcggcatgatctcggctcactgtaacctccgcctcccgggttcaagctattctcctgcctcagcctcctgagtagttgggattacaagtgcctgccaccgtgcctggctaatttttttttttaaagacagagtcttgctctgtcccccaggctgcagtagtgcagtgatgcgatcttggctcactgcaacctctacctccagggttcaagcgattctcatgcctcagcctcccaagtagctgagattagaggtgcctgccaccacacccagctaatttttgtatttttagtagagttggggtcttgccatgttggccaggctggtcttgaactcctgacctcaggtaatccacctgcctcagcctcccaaagtgctgggattacaggcatgagccaccatgcccgggcaatttttgtatttttagtagagaaatggtttgaccatttggtcaggctggtctcaaactcccgacctcaagcaatccaccagccttggcctcccaaaatgctggaattacaggtgtgagccacagtgcccggcccctactttcattttgtttgaggatgtttatcttggtcatttgggaagatctggaataaatgttggaacctctctctctctctgctgagagagaaaggaaggaaggaaggaaggaaggaaggaaggagagaaagagagaaagaaaaaagagagagaaaaaagaaaggaaggaaggtgagagagaaaggagagagagagaaagaaagaagaagagggaaggaaggaaggaaggaaggaaggaaggaaggaaggaaggaaggaaggaaggaaggaaggaaggaaagaaagaaagaaagaaagaaagaaaggaagaaagagaaaggaaggaagaagggagggaggaaggaaggaaagaaggaaggaaggtgagaaagagagaaagaaaaaagaaaagaaaggaaggaagggaagaagagaaagaaagaaaagagaggaaaagaaagaaaagagaaagaaaggaaggaaggaaggaaagaaggaagaaagaaagaaagagaaagaaagaaagaagaaaggaaggaaagagagaaagagagaaagaaaagagagagaaagagaaaaaagaaaggaaggctgggcacggtggctcacacctgtaaccccaacactttgggaggccgaggtggatagatcacgaggtcaggagatcgagaccatcctagctaacatggtgaaaccccatctctactaaaaatacaaaaaaaaaaaaaaattagctgggcgtggtggcaggcgcctgcagtcccagctactcaggaggctgaggcaggagaatggcatgaacctgggaggtggagcttgcagtgagccaagatggcaccactgcactctagcctgggtacttgagcaagactccatctcaaaaaaaaaaaaaaaaaaaaaggaaggaaagaaagaaagaaaagagaaaaagaaaagaaagaaagagaaaagaaaagagagagaaagaaggaaggagagaaagaaaagagagaaaaagagaaagagagagaaagaaagagaaagaaggacagacagaaagaaaaggaaggaaggaaagaaggaaagagaaagaaaagggaaagagaaagagaaggaaggaaagaaggaaggaaggaaggaaggaaagaaagaaaaagaaagaaagaaagaaagaaagaaagaaagaaagaaagaaagaaagaaagaaagaaagaaagggagggagggaagaaaaggaaggaagaaagaaagaaatcaattttaaaatatggatggtaatgacatttactgatataatactgttagttaattttaagatggatgtttatgatacaacaaattgttgagaaacccacttatttgttattttgtcatctattgcttactttgagaaaataccaagtgcctataagataacttaaatataaaaccggctctagataattgctatccaatagaatgaaatcttaaaggacctttcatcagtaattcaatggtatgtcaagattaagattctagctttcaaaaaacctcaaaccctactcaaagaaaaaataatacaaaacaaatagaagaaagtcaatccaacaaacaaataacaacaaaaataaccctgattctgttagtccagcctctctaccttgcttccacttaaaaatcctatccatctctctagcaagtctttaaaatacaaaattattttcaaatttatattcttataaaaagctaattaaaagaaagtatgaactaaagcagcagatttattcattttcaggctacctgatctaaaccagaaggcaaatggccaccctgttcccagagtcatgtctcctttcaggccgtgacggtggaacattaccttgcctccatcctgtcctctaaccttcctactccttcaggtgcagaggcacaggcaccctgaggtcaacctccacactcttccaagagtcatggcaacatgagaggaattctccaccactaccatttttttttttttttttagatgtagtctcactctgtcgctggagtgcagtggtgagactggagtgcagtggtgcgacctcagctcactacaacctctgcctcgcaggttcaggtgattctcctgcctcagcctcccgagtagctgggattacagcacgctcagctaatttttgtacttttagtagagagagggtttcaccatgttgaccaggctggtcttgaattcctgacctcaggtgatccttctgcctcaccctcccaaagtgctgggattacaggcgtgagccaccgtgcccagccctaccattattttttaagacacacaattccatagatctttagcaagactttctattagcaagacttccatctccagaaagctccagagatgtagccatcatctctagatttagttaaacccctcatcttcaagaattctttctcaagggacaatgccaaaatgcacctgcaattaaagaagtattcatttgaggaatcaggtgtcagtcttctcttcttgcaggacttctcaatctctccaagacattgccctagaacagtcccacccctagtagaagagggagtggccaccaaccacggaactccttgaaagcccaaaggacactgataacagttgattttctcccctgtcctctcttcatctagaacaggcagagggtgttaggtaatggataattataaaagggtcttgtctgtgtcctattagggtatcattaactttctttataaggaggggaaactgagcatccatttttggcattggtgagtcttgattaccatttctggggcaacagataagtccccctcaaaagcttgttacacatgtagcgtttatctcggggctgtggtattaaggaggtggataggtgaacttttattatctactttgtaagctccagtaatgtctatttgttgcttcttgtggttgaagaaaatgtttttgttgtttgttagttttttgaggcaaactctcactctgtggcccaggctggagtgcagtggtgtgatcacggttcactgcagcctagacttcactggctcaggtgattctcccacctcagcctcccaagtagctgggactacaggtgcacgccaccacacccagttaacttttgtatttttttgtagagacagggtttcgccctgttggccaggctggtcttgaactcctgggctcaagggaccctcccacctcagcctcccaaagttctgggattaaagcgtgagccactgtgccaagccaaatgtgctgtttttacagttaacaaagctatcaaaaatttttaagaaaaacaaaaagttacagactaatatggaaaatattttgttgtaaacaaaaaaactcatgatggagttttgtttgtcgatagcatgaaattcaggcttctccctgtgagactcaaagacctgatccaaccttccttcctggtgcccaccctctccactggacatgggtaccacagacacacacaccatgcactgctgcaggcaaacactgtgctccttcacttttctttttaattgtcaatgttatttcattcttctacgttgctctttgccatctttgccaccaccatcaggtgaactcagttgctctccagtatttctaagtgaactcaaagtgtagaagggtgggagaagtatgagttaatctactcatttactcacagtggagaattacaaactaaccacaacacaatgtagacagaaacaacatgtggcatgtttaatgtggcatgcaagcaaggattaagaagaaactcattttcccctggaatgccaaggagcggtccaagttgatgccgtttttttgagctgggttttggatagcaattgaaccaggaaataaggggactggcagagctagggcaatgctccagctgtccagaaacacttccaggctacaccttgacacgagttcaagtacaattagctggtgtcacagtagctctgtcttttagctaaataggatcaaacttgggttaattcccgggccatagttttaatgaattcaacctggtcattgaagcaataaaagatttgtttgtgtataaaagtcaccttattccaaaatagcaggagtagggaaagagctcattctcagagaacagcctgccttggggtctgatctcagccttcacacacaagctggcaggatggaaaagggttagttatcctccctgggtcgcagtttcctcttgtatacatagcagcaataacagtacctctataagtatctgagtgtgagtggtaaatgagttaatatattgagaatgattagcaaggtgatttactcaagctcatttgaatagtttggtagtgtaggacacagtcagagggcttctaactcaaagcctcctagtcatatgacagcagccgctaagctactaagtgacaaatcataagacacaccggggacttacacacacatggtcagtttgcatcagtaattgattctctaaataacaagttaacgtttgcctccttttttgagattgcctccaaatgaataaggtgaactgaataagttcgatttctttcttttagtgcgtttttcagaagtggggatggaaagggttttgtcctcagttatcatctttctgttcattgacatgggcccttagagggagagctgggattgctccagacggtgagcagctcaaaccctgcattgtgggtgggcagaaaggcaggtggggtggcacgctcctggatgccactgcattccgacaggacacccggtcccagctggagcacagcatcactgcctgggccaaggttcactgtcctggattagcaagaacagctggaaagtttgtttgggcatgggggtgaagcaggagttattttaaaaaactgtgaacaagtgaccatagaattaaaaaggaaatgaggatctggacaaagaacaacacgaggtcacgagcccctgggcccacccaagtgtccagaagcccctaccttccttagtagcctcctgccgtgggtctttccccctggttcctggggaaaacactcatcagtccaaaacaacctgccttaaaatactcaacagtccgaaacaacctgcaaaactactgggagagtgcagtgtttgttttcaaaattaggacactaaaaataagcagaatgcatttcatttaagaaactcaatttatttaaaactacctattgtctccttcaagttccttagagttcattatgaatttgaaggcgtaactagtgtaagtatgataggataaatttagccaaaacctgaaaaaatcaagttaaaaggaatagttatgaattcttttaaaaataattttaaacattttggtatcagtattaattacatgctctaaattattcattgatactaattatgtagtacaaggaggtataattacttcaaggaatgtctgcagatgattatataaaaataatcttctaagctacatcctacgacactctcggaaggtttaagatttaaatagatactgagtcatgggtcacttaacgacaaggatatgttctgagaaatatgtccttagaagatttcaatgttgtgcacacatcatagagtgtccttacacaaagctagatggtagagcctaccatgctcctaggctatatggtatacccattcacacctgtgcagtgtgtcaccacactgaatactgtaggaaactgaaacatattggtaagtatagtgtatctaaacatatctaaacatagaaaaggtacagtaaaaatacagcataaaagattaaaaacggtccgcctgcatagggcactcactttgaatggagcttgcaggatagaagttgctcagcgtgagtcagtgattgaggggtgagtgaatgtgaaggcctaggacattactgtacgctactgtagacttcattaacactgaacacttcagctacactaaacttattttatttatttatttatttttgaggcagagtcttactctgttaccaggctggagtgcagtggcatgatctcggctcactgcaacctccgactccctggttcaagcgattctcctgcctcagcctcctgagtagctgggattacaggcacgtaccaccatgcccagctaatttttgtatttttagtagagacggggtttcaccatgttggccaggatggtctcgatcttctgaccttgtgatcctcccaacctcggcctcccaaagtgctaagattacaggcgtgagccaccaggcccggtccactaaacttattttttaaaattttctatcttcaacaaaaattaaccttagcttatgtaacatttttactttagaaagtttttatttttttccacatttttatccttgtgtaacacttagcttaaaacacaaatacattgtacagctgtacaaaaaaatttttatatccttatttacaagctttttaaatttttttttctttttaaacttttttgttaaaaactaagacacagacacacacattatcccaggcctgcacaaggtcaggatcatcaatatcactatcttccacctccacatcatatcccactggaaggtcctcaggggcaaaagcacgcatggagctgtcatctctatgataacaatgcctccttctcgataccttctgaaggacctgtctgaggttcttcctgagtaggttcatttataccaacatcaccacagacacctgcgtaatgcattgctctatggcagtaagacagctatgacagtgataggaaattttcagctgcataataatcgtatgggaccactgtcatatacactgtccatcattgaccaaaacgtcattatgtggtgcatgactgtattatctgacaatcagtgtaaacccaggataacattttaagcaagggctctttgtaaatctttctttagttccagatggcaggagatgatggtctcttatttactaccctaccagttatcaaacctacctgaaagtccttttcttcaagccagatattgttaatatctactgttcctagtttataaattgaactttatcataggtatgtacgtataggaagaaatagtacatatagggttcagtactatccgcggtttcgggcatccactgggggccttgccatgtatcccccatggagaaggggggatggttgtaaacagacagtttagacaaagaactcttccctagctagggacaaaagttacaaatgctttggtagtttttaattttctgctgaggcaggtaaaaaaatacaaagtctatccagagaaaatgccagttattttttttttgaaaagttttaatttttatagaggaaaagtgctttcagacattgcaaagatttttcaaaaaagaaatatcattgctcttattttgccaagaaaaattggaagacttcatcataggtcatatcaacatgttctgggtaacaaaatgctcagtcatacaaggctaaatatgtaagcagatctgctctaatcttaattatctgaaagctcaaaattactgataaaatataatttacaatgacatgagactctattgacatatatcactattaaagatcatgtttttaagatcaaatactattaaatcttaatttttgagtaattcttttacacactttgtccctatcaaagtatcttttattttgttctaaaattttaccaccacttccaatccatgacttctccatgacaaatgaataaatgaattggcgtgtttattttacaccatgctggagctcatgttttctctgatatttcacacaattacttcagatattagatgactttgtctgaccccaagtcaccatagattcgaaaggtctcagcagaaaaaagggaatttgcattagaatatttggtctcattaaaaactaagtcctccaagcatgccatctgatcatgcccagattccacagtgaacaaactataagaagctggggctggggtgggaaacagatgtgtgctttaatactttttctttctgacttcctcataattctacccagtcctcaataatcctaaaagaaaataaaggtttagaaaagtaaattcttgtaggattgtactttccttctaatttcccctctttatcagctaagagaaatacttctgtacttcaactcaggcatagaagtgttcccggaacaaactgagggttgggctgctatttcttgtggcccaataacaagatgcagatgaacaggggaggaagagagtttttatttctgccaccagttacaaggagaaggcctggaaattatcgctagaccaactcaaaattacaaagttttccagggcttatacacgttctaaactctctgtctaactgtaagtatgcattcatctaaacaaataagtgattaatttcttttaatctataactaagctctgagtcctgaagaccttcctctggagcctcagtaaatttacttaaattcagtgggtccaggtgctggggtgattacccttatctcgtctcctgttaaatcacggaggtttggggagctcttttggacccctaataaacttgtttgcagaggcctggggagtttcttcagacccccaataaaacttgtttaatcctaaatgggtcctgttaagaattccttcattatcttctcatgctttaaggcccacgaaaggcctatgcaagactcttggtgggcttttgttacattccagcctttgtataagggcactggctctctcagcttttaatatttaaccactcagtcagtgctgaaacagttgctatggaggcctatgttagtgagacctggcctgccacagaagggctatttaatacagatcatgtatgccagcatcatgaacctctgtcacctacaatctcctgactaaaggatgtggggtgggtttgggtatgcccccacctgcacagtaaggtgtactgtcctcattgttcattttcctaatgcccatcttatttaaaattactgttcatgcctttagtgatatttgtatataagaaagcatcaagttataccctagggaatctgtttggcattgaaggaaaaatcttgactttgatggcagatggaagttaatttggtggtcacctctcagctccttgtgaatactttccacattataaagtctgctcacagagaatgagcatccatggggcatacccatgggcacaaatgtctacaaatggggtggctgtgatgtctcagatcaagaccaaggtgtctgccagaatcctggggaaaggcttcgtggcgactgccaacatgcggctgcctccagccggtgccattcgtcctgcacatcagtgaatatttggccatttacaatggaacagtaaatatggaatagcacaattattattcagagcacagatttatcctacaaatggatttctcttgattgcgtaacatttaacagggaatatagtttccggagaaatcaaattcccctttccattgtccatttcaatttatccaaagctataatgtgctattggctatttaagacaaaaaaaagaggtatttttgaatatgaatcactcatttccctgtttaagctactgtcacatgatttcccaggtaggagatgaatgacgaataccaggcagaatccctaacaaagagtgtcctgaaggaaagagtagagagccacaagaattataataatccctcatttctaccagttggaggatgagaatgtatttcaagtgctcataaactgacataatttcatttggaattgccttttaatcaaaaaagaagagtatctttttatgtgttcattctgatccatagtatcgcatgatcatccttaaacaggaactcaatgaagtactttaatctgtgcatcgcacactaaaaggttcattgggtttttttgcctgaagcaagcagaataaaaagaacagagagaaattcagctgaggtcatattgggaatactcctttacaaggaaggaaaatgaaaaatcaagtacataacgggaaataaaccttgatgaggaaattatagcagatgaaagctgatcatctacagcaaacagggcaaaggtggttccaaaagcagatgtacaattaaataagcaaggctcagagatattgacccacagcctggctggactgcagcttggctccttacacacagtgggcattcctttgtctgatttgatgaaagtctcacttaacctcaaccgattaatatgcctctggccctgaaattatgtatctcgattatcaagccactggagacctgaggcttatttctacatttttctcttagctattttgataacaagcgccaaggatttatacagaaagttttgtcaaaactattctcagtctcagaaaatgtacagtgtttgctatgtgtgtatttaatacaaggctacaaaatgactttcaaagcccgatgcaacaagataaaagcagttcttacttcacatatgtggagggaacaggattttactataggaatttattcatactaatctcttaaaaatgtagattgtcagtgaaaaaaaaatgtaatgaatacccaggtgccaaatcctgtgagcactgggaagtgtggttttatgtgcccccaggggctgttgatcccattgcgggtggttctgagagcacacaaaagaaacccaccactggaggcagccccgatgagaagcctgcccaagggcaggggaaaagccatggcttctggctgaaggtaataaaaaaggcttccctgagaatgagctagttcatccaggccttgaaagtcaagtcatttcttttttttttgaggcagagtctcgctctgtcacccaggctggagtccaatggcgcgatctcagctcactgcaagctccgcctcctgggttcattccattctcctgcctcagcctccctagtagctgggactacaggcgcccgccaccatgcccggctaattttttgtatttttagtagagatacggtttcaccgtgttaggtaggatggtctcgatctcctgacctcatgatctgcccatcttgccctcccaaagtgctgggattacaggcatgaaccactgcgcccggccaaaagtcaagtcgtttctgacaggtcatttttaacaagtagtttttagagaagtaggagaaggcaatatttgttcattcagcattaaaaaaaaaatattttttagagatgcggtctcaccaggtggcctatactggcctcaaactcctggcctcacgggatcctcctgcctgagactgggattacaggtgtgagcctaggcaccctgcactgcaaacagttattaaatgcttactctgcacaagttactagagaatacaagagagaacacagggaatgatgaaagttccaccattcaggctggcctctaacatctctagagtctgaacaaaaggacaaatgggccccatccatctaaacagtgaaatctagtaaattaaactgtaaataaaatatgttctattctcctatcttgagaagcataccttcataatgataaaatgttaaaatggtagagtcatggtcatatatttatgatgatggaatagaatgttttgtttttttttttttgagacagagtctcgctgttgtcgcccaggctggagtgcaggggcactatgttggctcactgcaatccccacctcctgggttcaagcaattctcctgcctcagcctcctgagtagctgggattacaggcgcccaccaccacactcgactaatttttgtatttttagtagagatggattttgccatgttgcaggctggtctcaaactcctgacctcaggtgacccacctgcctcggcctcccaaagtgctggggtttcaggcattagccgccatgctcggcctattacccagttttgagatgtccttatgatgtgctgtgatggtagatgaataagaaaatcaagacacacataactcataaatgttcatctatatatttcataaaatttatcttttacctttttattaacaaaatcactaattgtgtgttcacagtcaaaattttccatgtaattttcttctgttgagggtaatgctaaaattagggcatctttcttgagtcactgtagtttatttcagtatagagaaatttcactctgctaagtcagcagcaactgtcaataaaattatttttaggcgatatttagactcagaaaaaatagattttccatatattaggttggtgcaaaagtaattgcggtttttgctattgctttcaatggaattagaaattctaaggacaggttgcaaataaaattatcattatcctaggataaaactacaatattttttaaatgtatcatatacatgagtatcacatgtattataaattacaccatctcttaaaaaaaatctgaattcaaccgggtgcagtggctcacccctgtcatcccagcactttgggaggccaaggtgggcagatcacttaaggtcaggagttcgagaccatcctgggcaacaaggcaaaataccatctctgcaaaacatacaaatattagctgggcaaggtggtgcgccggcagtctctgctactcatgaggctgaggtgggagaatggcttcagctcagcaggcagaagttgcagtgagtccagatagcatgattgcactacagactgggtgacacagtgagaccccatcacagaaaaaaaaaaaaaaggaaagaaagagaaagagagaaagaaaaagaaatgcctgaacccacacaatacttataaattttttcaaatttttctttgctgaaatatttcatagaaaacctatgattaagacatctcagtatataatggtgagaaaatagtatctatatacattagttttggaattatttgtacaggaagcttcatagtaatgcaaatatttccatttcctttttctaatgtccttatattttacagctatgttactttagatgtatcacatgaaatatctttcaatttagaaaaaaactttaaaaattattttattgtaattttttctctcacttcattatgcattaaaagataatttcatttttattttgccattctagatagttttaatttgtttttttttaatctgtactacatgttcagacattctagcttcaaattccaaaatcatgtcttctagacttagaaactatccactcttctcaagaaatgttggatagtcagtgtcaaaagaagcatcattatgtttggctaaaaagtggatattcgtatgtttagaacatcataccaaagttttatattggtgattacttctttttgtcaaatagtactaattgttttgctatttgttcataatttttcagttctagtcattgtatcaggtatacttttctctgatagtgatttttttttaatattcacttaatcaagaacctaagtgtttccatcacaaataacttcattgcccagaggtggtcttgaagattggctataaaacatgtaacagtagtaacaaggatatactatctttgaacttaaaataagggtcaattcctctagacttgttttccatccagtgaaaaattgcagtcattattctgaatcagattgttttctaaaagaaaacctcctgacatcgaggattgaaaggcaccctccaggatcagcttctgtaagacagcaggctccgcagtgcccatcatctgcacccgtggctggttctgggaggacagcgttccttgtctatcagctggcccagctgcctttgctgcttctaagctgggaattagatgggaacacttttgtgatttattcttgtgattttgatcagtatttcaacctttgcttagtaaaaaatataaactttcatggagtttatcagacctgattacctgggatatgacgagaaaaattttcttgctcatctccattgttatggccagtagcaaaagtctaaatcatctgcaatgtccaattggcttgtttttattactttgatcagtaactaaatctggaaaatgtgttttgtactctttgcaaattttatatgggtcatgcttgacagaagcctactctttctttcattgtttcaggaatttaaaaatgtaagcagattgcctctgaatgtctttggtttttttctgctgcttccgccccttttctgagctctatttttgtcttctatttctagccccatcttgacatgaacttattctaagtgatctaaagaaatttaaaaaatgtaattgtatccaaagactacaaaattagaatatattctcatgaaaataccaattaaatataaaaaactgaacatatttttcatgtactttgaaaagtttttttaataatataaactaccttaaaattaaaggcaaatgtaaataataatgtcaaattttaaattaaatgtattgaaattcaactaaaatctttttcttatgaagatttaattacatcttattaaatatttttacaaaagtaaagctatttgtaattaaactttcaaggtcttcctagtcaccagtggagtcaccacctcacacgtattatagctaaacatacatatatatgaatgtaagaatattgtgaatttaataataagatgaattgtctaatattccttagccaccatgtgcaagtatcacaaattccatgctaatgtatgagtaattcccgaccatatttggttcataaagaaatgcaaggaaatagatgttcaacactacatggaaaaaatactttgcaacaattagaatgctatttcaagctgagggaagggatttgacaagtgatatggttaagctttgtgtcccacccaaatctcatcttgaattataatccccataatccccatgtgtcaagggcgagacgtactggagataattggatcatggtagtggttttccttatgctgttcttgtgatagtgagttttcacgagatctgatggttttataaacgtttggtagttcctcccagatgcattctccttcctgccaccttgtgaagaaggtgccttcccttcaccttctgccatgactgtaagtttctgaggcctccccagtcatgcagaactgtgagtcaattaaacctctttcctttataaatcacccagtctcaggcaggtctctacagaagtgtaaaaatggactcatacagccagttaatgtgcttgtgctttctcttacctacaaatttccacagctctaatcctccctgagcaacaaagcagtgactctctccagtgttgccactgctactacctatgaatcttggcagatttggaaactcagtatcaccttttgttttgaggacaaagagcaagacatggggagaagcatttcctggggctggaatagaatggaccatgagaataggagtcagggtttcagggtgctctgtgccagcactgagtactggacctgatgtacagaggctcccaggggttctttgtttgcccccgcattggttgaagaaggtacctcatctactcagtcttgtgatgctctcccacagccactaagctctagccaacctcactgccctctttcagtctctgtccaaatttattcctgtcttagaattcacatctctgcttggctgcctcttctatctgaaagcgtcaatttaaatgccaccttctctggcaggccagccctgatgaagtttctaaataagttcatcccccaccaccagtgccccctcactgcactccgcttcctgcataggacgtctcagaatttgcactctgtatttaatcattttctcttgattatctatgtccccgatttgagtgtgagagccacagggagggccatgaagcactctgaccagcacaaaataggcacgccctaaatactggagggagagagagagtaggagagcagagaatcctcctcaggcaagaatgactgatggattagttctccatttaaaaatacttccagagatgaccattcctttgtcatgctttaagagctgtgctgcaagaaactaaatagcaataagcaagaagaacacaaattacattgttcttatacttgactgaacgtcaaaggagccaagttccccacctgctccagtttcctagacagatgtctgaacatttaatttaacgtgggtcttcatttcctgcccagtgaaatatcttgcttggtgacagggttgttacaaggatgaattggccaaggcaatgccctcggggcacctaacagtcctcagtaaatcctgctgacctcagccgccccaaaagttcaggtgctgtttcttgagggtccacttaaggcccctctctaacttctctatcagttctgaggctactcttctccaggtaaaggaagaaactcgaattccctaataattagctcagaacccaagctacccttgttggaatttatattttataaacaaaaatgtattttcatatgttaaaactcggaagtccatcaaaaactgattgtctgtcaagactaatttggaaatctctcattcttaacaagtttaaagagtaaaagtatatattaatacttacacaagtacaagttaagtttcacacttgattgcctaactccacattctagctggtgtttagtctaagatgctagaccagtaggaaggaataagagagttagtgaggttagtaaagctcacaaagtagtatggtttactaggcttaattaaaaaaaaaaaagctattgtgaaattacaatgagtagcattgtgttctaaataaatattcagagcacagaaataaaatgaatcctcccttggaaatttgtcagagtgtgagacaaacatgtacactgacttactcatttactcaaatgcaaattttgctgtttgatgaagtgcttgaactttctaactccatgtatgtattgcaatgagatttagatcaccttctatttgaatagcacatcatttataaagcagtttttaaaataatatgaactggtggcattttaaaactttagcatttaacatccactatttgtaccagcaaagagtgcccatagtcataatcatgcgtgcacattgggattccaaagtaactttgaaattccctttgtctctttataacagtaatacttgtgtgctttagttcatggtgaaatccctgttcccagccaggttcatggttagcctgaaggaaatcacttaaactttttttttttttttttttttttttttttttgagacggagtctcgctctgtcgcccaggctggagtgcagtggcgcgatctcagctcactgcaagctccgcctcccgggttcacgccattctcctgcctcagcctccggagtagctggttcgacaggcgcccgccacaacgcccggctaatttttttttttttttttttttgtatttttagtagagacggggtttcaccatgttagccaggatggtctcgaactgctgacctcgtgatccgcccgcctcggcctcccaaagtgctaggattacaggcgtgagccaccgcggccggcctgaaatcacttaaactgtttagtatctccttgaactgaatgagaggcattacttgatatttacaaacagcagggttctccaaaatcccatggcatttgctgagaatgtattatgaagaacatttcctagaagctaacagctctcttcctgatacttgctaacctgatggctttggttttactcatctgtaaaacgggatgagaaataatttctgctataagggattattttgaggattaaatgagactgtattcatgaatttcttagctcatatccagtgctcaataactgtcagccattattttattattacccctgataaatattaaggctatgcctcaccgtatttatgtatgcatatacaaacatgtataatatgcatatataacgtatatttacaacaaaaagctaagatttaaagctcttaatagatttgctcatgtcagagttaaaatttaaaccagggttttctggtattctttttcaaaatgtacttccacctgtgatgactgtacttaccttatctgaaatatttcacttactttagtgcctctaaagtttgttgtctgagaaaaggtattccaaagatgcttagtgaaaaaaataaatataacagaaaatttcaccttatttaaatcatttcacttgctagattaaaattctcttttaaacctaacactcataatgtattgcatgcccacacactaatttttaaataagtgtgcattttttggaagctgtgaaatgtttctatactctgcagagcaactggaagatacagaatcttagagtgtaggattaacagagaacatgggaaataaaagtaaagcatatctgagaataaaacaatgagtaaataggactctgcttttaagatttatttctgtataacttcaaaggcatacatccattgaataaatgagctggaagaaatgaggactagagctctgattttttttatcttgcctaaattcttatctaaggggcctggggagtcatgccctacaaaccataaattctcaccagatacatattgtgacttacttttcaatctgcctctggcataacattatgagacaaggaaaaaatatttaaccccaaaatatatttccttgccataccttgaaattatcctgcaaagtctcttgtgggaaaaatccacattctatagagaatccccttccccctttgtattccttccttccttcctagatccaggagataatcaactaagagccaggcaagcttttaagtccaataagaaacagttcacaacctgctgctctctctgaagtctgctatctgagagcttcctctgcacaataaaacatggtctccacaatcctttatctttaacctgaacattcctttctattgatcccaggtctttagacaaactcaactaattgtcaaccagacaatatttaaatttacctatagcctgaaagctcccactttgagttgtcccacctttctgaaccaaaccaatgtatttattaaatgtatttgattgatgtctcatgtcttcctaagatatatgaaacaaagaggtaccccgaccaccttgggcacatgttctcaggacctcccgagggctgtgtcacgggccatcgtcactcatatttggctcagaataaatcacttaaaatcattttacagagtttgactcttttcatcaccagaagctatatagataatcaaccccagtctctcatctttcaaatgagaaaacaagccaaagggaaaaaagaagtataacagctttcttgagatatactttgcataaaatttatctatttaaaatgtacaattcagtggtttctagcatattgacatagttgtacaaccatcaccaccacctaagtttagaatatttccaacaccccataaagaaactccatatccattagcagtaattcccccattatcccttatacccagccccagaaaatcactaacctgcttttctgtctctgtcatttgtctattccagatatttatataaatgatatcatagaatatgcagcgttttgtgactggcttctttcacttagcaaaaatgttttcaaatatcatccatgttgtcgtgcatgtatatatataagaaacctgcacattgtgcacatgtaccctagaacttaaagtattaaaaaaaaaaaaaagaaccaaaatggcggagtatgaccttcctggggcattcaactggaaaagggacgaagccccaggcaagcaagcgccagactccagtaaacacactgtgcatgctcacctcccaggtgtcagtaggccactgcacatgctggcaggtcaccctaagggaagaatcaaggaaaaagggacgcaggaccccagaagtatgccaacatatagcaccctaagtcaaaggtcaaatgccgcacttgacctccaggatgcccacttgggcctcttccaagtgtactttcctttctttcgttcccgctctaaagctttttaataaacttccattcctgctctgaaaaaaaaaatttattcctgaatattttatacttttatgctattatgaatgaaattttctaattgttcaccacaagtacatacaaataaaattgctttgtgtatattgacctccaaaaaaaattatccatgttgtagcatgaattaatacgtactactttttattgccaaatcatatttcctcctcttcaattttttggaaaaatctgtgaagaattgttaattatcctttaaatgtatggtagaattcttcagcgaagtcacctggacctgggatatagctatgagaatttttaaaattactaatttaatccctttacttgttatagatatatccactcagattttctaatacttcttaagtctgttttggtagtttgtgcctttctaggaatttgttcatctcatctcgattatctaatttgttcatcatattgccttataatcccttttatttctataatttcagaaataatgtcctctctttattcctgactctagtaatttgtagtaatttgagtcttttctctatctcctttttggtctagctaaagatttgtcaattttttgacctttttaaagagcaagcttttttggttttgttgattttgtctatttttctctagtctctacttcatttatttcagctttgaactttatgatttctttcattctgcttgctttgggttcagtttgcctttctttttctagttttttttttttaagtgaaagtttatttatttgatgtcttttttttttaatatgggcatttacaactccaaatatctctctggccatgactgcagctccaccctataagtgttgttatgtttttactttcattcatcttaaagtattttctaatttccattaatatttcttctctgaatcattgtttatttagatgtgttttgcttaatttccacataattgttaattcccccatttaccttctattattgatttcaaattctattccaggtagttagagatcatactttacatttgtattatttcagtcctttttaatttagtgaggcttgttatatgggctaccatatgaactatcctagagcatgttttatgtgcactgagaaaaatgtgtaccctgctgtagctgaatggtgcattacatagatgtctgttaggtctagctgcgttatggtgttgttcaagttttctatttacttgatcttctgcttagttactctatccattattgaagtattgaagtttccaactattactgttgaattgtcttcagtttaatctgtttttgttgcatgtgttttggggctctgttattgagtgcatatataattattgtgtctttctgatgaactaaccatttcattattttaaaacagtctcctttgtctctagcataaatttgtcttcaattgtatgttgtctgatattactacagccactacagttctctgttggttactacttgcacggttgatatggtttggctgtgtctcacccaaatctcatcttgaattgtagctcccataattcccacatgttgtgggagggacccagtgggagataattgaaccatgggggcggtttcccccttactgttctcgtggtagttaataagtctcatgagatctgatggtcttataaggtgaaatccctttggcttggatctcattctctttgcctgccaccatgtaagacatgcttttcaccttctgacatgattatgaggcctccccagccacgcagaactgtgagtccattaaatctctttttgtttataaattacccagtctcgggtatgtctttatcagcagcatgaaaactgactaatacaacactatttcattcttttcctttcaacttatttgtgtctttgaagccaaagtgtgtctcattaatacaatatagttggttcatgctttttaatgcattctgccaatctctgccttttaattaaatgtttaatccatttgtattactaattaacacaactattaataaggtggaattatattaatttgtatcatatttcattaatattattataaataaagataaggtgggatttacatcttccatttactttttgttttctatatttatatctttttgttcctctatttctccattactgcctacttctttgttaaatcaaaattctctactgtagcattttaattcccctgtttattcttttttttttttgagatggagtctcactctatcccccaggctggagtgcagtggtgcgatttcagctcactgcaagctccgcctcccgggttcacaccattctcctgcctcagcctcccacgtagctggcactacaggcgcccgccaccatgcccgcctaattttttgtattttttagtagagacgggatttcagcatgttggtctcaatctcctgacctcgtgatccacctgccttggcctcccaaagtgctgggatgacaggcgtgagccaccgagctgtttattcttttactatatttttggagctgttttcttagggattacagttaacattttaaacaactcgtttgcattaataccaccttagttttaatagtatagaaaaaattttgctctacagctctgttcccttcccactcttctatattactattgtcatgcaaatttcacctctgtatttttaaaatccatcaacagcattttgtcattattattttatccagttttcttttaaatcagaagaaacaagttactagcaaaaataaatttacacttttacctatgtagtatactttgcagtgctttttctttgtatgtatttgaagaactagttagggtcctttatttcagcctaaaaaattcactttatcatatctcatagagcaggtctgctagtgattaatcctctccatatctgtttatctgggaatgtcttaattttccttcacttttggaggataactttgctggatatgcaattgttgtttgacagtcattttctttctacgctttgagtatgtcatcccactgcctgaagtctccatggtttataatgagaaatcagctattagttttattgaggattactttatttgtgatgcatcttttttttaaaaaaaaaagatgtcttcaacagattgattatggtctttctagggatggatcgctgagtttatcctacttggagttcattgaacttgtttgatgtgtataattgttttccatcaaattttggaatttgctggaattatttctttaaatattctttccgtccccttctctccctcatctccttttagaactatgatcatgtgtatgttggtgcccttgatggtaccccatggagctttttagattctcttcatttttcttcacactttttaaataatttatacctctattgatgttttctatttggttagacatcattcctatgtctgtccttctattctttagatataatttcctttagttcttggaacatatttataacagctgatttaaaatctttatctagttagtccaacatctgagttttcttatggatagtttctattgattacttttcctatgcttgagctatactttcctctttcctatatatgttcctctttgcctttctctctgtctctccccctctttcttctaccctcctcctttctctgtgaaaactgaacatttaacataatataataaggcaacttttaaaatctgaaccccttcctagttttcatgtttttgctgcttgattagtgattttcttgagtgagttttgtaaagtctgtattctttgtcatgcgaggccactgaagtttctactcagttagctaattgttagttagctaattattagacagagatttccttaaacaccttgaaccaatcagtctcccatgctttgttcaggggctgtatatgtatgtgtcctgaggcatgccttcaacactctgaaagcttactactatgccttagtcttcacttcctgttttgcagggcctcaaaggtcacctacagatactcttttcaaatctttactgcatatttgcatggtcttctagatcccctggaatatgtcagataaacatgttttaaaagcctgctacaggtgtttcgttttctagattttccttttaagatttttggccgtcctcttgtttgccctaacttgtatcactgccagggcaactttgatatattaaacaattgctgctgatgttttcaaccaaagccctgaggataacacgttacagagataattatgagtcaagtcaagtcaagacatttgtgaatctgaattttccaaaaagtttccagatagaacaaataatgacaatcattgttctttgtttaggatctccaaacctgttctttcctcttagtggtttctaggctcctgattttcagagttaccatggctgtgaagctgttggttttcaagagtactgcggagctggggtgaaaatgaaggggatcagctaagttaaaacatcacaaagcagtgaacaaagctcacgattcttactgagattcagtcactttgtataaatgttccttcaactgttgaaaacctttagttaatttccagacttatgattatttttaatttattttgtcagattttatcagtgtttttttttttttgtttttgcttttgtggagaagtggatttttgaaagtccttgctctgccattccaaaagtgtttcctctggccaagagaatttaactgacttgttcaaggtaaacagctagttgataattaaggctttatatgaacagagttttatgtcaaatttggtgacctttctgctataataggggtaaataaattataggaagttaacttcattatattcaagtttatatatgagtgaaacttctgggaaaaaataactcatgagaaaactcatgatgtcaataacaatcaagttccaaattttcagataattatattaatacagggctagaacagctttctcagcattcaaaacaagccatgaataatttaaagaaaaaaaggaaaaggaacttgtgagctctaagctgggttgaatcatttatatgcagatatgtgcacacacactcacattataactacaaaacacagaagtgtggtatgtccaacaaccaccattctatgtattataaattaggccaaaacagaatgaataagaatgcacattggccaggcatggtggcttacgcctgtaatcccagcactttgggaggccaaggtgggcggatcacgaggtcaggagatcgagactatcctggctaacacagtgaaaccccgtctctactaaaaataaaaaatgaaaaaaattagctgggagtggtggttggcacctgtagtcccagctactcaggaggctgaggcaggagaatggcgtgaacccgggaggcagagcttgcagcgagctgagtttgctccactgcactccagcctgggcaacagagcgagactccgtctcaaaaaagaatgtgcatcactgacagaggaattgtggaatgaactgcacattttctatttgagtcatatcaaagtcattccaccatttattaatggtttactatgtgcccagcagttcatatgggaagatatgctaactgctcctcagaatttgtagttgagacccagaatcagatgaagactcagccagccctgcatccactctcataaaactggtccagtagttaccattactccaaaatgctgctcaaatattggaaaagcttgaagaattcaaatctctgccaactctgggctcctgccacctgtctctactcttactccaactcatgatgggattaacctttagcttgttttccacttctggatttgtggctgagtagactttattctggttcatgatatttggtagttgaagctgccttcacaactattagccccagtttctgatttgtcattcttcaatgatgcccttttttcctgtgatacatgttttgacatgtaatcatagatatttcacactaaaagaaacttagaaccaccatgccttagaactgaaactgaaagctaatctgattaggctcaccaatcttgacctgccttgcttgttcttagtcacttgcttttagttgattttaaaaaccatatagctaaaagtcatgtagctaaacaatatataactaaactcccaccatctttcttatagacggtatctctgatgcataggtcaccatggaaatgtttgcttaaggtgttttccaggaacttggagtcagctcttgtccagttcaagctagctgagaccactgacccttcaactggacctgagtgaatgtccaatgggtgactttttgaggtcagagggccaaaatctccaccctcagatcatggtaatgctattttgtgaacatgcatcccatgaagagctatgacgcttgactacattcgcacagatcactcattacctcatttttccttatacccaatcacctttccccatgcttcagaccaccttgctcctctatcccataaatgtccctaaaacaccatctccaaggagacagatttgagagctgttctcccatctcctcacttagctgccttgtgaataaaatcttttctccactgcaaacttgtcatgtcagcaattggcttactgtgcaacaggcagaatgagcctggttttgtacagaaccacacacaccattctttcaacaagctatgactgaatagctatgatcaaagtgaaaaagacagtcttggccttcatggagctaatagtaaagcaaaaacggggctccaagaacactggtttagctggaggggctcagcatggggacggaggtgtccaaacttctgctctgaaggagttttttcctccggttttttgcttgttacagaatgtaactagcttttctccccattggtccatgagtccaggaagaaacagtctttatataatcctttccatgtctcctgctgtctcctcctgtctcttgatcagaatgcacaggccttcggcaggatctgagatgtcaactactcatctaatttaaagtcaaaacaggtacaccatagttctaaaccaggaaaatcactcttatatcaccagtgagatagatgtcttcatagcaaattaaggtggagagaatgaacatgttaaagttgggagaaatatttcaggataccttggggcagtgagccgtgtggtgcccgctctcaatgatggatggagccgcttggcaggcagctatcagagggagagcagctcttcatgtacaagacataaacatctctccaacagtgaccactactgcacaccacaccatcttcccacaaaaggaaagtgctgttcccaccagccatcacagacacatggacggcagcagcagcgatggcagaatcttggaatcctaaagacaatgacacacattccaaagcatgctgctatcagtcttgtctctggaagccaaaaacaacagcaaaactgaagagtgttttaaaatcatggacctacagtttgattttcaaaaatatgtccaaaataaaaatatgtccagccaaattcaccaagtgacacaagaaacattctgtgctcctgataaatctcaacaccacagagaacgttaagggaacgtttcaaaacaaacaaagccaatccacagcagtcctatatgacaaacttcagcaaacaaagattacacttatccattcatttacagcaaacattgaattagagttataaagagtacactttactatctacaccagaagcttataatttagaggaaaaataaacatttaaattatgaataatgacacagtctacccactgtaatcctcacatggcccgcggtgacacgcaaagtgccctttggtgtgtcacggatggctcctgaccctgctccctgaccagcagtccttcagatgccaaagacccctatccttgggggcaagtaaggaaagacgaccctgcaagtatgtcacttgcttttggggtagtccttgagcacagaatagagacagagacagagagaaaaagaaaaagaaagacagaagcagggaaagtcagagaacaataaaaaagagacaaaagagagaaacagagaaacagaaagagagacagacagaaagagacagagagacagagagaaagagacagggctcttctacctggaagcagctaagcatgaagtttctggaccaggcggtgctgcctgtgggtggcaagtgctcccttgattccacacctcagctactggtccacacacgtggttcctctgcctccctctcctccagctgtggcactgatatatatctgcgaggttctctgacacaacacgattccccagaaagcaaaagtatccagccagaaaagagagagtgggtcatgtgaggaggtgtggtccagtggagcagctgggagggtccactgtggccccctcttcctccatgcccacaccaccccttggtgtctctccctctcctgctcacctcgtaggttactcaccccgcacaccatgtctcaccttcctcctgtttcccactctctttgatgaaccagcagcactgcctggctctgggtctctctctctctctctctgtctctgtctctctctttctctctctctctatatacacacacacacacacacacacacacatatacagctgctccgatgggtcacacctccttgcatgccccactctctcttttctggctggatacctgtgctttctggggaaatcgtgtggtgtcagagaaccttgtggactttcaggatccaatttattttttcagaagaagattctgataaactattttgagggtgggtgggagagcctggagccagggtggcctaagctcgtctaggcagacctcaagcagctactgtggtcatcagcaagctgggcagagcagggagacacaggaaccaccaggccaggtcagccctgaggactccaggaaggttctgggggaattcgttcagagcagggggaggctgaggatcctaagttcgggactgatcttattttgccttcaggctggggtgacccagtgtctctagggttgtatgaagtctgtgtggaaggtgggaaggaggaagaggctgaagacatggggctgagacaaggtagcatgggtctgtcctgcaaaggtcaggggcagagttaatgaagttagagtcaccatagaaccaagaggaccagggaaccaactacagggagtgccacaggagtgtcttggagggtccaacttggaaaattgaggggcactgaccccattaaaggcaaaagcaagacaactacacaaggcattcactgcacactaatgtgcctgctatggttccaggtaaattacacacacctacttcaacacttatagcaacacaactgtgatctagagtttcaaagatagatgtagcctggaatatgaagagaaagggctaaaatagtttggaataaagagggtcagaaatagcaggatgataataggatgaactatggatatatgcaaacccacacatttgaaaacaaaagcactagctaacatttgactatttgctctatgtcaaacgccatgcttagcctttacatatatcatttaatcctcatgacaaacaaggaggtaagtagttttcttaccctcctgcccacgcttcttttttaaaaaatcatattcaaggtcagtgctagtaaggcagggagccagccacagcttctgcctctagagcatgacgtgggaagcatcacattacagccattctttcactcagccacaggacacagacacaggcttctgtggaccctctgggagaagaaggggctgtaagacagtctcactgcataatgctactaatgagcagggagggacatcatagtgcagagaaacagactcagggtgaactagacaccaaaaaggaagaccaatagcccaaacaccttctagaattccacgaccaccttctagaatttgttcccaagcttccatctcaggaaacaagaagggcaacccagatttatttttgtactgggactcctctttagaagtcaaatgaagtcaaattactttgctacagttttacaatgctagttacttttattcacatttattaagtttaacattctgctaagaaacaatgttttcaaactttcacattgaaaagtccttccttaattaagcatatacaatttaccattttcagcagtaatccatttgcacaactaattcctcaagattattccactgaactgaatctttatgtgtaatgtacaaaaaactgatttgtagcctttctttctttcatgaaatactagcttaaacattagcactgctatggggattaagattcagaaaatcttagggacatgtaaattgagataatgaaaagatagttaatatgtagaatagaattttaaatgagcattaaatactaattgtaagtgtaatttcagcactttgaaatgaatgtttttattcagtctaatttagaagaaagtcatttaagtaaaattctgcaattttaactgtttaatggtagttgaaacaacagaattctttcattttataatattcaaaactttaagtgactgtttaaactgtgatttgcattctgtttctgctactgtttgaggcgaatatcaaaacagttctccccacttaaaagcaataatgttgcacctcctaaaattaaaaggaatgtaacttccaatagtactcactagttaataaaatattttttactaactatcatttttaaaggctattctttattgctttccagagaagtatgctcagtgttactttttctaaattgtccatggttaggaagattaaaatattaacaactttagattgagtaggtgtttaatttaaccatgtaaaccttctgactatgtaagttcacaaaagaggcttaaaaaggtaaattagggggctgagcacagtggctcatgcctgtaatcctagcactttgggaggctgaggcgggtggatcatgaagtcaggagatcgagaccatcctgggtaacacagtgaaaccctgtctctactaaaaatacaaaaaattagccaggcatggtggtgggtgcctgtagtcccagcaacttgggaggctgaggcaggagaatggtgtgaacccaggaggcagagcttgcagtgagctgagatcacgccactgcactccagcctgggagacaaagggagactccatctcaaaaacaataataaaaataaaaataaaaaataattcccctatgttgttttataaagtttacataaaatgtcaagaaaaatacatttaatatcataatacattttcaatcctcagatacatgatacattttaaagttattgtgaaattttactctgcatagaattcacacagtcaagaggtttctgaaagtctatggtaacagaatgatttatttccttctaaaattaaatatgtacctaagtataatgtagtgggttttgttctcccattaaatacattgaacatatatttatacaattgttattcacttaggtaggttgcttattaattactatctatccacccacaaaggccattattacaaatttataggctgatctgattactaaaataagaagactcagtagtttaagagtgaaaacaaagctaatgaaattttgcattccccaaagagaagaagctatgtagagaataagcagaaaatcagttgtcttaatatttattaactttatcatgaaattaatcaaaaataccaaaaccaacttaaatggctcgttatattgccattccaatgggtaacattttcaagtccacatggaatacatttctctgattctctacagggttcatcagtgtcaccctgtgttgcgggaagtcaaggaccttgaacggagggactagctgaagccatggcagaagaacataaattgtgaagatttcatgggcatttattagttccccaaattaatacttttataatttcttatgcctgcctttactgcaatctctgaacataaattgtgaagatttcatggacatttatcacttccccaatcaatactcttgtgatttcctatacctgtctttactttaatctcttaatcccatcatcttcataagctgaggatgaatatcacctcaggaccctgtgatgattgcattaactgcacaaattgtttaaacaatttgaaagctgggcaccttgaaaaaagaacaggataacagcgatgttcagggaacaagggagataactatgaggtctggctgcctgagagcagggtggaacagagccatatttctcttctttcaaaagcaaataggagaaatatcgctgaattctttttctcagcaaggaacatccctgagaaagagaatgcgttcccaaggggaggtctctaaaatggccactttaggaacggctgtcttttacagttgtgtaaggaacgaaataagccccggtctcctgtagcgctcccaggcttattaggacgaagaaattcccgcctaataaattttggtcagactggttgtctgctctcaaaccctgtctcctgataagatgttatcaatgacaatgcgtgcccaaaacttcattagcaattttaattttgccccagtcctgtggtcctatgatctcgccctgcctccatttgccttgtgatattttatcaccttgtgaagcatgtgatctctgtgacccacaccctattcgtatactccctccccttttgaaaatcactaataaaaacttgctggttttgcgggttggggggcatcacagaacctgccgacatgtgatgtctgccccggacacccagctttaaaatttccctcttttgtactctttccatttatttctcaggccagccgacacttagagaaatagaaaagaacctacgtgaaatagcattgaattatcgggggctggtttcccccaataaccctgacaaagtctctatccttgactaaaccttatacaggctcctctaaccccctcttctcaatgaggccttgacctggcaccttgcttttggtctgctagtccagtggtagcaagaatactgttaagttgtattttttagcaagaattcctcccacccttgatgtaccctcttaagtcattttccatccaatgattccctcattctgcttgctgggtgtaattccccagctgtcctgactgtatttaaagtagagccccacctctttcccctcctgcaatggtcttgacatgtatcacaatagtcctaaataattttttctttaactctctcccttctgttttgttctggttttaatgctgtttattagcctaggaacaaatgtagacatagacagtccacaacagatggcccctctacaccttacagctggcaacttatgatacgtcactatgggtttacaaaagtccagattcaaacttccaatattttcatattaaagtaaaagcaaagcaagtatacaaagtaaaatgctttagctactcatttcctatatgatgtcttacagccacatgcccatttaatatatgcaaaatgggtgatagtctctaaaacctgttaaatatcactgcttcctcccatggtgggaatacgagttccaatcttccaacattgacccagtagggtgactgtggcaagtcgcttaatgcctctaagcctgcttccacatccccaaagtaggaataacattattatctaccttataagatggctgcgataattaaatgtgtcaatacacaccaagtgcttgggatgacacttggaatgcaagaattcttaatcaacataaactgcacaaaaataaatcagaacaagaaagtgaaaccatagctgccactgggtaccaactgccagataaaatatcaaaatcagccattcacagaaagtggtccacttattttccaagtttatgttcagttctcaagtttcggttcagtgaatttttaacacaaatttagtcagtaccaagtacacagccttcatgaagtcaactggatgtcataagttattctttggtgtcagccaggcaaggtgtctcattgcctgtaatcccagcactttgggaggccaagatgggcagatcacctgaggtcaggagtctgagaccaccctggccaacatggcgaaaccctgtctctactaaaaatacaaaaattagccaggcgtggtagtgggcgcctgtaatcccagctactcaagaggctgaggcaggagaatcgcatgaacccgggaggcggaggttgcaatgagacgagattgtggcactgcactccagcctgggagacaagagcaaaactccatctcaaaaacaaaacaaaacaacaacaacaaaaaagttattctttggtgtgtattggaaaatacaaaaggaacagaaatatagagccagggatgaaagccatagatactagcaaatgctcacaagctcaagacctgaagtaaatacttatcaattggccgggtgtggtggctcacgcctgtgatcccagcactttggaaagcagaggcgagtatatcacaaggtcaggagatcgagaccatcctggctaacacaatgaaacccctactaaaaatgaagctgaggcaggagaatggtgtgaacccaggaggtggagcttgcagtgagccgagatcgcgccacttgcaccccagcctgggtgacagagcaagaatctgtctcaaaaaaaaaatcaataaattaataaataaacaaaaccagtgagaccttgtattccttcacaaaagatttttcactactatgaaattcatgacggtgactttggagggtgactactgggaagttctttcctgtctcccacacggcaggctatgtttcttaactcaacctatgtaatatcctcatcactcctctccacacacattttttaagacataattcgctaatagagtggttactatggatcaggagctcttgagggatgtgatgctcattatttatttcctactcacaacttttccagtgagatattattattattacagaagaagatacaggctccaagagactgcacatgttgcccaaaatgacaggactggaaagtggcagagccatgatccaagctcaagtcagctagacttaacatccagctcgttcttctctgctttggagcctcccacgctttcacttttaaatgaaagataatgataattcttaaaataactgctatgtcttctttttggcattccaattgctgccagaagctatattttatttctgattcagttcttgcgagtattcttcctttccaacagtatgctcttttactttctaaagaacacactgaattttgctatttacagttctgagatttaaaaactgacaatctaggaggaacttttatgttgctgatgacttttcactggatcttgacttttttccacttcagggatatcaccctgacctggctctcataggattatgaaacactatatccactgataaccataaacaaagaaacatgttaaaataaatgaccactaatgaaaagggggtagagtagaaaagataatactgtagtgagactatgcatagatattaacattttatgtttataggttgatagcttcccatcagtacacaagctctgtgtgattaaaacatgccctcctcccctatgcacctcatcaaccagtttccaagtgtcctctaggccaaggctgtgtgcaagggaaggccacacatatcatgatctgacggcgaggcgaagtccctgtgggcacctatgtgagtttccagggtatctgagtgagaactgccatccaatccaaacaacctgtcacaaaaatcccagatgtcgggaacccctgacagtaagagtgaggaaaggaatcaaaacaggcccagtggagatggcacagtacagtcatgcagggcacagagaggaggggatggggctgacactgagaactggcccattacctggagaaagcctgtgcccagagaagttaggcccaggcagcagaaagaaaggatgagcagagacagggagtgctgatggcacgcagctcccagttctggtccaccaagtatgtgtgcccataaattctatctcatggattccgctctgacaattgtgcatgttcttggtaaccagaaggctgccacataatagttggctgtcttcatcccttttcagctgtgacaatgatagcagcacaacttaggtcaaatataatcacacacaaacacaaggcaggcagggacatcacttgcaggctgtaagggggcatctcaagcctggcttttcaaagcactgttcccacactcacactgtagtcaccagacagcttgttagaaacgcagagcctcagcctggtgtggtggctcatgcctgtaatcccagcactttgggaggctgaggtgtgtggatcacctgaggtcagtagttcaagaccagcctggccatcatgggaaatcccatatctgctaaaaatacaaaaattagctgggcgtgatggcaggtgtctgtaatcccaaactactgaggaggctgaggcaggagaatcacttgaattcaggaggtagaggttgcagtgagccaggatcacgctgctgcacttcagcccaggcaatacagtgaaactctgtcttaaaaaaaaagaagtgcagagcctcaggccctcctaggacctgctgattccaaacaggctgtataacccagtgatttgcatgcacaataaagtttgagggacactaatgtagatagctgaaaatgccaccaaaatgaaataatatatattttctcaaagaaaattctcagacacccaaaaatacatatgtaaattcccatatgggtttccaagaaccccaggtcaagaaacactgttctaggagacagtgcgcatacttgtttatcctacaatgagaaacctttaaaactcatggatggggagtttctcagtcagtttgggctgctgtaataaactactaccatacgctgagtagcttataaacgcatcttacagtgtcttcaaataatggatagctgagggagctctctggggcctctttctttttctttttcttttcttttcttttttttttttttttttttttgagatggagtttcactcttgtcacccaggctggagtgctgtggcgcgatctcagctcattgcaacctccgtctcccaggttcaagggattctcctgcctcagcttcccgagtagctggaattacaggtgtgcacaaccatgcctggctaatttttgtatttttagtagagacagggtcttgccatgttggccaggctggtctcgaactcctgacctcaggtgatccacctgcctcggcctcccagggtgctgggattacaggtgtgaaccactgcacctggcctctggggcctctttcatagaacaccaaccccattcatgagggttccacctttatgacctaatgagacctccatcttcatgacctaatcatttcccagaggacctgccgatactaacacattggggttaggattttaacacatgaattttgggtgtcacaaaaacttaggggtctacagcacataggttaaataaaatatttatattataggcatgcattgtggaaaggagacctctataaatcagaaggctgtttcctttgtgacgaatgttttctacagtgaaaaagcggagaggaagcatgcagcctcttatttctctgactttgtgtgccttgtgtagatgcttggcgcacatgcatgcatgtggccttgatttgctattttctgccatgttgtttgcaagtgttaaagaatgagtaaacttgcagccatcataaaagagctgctgattcaaatggctttgggctgcgaagtcaccatcagctgggacttcacaatgcatggagatacatcagctttctgggaacacctcagttttcccgtggctcttcgtccagttgtagggtttggtctcttgatattgattcactttacaatttttctgatttttactttcttctactcataaccttccttttagtggaaactcttcagtggcataactgcattcacataaaacatgtttcctgggctcctaccctgccagagacaggaaaaggccaaggaaaatatgttaccacaggggagaaacagggtggtccagcctggcaagaggtgcctgatatctgctgctcacatgagctcacgaactcattgatccttgctattcaatatccatttccagatattatcctctgatgtcataatccaatccagagcaagaaaagcaaaagccctcttggaacacaggcacatgtgcactctcaccgccagctttggccaaggctgctcctgcccagaataccgccccatcctcctcatggtgacttccagttcatccttagctatggcctcctcaccacatgtgttcaaatgacctgctgctacacagttaaccacagtgtaggtcaggaatttggacaaaacacagtagggtggctgttctctgcccattggtgtctaggggctcagatgataagaaggaaagactgacctcacaggaccattgccaggagtgcccacccacagcctccgggggctggactcttacaaggggcctactgctccaggagtgagtgttccagcaaatagagcagtgttgcctggccttcagagatgccttgggcttcccccttattgtgtggattaaagcagtcacagcacctccaggttcaaggagaagggcttagctccaagctcaagggaaagagggtcaaagaatcagccaccatgtttcaaagccaccaagaaagagaagtgttgaatccttaaatatcaggataaatgcttctcctatcagttccctcctatggcaggactaatcacagcctttggaaggtgtttactctcattctccatagactatcagctccttaaataacttattcatcatcttctgcctaattattgctacagtgcagggcacatagtagtcactgataaaatatttgttgaacaaattgttccacacaagaatacttacagatgcttcttaatctcttctcatatgtattgacttacactgaataatctgtctagcatattctcactcctttatggcgtgctaaatacaaggaagaatttcagtctatgaggcatggcttccaaccaacgtctccaagtcatggtacttatcatgaagccaagttatctaacaacaatcttctggggttaacataaccttatcccataaaatttctcttataggcagaaaattcactttagtggcttatgaatgtcctgaatatgtcagactgtttccttactgagcattccctctgtattcaatttaagaaacatgacaatctgcgattttaatattaataaagcaaattgacttacaaaaagtgtacagcattcatgcatccacagtagctaatggcttaggcaataggcaatatccagacatgcatacaattgtataaaatttgagttaaaatgtattattgcataattatgagaatagcttcctcctgggtaaaaagtgtcaagatgggttaaaaatcagtgccgttttacttggagaccacattattccagtttcttttgctacaggataaattgctaagttgtaagcaattggtgccttgaaaccagctggcatcacgtagctgtgcacaacccaaacaccatcaagtgaagtgctttattatgtccaccaggatgtatgcacagcccgaagtgcctgcaactactggacactgcagaaaacctccttctgctgctgagtcgaataacacgtaatgccttcactaatagagaataaagtggttccaaatagttgtccttagggaagaaatacagaatggaaattgaataacttatcccagctagatgcttttgattggccttctggaatgttcacatccctttaaaacttggcagagttcaccccagcagtataggagatggaagccaaaaagataacacaagatactttgaatttcagtttttttctactcatgcattattataactaaaccgtataaaaataatgctctactacctttgatatggaacaaacaatggataaactactggaaagccattgctgaaatacacatatctaaatttgggggaaaggtgatctctaagcaacagggagaaattccatgtgtaacaggaattttgaatgaaaggggcgtattagccagatagccaagttcctaccacagcatccccacaaaactgttgatatgtttagcgagccttagaaatagtctcactggaaagaaattggtaaaatggaactaaacatttcaagtcaatagggctaaaattatgtttttagatagatttggaggttcagttcttaaaattccaaagtcatgattgttcatgtcttctgaaagatacacagactgtgattaaatattttctttcccccaaaaaaaaatcaatttgaaaaacatgtgaactagcaggtgtatgttgatagaatagatatggcataacactactcagaaatctctgctcaacatactcttagtttagcaaactgtaaagtcttttgagaccaagaactatacaagactctcctctctttttctagcaagaggtggacatatttgataaataattttactttctctgtcaactcttgaaaagacatttcaataagacatcacttttatatttgttaatgtgtgaaagatccctgtaaaactaccaaggaaccaaactgcatattttatcagtcaaaactaattatttctccttgacaaattatgcttttctattgtttttacgaattcttaagcagatcaatcagcataatacactcataccagaatctcgctcatgaactttatatgtttctttcatatctgccataaaggcaatgggaaatccttgtaagtagcagagtaaccatagggcctttagacagttcataaacattaaatagaaaatataatagtcagatatttgagttgatgtactcctctcattatagtcaatctcagcattgctcctaattggatcaacgtcgcatggaaacaagtgcaacatgcttctagtaataaaagacaaaggaatgcctgaacacacagtaaagagtgtgcttgctcatcagagaggcacttattaggaggcacagaaatttttcctgcagttagaaaaaaaaaattattctgctttgcttccctttacaatgttgctataaatttcatagcatagaataatatgtgtagaaaaaataatactttaatacccaaagcaactgaaaacacaaaatcactcatttaacccccctctttttagcaggaaaaattatatttctattaaaattaaaatacattcatatataggttttgcttattgaaataatgtaaatgccccagaaagcaatgcttctatgatcataaaattgtaaacaaacaaccaagacacattttaagcatcagtggttatatatttctcttaggcaaatggtcttcagtgaaactcctgggcttaccatcaagatctttagtggaattaaacattttagatggaacaagctgtttctaggatgcacttgatcgtggtcctttacactcttctaaaacttgtcctcactctaactccagaatccactgttttgattttattaccaaaaatacaatgctggttgtttgtacctgccaaaaaaaaaaacttgaatgaaatgattaacatggttcattagataatgcctgaggacatgcacattcaaggcatatttcaaaggaacaaatgccattttattattacgatgattcatacaatgcacattagtaatacatgtacaggcagactttgtcttacggtgctttgctttactgtgcttcagagatactgtgtttcttacaacctgaaggtctgtggcaaccctgagtggagcaagtctactggtgacattttcccaacagcatgtgctcactttgtgtttctgtatcatatttgggtaattctcccaatatttcaaatgttttcattattattatatctgttatagtggtctgtgttcagtgatctttggtgttatcattgtaattgtttgggggaccacgaaccacagccacacaaaatggtgtacttaaatgttgtgtgtgttctgactgctccaaccagctgttccccccatctctctccctctccttgggcctcccaattccctgagaaagaacagtattgaaattagaccaactaataaccctcccacagcctgtaagtgttcaagggaaaagaagagtggcaagtctgtcactttaaatcaaaagctagaaatgattaaactagtgaggaaggcatgtcaaaagccaagataggcctctgtaccttagaccagagcaaagccctcactctcttcaattttgtgaagactgagagagatgaggaggctagagaagaaaagtttgaagctaggaggggtgaagcaagatggcagaatagaagactccaccaaccatccccgcttcaaggacaccaattaaacaactatctacaggaaaaaagcacctttgtaagaaccaaaaatcagctgagcactcacattacctggttttaacttcatatactgaaagaggcactgaagaggtaggaaaaacattctttttcttttttaagaaaacaatttttttttttgagatggagtttcactcttgttgccccggctggagtgcagtagcacagtctcagctcactgcaacctccacctcctgagctccagcgattctcctgccttagcctccctagtagctgggactacaggcgcccgccaccacccccaggtaatttttgcatttttagtggagacaggatttcaccatgttggccaggctggtcttgaactcctgacctcaagtgatccgcctgccttggcctcccaaagtgtggaaaaatattcttgaatcactgatgacaacccttcctcactccccgacccccatcctcacccccacccccatgcccacctcttcaatgtggtgctgagagcatttctgtgccctgggaagaagagggccagcaactgtgacacactgaagctagcggaggctgttcatgaagtttaaggaaagaaggcatctccataacataaaagtacaaggtgaagcagcaagttttgatctagaagctgcagcaagttatccagaagacctggctaaaatcactgatgaaagtggccacactaaacaacagattttcaatgtaaaggaaacagcctgctattggaaaacaatgccatctaagacttttgtagcaagaaagaagtcaatgactggcttcaaaactttgaaggacaggctgaactctcctatcaggggctaatgcagttgatgaatttaagttgaaaccaaattttatttacccttcttaagatcctagagcctttaagaatgatgctaaatctacttagcctatgccctagaaatggaacaacaaagcctggatgacagcacatctgtttacagcagagtttactgaatattttaagtctactgctgcaacctacttcccagaaaaaaaaaaaaaaagaatcttttcaaaatattaccactcattgacaatgcacctggtcacccaagagctctgatggagatgtacaaggagattaatgatgtttttcatgcctactaacacattattccttcagcaagcctggatcaagaagtaattttgactttcaagtcttattatttatgaaatacatttcttatggctacagctgccatagatagtgaatcctctgatagatctagacaaagtacactgaaaaccttctggaaaagattcaccattctaaatgccattaagaacattcgtgattcatgagagaaagtcaaaatatcaacattaacaagagtttgttggaagtgcattttaaccctcggggatgacttagaggggttcaagacttcagtggaggaagtaacttcagatgtggtagagaatctcaagaaaactagaatttgaagtggagcctgtgatatgactgaattgctgcaatctcataatcaaacttgaacaaatgagttcttgcttcttatggatgagcaaagaaagtagtttcttaaaatggagtcaactgctggtgaagatactgtgaacacttaaaatgacaacaaagcatttagaatattacatcaacttagttgataaggcagtagcaaggattgagagaatttactccaattttaatagttctactgtaggtaaaatgctatcagacagcctcacatgcaaaaaagaaatcttttgtgaaaagaagagtccattaatgcaggaaacttcctcatcttattttaagaaaattccacagcttccccagccttcagcaaccaccatcctgatcagtcagcagccatcaacagtgagggaagaccctccaccagaaaaaaagcttacaacttggcgaaggctccaatgatcatcagcatgttttagcaataaagtgttttcaaattaagctgtgttcattttttagacataatgctattgcacatttaataggctacaatatagtgtaaacataacttttatatatcctgcaaaaccaaaaaacaattgtgtgactcacttttatgcgatattagcttaattgtagttgtctgggactaaacctgcaatatctttgtaatgactgtatgtaaattagctaataattttgaggaccattaatgattttgaggaccaggagatattcctcctctggagctaggaatgaaatcattgtcacccagaatgagtggctgagaacggggcaaggatgaattctccaaaggaaagtcccctgttgggaaagtggtgggggtgcaaaagccaccactcaattgttcaaggaaagcctttggagtggaagagacagtaatcattccagcttggacatgaaatgaaaaaccaggagtagaaatgtcatagataaagatgtatttgcactttaagtcctatggagtgtaactagtataagctgcttcacaatcttagacttcagacatctttgtagtagggagtctggaatctctctcagggctccctctttcccctacatgtcaaaaatcctgccccatagggagttagtcgaaccagtggttccctttctcactactgctcaggaccacctgtgaagttgagtgctcacagtcccacagctcgtggtcccagtgctgggatgtgttcttggccttggttcagcttttctggaaaaaacaacctcattctcacattgcagatctcaagtagaggtgttccaagctctggttcccaaggctttaggactcagtgccctatgcttcagttccgcactaactgccttccagagcaccaactactccacaagggccaagtcaaatgaaccccagtactccctgtcctgtggatacagaattaatattcctgatttctccctgggaatgcacaccactagtgcctttcctttttctttttcttttttttaataccccatttatttggacatagtgctatctgcccatcctttttagggcagcctcactgaatactttcctactttccctattctgtaagacaaatttcaggttctcagtagtcatcagtgttgcaaagagtggcctatagttttctctcctcattgtacccattttttttttttttgctgtgtttttatgttactcatacggtgagttcaatccaagttggagatttatccttgattgatatatataagaatatttctagaaaagatttgtcctcagaatgccctgccaaagaggtaaaattcaatttttctcttttccaggaaggataagcattaacaagcacagatggtgaacaaaggtgagaccgggcgtgacacaagtcttcagggatgaacaatgaggggcactcagtagtgccagggcagctcttggatatagtcttcattatatagagggagaaaaaaaggaaaacccagaggcttggggattaaatgatttgcccaagatcatacaccttcttagtgccagaagaaaacaggtattctgactggtggccttccatgacatcatgcctgtgcaaatgacaatcacatcacaataaataacacaaaagaaactgtagccattatcttctattttgcactctgcttgcacttggtctgttttttcctaacatacaccagacttgaatgacaaaaggcttatctttagaagataaaatccacccaaggagtatccttcaggggaaagagcacacaaagaagcttagagtttagaaggaagaacaaatattaggaaattaaagggaacttgtgttacttatctttagactcaatcatttttaaaaaatgaattattgtatttattattattgccctaaatatatatgcaaaatatttttctagtaaatttttttcactatttttcaagtcttggaagtttaagccatcaatctaagatgtaacaagacttacagtgaacaatccaatgcttgttttttaaaaatgtctctaatgcattaaaatctatgaggttattcaaggataattaaatgtgatgttttaaaaggggaaaaaagcacagtatgactgtatgggaaaagaaaacaaaattaattagacacaggcctgggaacaagtcaatttttttcatgttaattttcattaatagatttttttttttttgcacaaacctccatttcgaaagagaatgaaatgaaatatcattcaaaaggaagaggaggacgattctttgtcaaccacacaggcattcaaatggcaagtgtgggatttcctccaccacaaagtgaggtacagctggcctcagactccaaagaatgaacattcaaagaaacattaaattactctaaattttgcctttaaattcctatctggtttgctaatactttggtggaaggttctaccacctttctaagataaagccttctgttttctaagacgaggtcctgagttgcaaaccttttcttattttctcttctggcatccaggagcaactaagggcagcattattttttctatgaggcacagagattccaggatccctttcttccctaggctacacgtgggcccatgccggagtcgcagctctctgcgacactgtcctccctgatgggcgagggaagggcctggaggcggcggagggcagcgggggcgaggtccggatgggcccagccccgggtgccagcagcccttgctcctgctacagcgttgaggagggctgccactcttttatatatatatatgtgtgtgtgtgtgtgtgagtgtttccagtgcttcctcaacaaaaataactttttggcttcaagagacactaattgatcatttttgtaatctttgtaaatacacttctttgtaccctgccttattttttaaaaagagatccagaatcttttagaatttaccattttcacctctgggttttaatggatacaataatactagtactaataggtgcagctaacattcgaatagttcctggtacatggtaaataagcacaaaattataggcgaggagactgacaccaaaggattgaagctacttgcccaaagacacacagctcataaactgtgaagggaaaattcaagtgcaggcagtcaggctctgggatccagggtcctaaatactgagctctcttgcccctcaactagatctgtgagccagaaatacattgcaggcaaagcctaagcttgctaagagacgtcttcttacacagagaaagaccggtagatcatgtggtcacatgacttccatgggctttattctgtgagactcagatcatattcacaactgtgtagtccaaattggccaggactgtgggtgacagtgccttccaaactacacagaggtgacctgcaatcattcaggaaggcacccttaacaaacaacggctcagagcttgaaggtcacgaaatgaaaagccattctctaacagtcagagagtacccagggattgggttaacccaacgcagctgtgaccatgtcatccaggtgactttctgctgccttaattccatctcgttggtcaaattcattggacggagaaaagtatggaagggtacacaagtagttttgcataacttatcaaccctgccggtgcatgcaaccctaaaagtcaggtgttcatatagctcccccttagtagagttagcttcccactctctctggacagttgaggttagtacttgtcctgctttaccagatagtggcaaagaaaaattcaatagtggatataaaatccttcaatgcttaatcattataggggctgttcttgaaagttagatttttttgtataggctctattctcagtacaaggacctagatgcccgggtgagtaagatttagcaatacattgtaaatctgatgatgtcccacttagaaaaaataaattcttttctgtttacagaatctgttacccttcttttgcattcaaaaaattcaaagaaatattaaaagaaaaatataatcagaaattatacaaaaaaagaaaataaatgatttagaaaaagtaggtggaaaacattgagttttaccttctgccttaagtaagaagagcaatcagctacttgaaatcttccttgaggggccaagatggctgactaaaaacagctgcggtcagaggcgcccactgagaagaatgaaaatggcgagtgaatcctgcaccacaactgaggtatcgaggttctctcactgggactgactaggtggttggcatgacccacggacagcaaggaaaagaagagtagtgtgacagccctcctgggagccacacagggcaaggggagctcctacccccagccaagagatgtgatgagtgatagtgctaccctgtctgggaaaccacgctttttccactgatctatgtgaccgggggatcctcgtgagcccacaccaccagggccttgggtcccaagcatagagctgtgcagattctcagcaaccactcagctggagactgcctaaaactaccgaattcccggcaggagaggtgttcatcatcactgcagctgcctgctgcctaagacaactgaactcccagggcaggggtggcagccatcaccgcagctccagtctgccatttttccccctgctggtgctggggagactggatggtttggacccaggaggaattccccacagcacaggataatggctgtggtacattgtggccagacagcctcttcaggccagaccttgacccagccctcctcactgggcggggcctccctgctggagtttccgcaactccagccttgggtttagggacagcactctgatcttcctgggactgagctcctgtagggagaggcagccgtggtctccatgaatcagcagacttagtctttacccctgagggctctgagaaccaggcagtctggacaaatgggatgtcccccagcacagcacaccctatccaccaaggggcagctagagtgctttgttaagcaggtcccagatcccatgcctcctgattgggtgagaccccccacaacaggggttgccagacaccttatacaggagggttcccaccggcatcaggttggtgcccctctgggacagacagcccaggggaaggagcggcagccatctttgctgttctgtaacctccactgatgacacttgcacgagggacccaggtctggagtggacccccaggaaaccacagcagccctatgaaagaggggtctgactgttaacaacaaacaagcaaacaaacagaaagcaacaataacaacaacagcatcaacaaaaaagcccccacaaaaactccacaaaggtcagcagcctcaaagatcaaaaccagataatatcactcatgaagatgagaaagaatcaacaaaaaaatgctggtaattcaaaaagacagagcaccacttctcctccaaatgatcacaacacctctccagcaagggcacagcgctgagcagagactgagatggatgaattaacagaagtaggcttcagaaggtgggtaataatgaactttgctgaactaaaggaacatgttctaacccaatgtagagcagctaagaaccatgataaaacattataggaactgggcacaaggactcacgcctgtaatcccagcactttgggaggccaaggtggtcagatcactagaggtcaggagttcaagaccagcctggcgaacatagtgaaacaccgtctgtactaaaaatacaaaaattagttgggcgtggtgactgacacatgtctgtaatcccagctactcaggaggctaaggcatgagaatcacttgaatctgggaggcagaggctgcaatgagccaagatcatgccactgcactaccctgggcaacagagcaagactctgtcaacaacaacaacaacaacaacaaaagatggaaaaaaaagttacaggagctgttgaccagaataaccagtttagagaggagcataaatgacctgatggagctgaaaaacacaacatgagaatttcacaatgcaaccacaagtatcattaaccgaatagaccaagcagaagaaagaatttcagagcttgaagactatcttgctgaagcaagacaggcagacaagattagagagaaaagaaaaggaatgaacaagacctctgagaactatgggattatgtgaaaagacggaacctatgaccgattggggtacttgaaagagatggggagaatagaaccaagttggaaaacatacttcaggatatcattcaggagaacttaccaaacctaacaagacaggccaacattcaaattcaggaaatccagagaaccccagtaagatcctccatgagaagatcaacaccaagacacacagtcatcagattctccaaggtcaaaatgaaggaaaaaatgttaaaggcacctggagagaaaggccaggtcccctatgaagggaagcccatcaaactaactgcagacctctcagcagaaaccctacaagccagaagagattagtggccaatattaaacattcttaaaagaatttccaacccagaatttcatatctgccaaactaagcttcataagcaaaggagaaataaaatccttttcagacatgcaaattctgagggaattcatcaccaccaggcctgccttgcaagagctcctgaaggaagtactaaatatggaaaagaaaaactgttaccagccactgcaaaaacacactgaagcacaaagaccaatgacactgtgaagcaactacatcaacaagtctccaaaataaccagccaacatcatgatgacaggatcaaattcatacataataatattaatcttaaatgtaaatggactaattgtcccaattaaaagacacagaatggcaagctgaattaagtcaagacccatcagtgtactgtattcaagagactcatctcgtgcagacacagataggcttcaaataaagggatggaggaaaatttactaagaaaatggaaagtaggaaaaagcatcctagtttctgacaaaacagactttacactaaccaagatccaaaaagacaaagaagggcattacataatggtaaagggatcaattcaacaagaagagataactatcctaaatgtatatgcacaaaatacaggagcacccagattcataaaaaaagctcttagagacctacaaagggacttagactcccaaaaaataatagtgggagactttaacaccacactgtcaatattagacagatcatcaagacagaaaattaactaggatattcaggacttgaactcagctctggatcaagtggacatgatagatatctacagaactctccatccagaaaacaacacaatatacattcttcttggtgccacatggcacttactctaaaatcaatcacataattggaagtaaaacgctccacagcaaatgcaaaataactgaaatcatagcaaacagtatctcagaatacagtgcaatcaaattagaactcaagataaagaaactcattcaaaaccacacaactacatgtaaattgaacaacctgctcctgaatgactcctgggtaaataacgaaattaaggcagaaatcaagaagttctttaaagccaatgggaacacagagacaatgtaccacaatctctgggacacagctaaagcagtgttaagaggcaaatttatagcactaaatgcccaaaaagctagatgcgggggtctgtcctgcagaccctgacccaatgatggatgaataaagtacactgacacacagatactctgctttgccagttcagctgagtgtctgggccactatttgcaaccgtggccccgacttgccagtgagacttacatttattcagtaaagattaattgacaaaggtcatgactaaacacacctgtgggtaattaacctggtcaccccgaccctggagagagacatcgtgcacccgcaaatgatcaaaggttggtcttaagaccacatgagtaaataagctcattaggtaaactccccacattcctttgtactcactttaagctatttacttaaggtaaggatcaggttgccttcagctataatccttactaaagctatgcaaatttctcggccttccaagaaggtttgtggctattactataactatctttaatatttttcccaccagcctgaatgaacccccacaactagaaagatctcaaattgacaccttaacatcacaattaaaagaaccagagaactaagagaaaacaaactccaaagctagcagaaaacaaaaaataaccaagatcagagtggaaatgaaaggaataaccaagatcagagtggaaatgaaaggagatagagacacacacaacaacaacaaccaaaaaaaaaaaaaccttcaaaaaaatcaatgaatacacgagctggtgttttgaaaaaaaaattaataaaatagactactagctagactaataaagaagaaaagagagaaaaatcaaatagacacaataaaaaatgacaaaggggttatcaccactgaccccacagaaatacaaacaaccatcagagaatactataaacacctctatgcaaataaactagaaaatctagaaaaaatggttaaattcctagacacatacaccctttcaagactaaaccaggaagaagtcaaatccctgaatagaccaataacgagttctgaaattgaggcagaaatacatagcttatcaacaaaaaaaagcccaggaccagatggatttacagctgaattctaccagaggtacaaagaggagctggtaccatttcttctgaaactattccaaacaattgaaaaggaaggacttctacctaactcattttatgaagccagaatcatcctgataccaaaacccggcacagatgcaacaaaaaaagagaacttcaggccaatatccttgatgagtatcaatgcaaaaatcctcaataaaatactggcaaaccaaatccagcagcacatttaaaagcttatccaccatgatcaagttggcatcatccccaggatgcaaggctggtcaacatatgcaaattagtaaatgtcattcatcacataagcagaactaaagataaaaaccacatgattatctcaatagacacagaaaaggcctttgataaaattcaacactgattcatgttaaaaactctcaataaacttggtattgatagaacatacctcaaaataataagagccatttatgacaaacccactgcaaatatcacactgaatgggcaaaagctagaagcattccccttgaaaactggcacaagacgaggatgtcctctctcaccactcctattcaacatggtattggaccttctggccagggaaatcaggcaagaaaaagaaataaagggtattcaaactggaaaagaggaagtcaaaatgtctctgtttgcagatgacatgatccgatatctagaaaaccccattgtttaagcctgaaagcttattaagctgataagcccctttggcaaagtctcaggatacaaagtcaatgtgcaaaaatcacaagcattcctataaaccaacaacagacaagcagagagccaaatcatgaataaactcccattcacaattgctacaaagagaataaaatacctaggaatacaacttacaaggtacgtgaatgacctcttcaaaaagaactataagccactgctctaggaaataagagaggacacaaacaaatggaaaaacattccatgttcatggataggaagaattaatatcatgaaaatggccatactgcccaaagtaatttgtagattcaatgctattcccattaaactaccactgacattcttcacagagttagaaaaaaaactactttaaaattcatttggaaccaaaaaagagcctgtatagccaagacaatcctaagcaaaaagaacaaacctggaggcatcatgctacctgacgtcaaacaatacaacaaggctacagtaaccaaaacagcatggtactgatacaaaaacagacacatagaccaatggaacagaatagagatctcagaaataagaccacacatctacaatcagctgatcttcaacaaacctgacaaaaacaagcaatgggggaaggattctctatttattaaaaggtgctgggtaaactggctagccatatgcagaaaattgaaactggactcattatacaaaaattataccttatacaaaaattaactcaagatggattaaagacttaaatgtaaaacccagaaccataaaaaccctagaaggaaacctaggcaataccattcaggacataggcacaggcaaagatttcatgatgaaaacatcaaaagcaattgcaacaaaagcaagaattgactaacggaatctaattaaactatagagcttttgcaaagcaaaagaaactatcatcagagtgaacagacaacatacagaatgggaaaaaatttttgcaatctattcatctgagaaagcctaatatccaaaatctgcaaggaacttaaacaaatttacaaggaagaaacaaaacaaccccattaaaacctgggcaaaggacatgaacagacacttctcaaaagaagacatttatgcagtcaacaaacatatgaaaaaaggcacattactgatcattagagaaatgcaaatcaaaaccacaataagataccatttgatgcaaatcagagtggtgattattaaaaagtcaagaaacaacagatgctggcaaggctgtggagaaacaggaacctttttacactgttggtgggaatgtaaattagttcaaccattgtggaagacagtgtggtgattcctcaaagacctagaaccagaaataccatttgacccagcaatcccattactgggtatatacccaaaggaatataaatcacctagaatcagaaataccatttgacccagcaatcccattactgggtatatgcccaaaggaatataaatcattctattataaagatacatgcacacatatcttcacaatagttaagacatggaatcaacccaaatccccatcaatgatagactggataaagaaaatgtagtacatatacaccatggaatactatgcagccataaaaaggaacaagataatttcctttgcagggacatggatggagctggaagccattatccttagcaaactaatacaggaacagaacaccatacaccactttttctcacttataagtgggagctgaacaatgagatcacatggacacaaggaggagaaaaacacacacaggagcctgtgggggcagggcagggagggagagcatcaggataaacagctaatgcacgtggagtttaatacctaggtgatgggttgataggtgcagcgagtcactatagcacacatttacttatgtaacaaacctgcaagtcctgcacatgtatcctggaacttaaaattaaattaaattttaaaaaaagatatcttcctgagaaaatgtgaggtacaagtaaataaaataattattactataaccaacattgggaagtgtaaaaatataataattgattgttgtcttgggctggtgccatgagagctgtctaggattcccatgcaaacagagttatagtccctacttggtggctgcttttagctaacttggaacattttaaaaataaattctcaacactgcaacagcttttcaactatacttgtctttagagttggccaaaatatagaccatggcaaaatcagcctctctataacagggcaaggtgagccaggaagggaacggctccaggtaaggaggcattctgatctaggtatgaagaacaaaccattttactgtgcacctacatctggcttaaaacaagggtgccaactagagagatggagatctttgtaagtttctccctacccatgcccaaccctcacagcattacaggattaaccatcacatcagcactcaaatatttctcatatctgcttgtcagaatatttagcctctaattctcttttctcccttagctgattttccctagaaatttttgtctttggaatctattttcctctttgaacaggcacataccacaagccttttctgtaaaagtagtcatcaacacaggtgaggtagtaagtgaggcttacaactaaaatcgtttcagtccaggcaactccctgttaaacacagagtggtccacagcactcttagaatggagggcctgccccatgtcaaactttcaaatgggcaatattttcagcacccctcaagtttcactgggccaattggctcattcctgcatgcaacatattttatgttaatatcccaacataaaatatgttggtatgtaaaatattttatgttaatatattttatattgtctatcttctctgttctctgccctgaaggaactcagtctctcagaaagacaagttaataacgctaattccacgtggtatattccctgattcagataagacaggaaaggtgtgtcacgcagcctgggagtaacagggagaagaaaggcttccccaaggtgagctctgagctgcttctgcagaacaagcacaggcagactcagtgtggagaaaatggccaaggatgcattcctggcaggaagaactgttgtgggaagtcagggaccctgaacggagggaccagctggagccacggcagaggaacataaattgtgaagatttcattttaatatggacacatatcagttcccaaaattaatactttcataatttcttatgcctgtctttactgcaatctctgaacataaattgtgaagatttcatggacatttatcagttccccaaaataatactcttataatttcttatgcctgtcttactttactctcttaatcctgttatctttgtaagctgaggatgtacatcacctcaggaccactattgtacaaattgattatagaacatgtgtttgacaatatgaaatctgattgtaaaacacgggtgtttgaacaatatgaaatcagtgcaccttggaaacaaacagaatagcagtgattttagggaacaagggaagacaaccaaaggtctgactgcctgcggggttgggcagaatagaaccatatttttctttttgcagagagcctataaattgacgtgcaagtaggagaaatatcactaaattcttctcctagcaaggaatattaaatattaagaccctaggaaaagaattgcattcctggggggaggtctataaacagccgctctgggagtgtctgtcctatgtggttgagataaggactgaaatacgccctggtctcctgcagtaccctcaggcttattagggtggggaaaagatcccgccctggtaaatttgaggtcagaccagttctctgttctcgaaccctgttttctgttaagatgtttatcaagacagtatgtgcacagctgaacatagaccttcatcagtaattctaattttgccctttgccttgtgatctttattgccctttaaagcttgtgatctttgtgaccaactccatgttcatacaccccctccccttttaaagtccttaataaaaacctgctggttttgtggctcaggcggacatcatggacctactgatatgtgatgtcacccccggaggcccagctgtaaaattcctctctttgcactctttctctttatttctcagactggctgacacttagggaaaatagaaaggacctatgttgaaatattgggggctggttcccgataaagaacagtgtgcacaaagcccatttgggttcctgcctctctagactttctgctgcaccttcataaacacaatccacttatgttctaattgtattgtggctggactggtaggcactaatttaataagctgaggtcattctatttagttagataaaatgtctatctttcattgggatattagttgaactggtaagctgttgggaaatctacctttgggggacctctaggtttgtctcaaaccatgcatgtaggcaggtgcctcttttacttattcctggggctcacactccaggcgacatgagtacatgaatcttaagatctgtgttgttactcttggaaatcatttgcacaaaatatcatgcatgtctctcatagcatatgtaaccattagcactctgtagcatttgtggttaaatgagggcttttagttctgattttttttttaaagaagttagtagacaggaatttttttaagtatttttagctggagtcatgttcaaggtttttttttttttaattttaaaatgcatgcataaaacagtcagaattgcacagttaatgtttcttggtgtttttactactccgatgaagaatcactggagaagaccaacaaagttatgtaaattaatcagaaggagcagcaaaacaacatggattttaaacataactctgagtttctccacttcattgtctagagcaagcttgtccaacccacaatctgcaggtcacatgtggtccaggatggctttgaatgtggcccaaagcaaattcgtaaactttcttgaaacattatgagattttctgtgaattttttttcaggttatcagctattgttagtgttagtgtattttatgtgtggcccaagacaattcttcttccagtgtggcccaggaatgccaaaagattggacatcgctggtctagagtttgacaataaaactgtgctgtgtcatttgttgtggctactctgttgcctgaaacaaaaggcagaacatatgaatgcttttatattgcatttgaaaagggtctgtgatttgaattttggtcagacatggccaattttacataatagcaagaacaagggctgtgtgatataccccttcatgcatcctgtgaagtagcttattgaacttcatggcagaatggaatatacaggctaacaaagaacacaccaggatgtttaagttatagtggtacctatttgtttttgataaacatttacataacttaaacctacatcaacttgagtaaagttaacatttcactgaataaaacaaaactttataaacattatttgtgaaagatgtctaagcaaaggaatacatttacaaaataatgtagtagctgaacatccaggtatcctcaaaattgtcctaatgtttctctctccctttggggccagaagcatcaatgtcagacctattctgcacctgggttagaacatgtgctgcagcaacgaggcttccagaggccttggctcactgtgggttggaggcctcccatctgtcctgctgggttccctgcctcccagataaggaggtctgtgtcctgactgttgatctagacaggaagctctcagttacttgcttatatcaatatctcagcgagtatctctctttggaaactgcgaggtccagtagaaaacctttccatttctcagctctcacatccttcctcttcccacactactctcattccctttgcctaccacacaaaaaaactctccctgtccttcataaaaacaaacagaccaacataaacaacaaaattcacttgaccctgtccctctcttccaacttcttagaggtggaatttgcactctgccacctcgagctctgacagatgtggcccccatcctctctcttgaagaacaaacgatactgtcttctgggctcctcctgagtcttcggtagatgtgttcctctgtctcttccctccttttcctccaggaccacagtgttgcacagctgcaaggggggcacatttcccagcacactttggagttgtgcagtacacagcctacacaaccactggtgaccgtcctggcttttgttcttctttgtgtttacttgaccgtggagcattccagaattctagcctatgtggccttttcccattcttccctctgggaaatctcatttcttctgttcaacctaattaatgtacaccgttagcccaatgactttcagaactgcatgttttgcctctatctccctcctgagcttatatatttctgagcccctaccccttctaccagaatgcccatgtaaaacacaacaaaattcaacaatgtatgaacctcaaatatccaagacaggtctcagttaatttagaaagtttattttgccaaggttgaggacacactcccatgacacagcctcaggaggtcctgatgacatgatagagcacaattcggttttatacattttagggagacatgagacatcaatcagtttatgtaagatgaatattgatttggtctggaaggtgggacaacttgaagcaaaggaggacaacttgaagtggggagggggcttctaggtcatacatagataagaaacaaatggttacattcttttgagtttctgattagcctctccaaaggaggcaatcggatacagatatatctcagtgagcagaggggtgactttgagtagaacgggaggaaggttggccctaagcagttcctagcttgacctttccctttagcttagtgatttttggggacccaagatttattttgctttcacactctccatgattcaattttttttctcctctttttcactcatttcactgtctttgttgcccatctagttgacaaacgaggacattcaccatccctttttactccataaatacagaagcagaattggtccttctaacaccagacttgtactgtcattcaacttttcccatgtgcagtagctctccaactagcacagggaccacagctttgctgcctcaggttgcggctactccccacaaagctactattccataacacatcccttcacttcatttatagaatctacagtagggttgaaaggcagcacttagtgtagggaacactgttctaatactttaatcagcatataccatctaagtacaggctgttgtaggatatcctggctccactgaccttctaaaacaatttgtctgtccatttgtttcttgaaggatgactcccaagtctccagggtacattataccccagccagtggtgctggcctttactcctctacctcctcaagctgtcacctccacattgtccctatgtccattctcctgcttgggctccatccacactcacctgcccttccttccagaacagcctcttccagcccctctccacagaaccacactggcctgagtcaggaggtcagtgacagcccactttcagtttcatttctctccccaacaagtcaaccactgggggaagtttgaatgttgacacacttcatctgggtcccactgtgcttcccctcaacaatgccaggtgggggaaggtccaaaaagttcaggcctgttcattactgccaagtggtcattcaaagccagtaagttatgtcggttacaaacaagctacaaaaaattttgtaacaaaggtaaaagtaagccctattaagttgtattttatatatacatatatatattttaaattatacaattttatatataaaactttatatataatttaaattataaaattatgtttgctgcctcagattgcagctactccctattattccataacacatcattttatgtatatatacaaaatgatatatatattatatatatataaaatgaatggaaattggaagagctgaaggaattctattttcttcttgaacaaggtgaaattttttatcagctggacacactttttcatgactgagcataagacattttccatttccccacccccatcttgttcctcaagttttctattatttggacagcaaagaaagctttccacataaagaaaatgtctttaaattaaatgtttagaatttcacattgtaaatacttttgtatttatgacttttaggaaaatcctcgatcattaaaacagccctaagcttaaaactttttctaatcaaggtggtttttagagcatgttcaatttgcagtcactgagtccatttcttaaccagtaactaaggaaattaggaaagtacaacctaatgaccctggaataggatggagtcaaatcacactcaccatacactgcttctgattactgaacaggctccctaaagatgctgtgttcattactggacatttttttgtttgcaaattctaattctgaaagatttgttttactaaaatccacggcacaaagagtgagattttctcaatggcagcaggctttttggtaaatgatattagtttagaaacacaatatctttatagtcagaatgaaattaaaatttggagggacagttttgcatttttctaaacttaaaaccctgatcaactgtaaccaatcttaaaaataatacagttttcttatctatgatttaggaaaatattttctgcattcaggctaaaattttaaaacatgtaaaaatggaaaaaattaaggaaattttaacactactactaataagcatttactaagcatgttggccatttgcagagctaaatatattatttacatcatttccatgttataatgacaataaacatacataagggcggtttaacaaaaactattggttctgctgctggggagaaattcattcagcttccatttgccttagttttcaaaaactaattggctttttcccataattgttattgtcatctttcatgatattgctgacataaaatgcaatcctacatcaaggatttttagccccagaggagtagaggagcaatttttacaggctttacatatacttctcagcttttataccatttctctactagaagtcacaaactgaaggtcctaggcaaaaagcaacctacaaatatgcatggttgggcttgtatatttttgcctttccatttctaaaaatgtaattagctgctaatattgaaaagctagggaatgtcacttttggcttccatattttcttgaaactatggcccaaatccccaaaggccatcaattagctaagtaactggctgccccattagcaagagctgcctctgccttcattaccatccccacacactccaagcttcaggctagttgctattcatcacacagtagtctgcctttcatctaccccacttccctcaaattgtttactggcaggttcccagagatatttaggtttgtaattcctgtcctgaattgcaaacatgatactaatagtgaaaacttccatagtgtttactagagctaagcaattttctaggtacttaaaatgcattaattcattaaatcttcaagataaccaatagggtgaagagtgcatcagtctgttttcacacactgtgataaagaaatacctgaaactgggtaatttacaaagaaaagaggtttaattggttcatggttctgcaggctgtacaagaagtacagcaacttttgcttggcttctggggaggcctcaggaaacttacaatcatcgcagaaggcaaagggggagtgagaacttcacatggccagagcaagaggaagagagacgcaagaagagctatatacttttaaacaacctgatcttgtgatacctcactctcgccatgacaacaccaagggaggtggtgttaaaccatgagaatccgcccccactatccaatcacctcccactgcaccccacctccaacattgggagttacaattgaacatgagatttgggtggggacacagatccaaaccatatcaaacactgttagcatctccatttttacagattaggaaactgtgacaccaagaagttaagaatttgtccaaggcaacacattttgtaagtggtggcaccagactcccagacaggaatctagccaagggcctgagaatccaccattaagctttatttttaaacatagtggaaggctctgcatgacaacactgacaacatcacttcagttctgctcattacatttagaggtgtgtgtctaatgcaagctaatctcttctttgaaacacctaggaaacaaaatttaggtcgagttgtacctcatgtagctccaagatacttcattagacaagcagccccttctccaaggctttgctgctatctaccaaaaaactgtcattacaaaaggacaaatggctggttctgagtctgaaggcacttgcagaactgtgctgtccacatagcaataagcagtgctcccaagttcaagaatcctttcagttattacagtaagacgtattttgatatctgcatgcatataaaattaatgaaatgctttatagaaatgaaaatctatggataatatgtcattttctatgtaaataccatcaaattggactttttattaccaagtcctcatttcacgattatgactgacaaatgtgtggcaatgatcctcttaaacatttatatctcaaaattccaggaattttaagctatttccctctgcccaagaatggacttgaaacactgcaagcagttttgtcttccatgaacatgacacaacccacaaaatatttattatagagcaggaaacctctttagtctgcatctttcagcatttttccttttcttcttttattttttcttaaatttttgaatttgtcgtctttttctttctttaaaaatagaccctagaaacagatccttttcttcttttgtggtgatttgcccttctaattatctaattatgacttaatttaatctaaataaatctaaatgtttgggtttattatctgaatattaaagatgagaagataggatttgaactcagacctgtttgacttccaaattctggtttgccctactatcccgtaatgcctcctagatgccgattagtctaagcggctgctccacaaggcttttaagcattcaagaactctactggaccatttgagggtctgttctggagacagacagtgcttcaagtgctgagggctcaggacttcaccctcccaggaggtacacacagtacaaagcctaacaatttgtcagcacataatcaattgaaaccacactctaaagttaaattagttccttccaaatggggcagacacgtgctgaccaattaagaggcccaaagacttgggagtagaggatgaataggaataaattgagaaagtatgcaggaaaattattgaaggaagaatgaagacgagaattctcaatgctaagttctggaagatgctggaagagaactgaatccaaaacaaatatatttatgtcaactcatcattgcttacattttctagtctaacagagcagaaccatgaaattgtttgaaaagtgaaaagcctcttctaagtatacaagcagggagagcattaggaatcgtaaattaaaaggacacaggtcctagcagagaagcaatgaagcattggggaagagggtttctggggaatttatgtgaacttacagaactgtggtctgctgtggtacctgaggaatgtggtccagcatcaagtgcatgcagcggacggtgctcttaaagcaaaggcaccggctggggcagggcaaccctggcaggcaccacccggccaggagaaagagagtggtccagcagaacagtctgggctccatcgctccattcgctgctggccacgcgaagaagcagccggagggagagcagcagctgcagctgcagcagcaaccgcagtggtggtgatggtggctgctggact

SEQ ID NO: 1387 - DNA, 61949 bp, Homo sapiens
cgaggctgcgccgcgtggagtggcttggcttaacagcagggagggcagagcgatgctctttgacctcccagaagagtcacgtgggctgacccagagccggggcggaaaggctgcgtttgtttcttccgggtcattgacagaagcgtcaattcctgggagtagttcgttggttttctttcccctcatccttttgcctgctcccggcgaggggtggctttgatttcggcgatgagctcccagaaaggcaacgtggctcgttccagacctcagaagcaccagaatacgtttagcttcaaaaatgacaagttcgataaaagtgtgcagaccaaggtaggaacctgcctgttgcaccgtctttgactccaggaaggaatggctcactggagaggggagagaggaaatgagaggagtcggctggggcgagtgtggaccgcagcccagagttagtcttggctgcagtgcaactctttctaaaatgttattctcacgccctttctttgacctggacatgttgtctcctggtaaatatttgatggtcagcacacttaactaattgcacagagtgaacaggaccctaatgaaatctaaggtgcagatggggcagttacgtcgttcagcgttcccatctggatcacattagcagagggaaacgaggattgtggcatgagtggctttttcaaattttacaccaagtttatgcagctacgatttttttttccaaaaaccccaagcccatagaggaaatgtgaatgattaagctgtcttaggctgtcctcactagtattgtgtgaaatttctgttttgtaacaattgttttgaagataaaaatatttggttaatgtaaaaatacttgttttgctgtttatctttagcaggacttctgtaaagtcctgctaaaaaattcagactgtctagatagccagaggacttgggttgtatataagtactaatttgcaggccgggcgccgtggctcaaagtgctgtaatcccagcactttgggaggccgaagcgggtggatcacctgaggtcaggagttcgagaacgacctggtcaacatggcgaaactccatctgtactaaaaatacaaaaattagccgggcgtggtggcgggcgcttgtaatctcagcactttgggaggccgaggtggtgggcggatcacctgaggtcagaagttcgagaacgacctggccaacatggcgaaactcccaatctgctaaaaatacaaaaattagccgacgtggtgacgggtgccggtaatcccagctactcgggaggctgaggcaggggaatcgcttgaaccctggaggcggtggttgcagtgagctgagatcacatcactgcactcctgggcgacagagcaagactccgtctcaaaaaacaaaaacaaaaaactactaatttgctctttgctgtgaatctctctccctgtctccatagctgtatggagagaaaatcattgacaacaggggcatattaggggccagcatcactcagataaacctaatattcacaaaagttatggagctcaaatttactaggtgtgcggcttgagtgagttgtataatatttaatttctctgagccttactttggtctcaaatgcaaatttgtcaggattgttgggaggcgaaactatatgattatgcataaatggcctaggtcatagtaagtgttcaataagtgattaatttcccgacattgattgggaaagcaaagtcatctgtttttggtaacctgtgatctccttttcctttcctctttctttctttgcttattctacaaatatttaataagcaccttccgtgtgcaaggccctgtgttcataggtataccgtgttcaaaagagctgactctcccttcacggagtttatagtttctaggtgatatgggcaaaaagaaagcagaaagataagtaaatacaaattatgataaatattggtgaagggcaacacagctcagtaagggagaataaggaagaatattttaaattaagtgctctcctttcccccacttaggttgagaggtttttcagaatgaaaacctgaagcaacatttgggaagactttcccaagtttgctcccattatcaataggtaaaccagaataaaaataaaaagctgcactattccaaatagatgtctgcgtcttgtgtattcttaccctaaggttgtgcacaaacatttgcttttgattgtttttcatgtctgttttcgtaaaaagcagttttaatgagtatttaactatagtgtagcttctcctacttgtacttttcattgtgcattttcttggtgttatctaataactatgtcattctggtcctaaatgttttcctgggtctcaggttcagtcactaagttgcatttgaccatttttatctttttatctttaattcctttccctcttttaagttatgaaaaagtctcatttgttaatcaggaggaccaccaggccacttcattattgaaggttctgacaaaaacaacacaaaatattttactgaggaaaaatcattcggttgattgttcatctgtgtaatgaatagctaataattgtctgtgatcataacagattcttgcatctgctatgagtagccatctaaagccaagactttgtcagaagcatctgatcctaactttgtgcctgttctttacactggaaagctatttgatctggtgacatctaacaaaggagtgataaaaaatgcacggttctctgtaactccccataaagcaagcttgtccaacacatggtgcagggcgtctttgaatgcaacccaacacaaattcgtaaattttcttaaaacattatgagatttttttgtgatttttttttttttaagctcatcagttgtcattagtgttagtgtattttatgtgtggcccaagacaattcttccagtatggcccagagaagccaaaagattggacacccctgccttagaggactgtagtaacaattgactacttgtattaaatactttatgatttggtaggggtcctacatgatagtttttcttttcctcctctgccaagcagtttgttaggactcactgcaattagaagttggataattacagatgttttattggaagttaatataggtaaagcactcattctcaaaaggacacagatgatagctttctttatatgcttgaatatactctagaaaaggagagtatattcaaattttgtgccatttcaaatggccaaacttggaccagggaatcaaagtaacaaaaataggtttcagctcaatatgagggaattatctgacagtgaaggggcttgcgccgggatttgtaacctcctcttccctggggttatttaaaagaggtccctctggccattggtcaccggtaccctcaaatgacttatggggattcagagggtcggcagtgggaataggtttaaatcttttctagtcatttagtactgagatgttgagcagatcaaggcagccttctttcccttactggaaaggcagtgatgtccaacgaaaagagcactggactaagagaaaagagccattccttagccccagttctgtcatttgttttgcttgatgatgtcaggcaatttacctatagcttttaatctatgatactgggttagtactatctcttgtcttactttcctctgaggattgctacagagatcattacaaaaattattattattattttttttttttttttgagacagagtctcgctctctcgcccaggctggagtgcagtggcgtgatatggatcaccacaacctccacctcctgggttcaagtgattctcttgtctcagcctcccaagtagctgggatttcaggggcacacaaccatgcctggctaatttttgtatttttagtagagatggggtttcactatgttggccaggttggtcactcctgacctcaagcgatctgcccaccttggcctcccaaggtgctgggattacaggtgtgagccaccgtacccagctacaaaaatatttttaagaaatagggataaaaataagaactaagaataaagcccataataatttatgtggccctgcagttgatcaaagcctaaaaaaattaattagaaaagaaatgcatgcttgttgaagaatactgaaacaatagagaagtatataaggtactgtataaaagtgaaagtctctgttcccagttttagtcctgttcagatatagtcactgttaacactttgatgtgtacatttctagatatgtctgtatgatacagtgcatatgtaataaaatacatctttgcccttctcattcagtaaagtggatgtgtcagaacagaaagattaagcttattttttaaatggctgtgtaatattatacagcacaaatgtggattagcttatttaactactttcctattaataaacattgagttgttttcagttttgcactatgccaaaaaggccgcagtgaaattctggtattcctgtctgtattccacatgtgttatctggtaccaaacattgtgctagatattggaagtatagggttgagcaaaatatacagtcacagtcttaattgaagcttgtgatttggtgggagaagtgacaggcattaatcaaataatctttcaagtatgttaatactacagcagtaagagctatgaaagaacggtctagggagccctgagagtatctataatagcatgaagtcttgattatgtttggagggttaaggaaagctccccaaaaatcagaaggatgagtaacattaaactaaatggaggagcatctgtcatccttttgaggatgctattaataatatatatatagtcagtattgtttttaatagcatttcccaaaatatatttcttagagccccaaggtcatgtatcttcttcatagggcaggagaaaatttcatgatcaaatcactttggaaatactgtatactagatctcacttttagaggtgggtcgtagtatacattggaataaatcaatgttttgcagttaaaaaattattcaaccaaaacttgcttggctatggaacgctttgatttacataatacctattgaactaatttgttgtggagctcactaattttaggaaactatagtcttcatcttgagatggagatggaaaatggaagtctatgggtgtactctaaataattttggaaatatagttttattaatacaagttgagtattatttatctgaaatgcttaggaccagagtgttctggatttcagattttttcagattttggaatatttacattatatcagtttagactctttaatccaaaatgttccaacaggtatttactttgaacatgatataggtgctcaaaaagttttagatttcagattttttggattagggatactcaacctgttatagctaatatttgtgtacttaagtgtattaggcactatgtttaggcactatgtatacttgctatacattatctataataatttcatcttcaaagtaaccctaagatagatgcaaaatgatcccattttacatattgggaaattagggcttagaggtgaatgacatgcccagagttacataattagcacatgcctcttcattggttggatgggatctgtgggaggacaattcaaagggcaagtaaatcaaaagccctccatgtgtatgtgtgattttaaaaaatatatgtactgtatttttgggtgtaatggaagcagtgtgacaccagattagggtcagaacagaaatgagtgtggtttattgccaccaatactaaacattgcttgtttgaaatgttctagggagagtctttcctcatgaggtgtggcccctggagtatcacatgccatacatgtgggctggttggggtggatctcatctcatcagcctgggctctgtagcagaggctccttttgctgagttaatgtgaaagtagatactaatttagtccattttcttggctcctgatttaggcagaaagctgtcaagtttaagattagttatgattgcatttatacagcagaacaggattctgtgtttacacacacctttattcacagttgtcaaaaatggggaaaacctccaaatatctatcaacgggagaatatatataagctgattgtggcagaggcatgcaatggaatactactctgctattttaaaaaaaagaaaaactgatacaagcaaagcagatgaatcttggaaacactaatgtggagggaaacaaaccagatacaaaagagcatactatgtgattccatctatagagaccagaaaggcacaagaaaactttctggagtggcaggagcagtgaagattataagagcaaatatattaaaactcattaaattgtacgtttaaggcctatgcatgacattgatataaattttacctcagtcaaaaataggcaaacaaacaaacaaagaaaaccaagaaggctgggcacagtggctcatgcctgtaatcacagcactttgggaggccaaggcaggcagatcacttgaggtcaggagtttgcaaacagcctggccaacatggtaaaacctcgtctctactaaaaatacaaaaattagccaggcgtggtggtggccgcctgtaatcccagctatttgggaggctcaggcaggggaaccacttgaacccaggaggcagaggttgcagtgagctgagatcgtgccactgcactccagcctgggccacagggagggaaaaaaaataggtattacaggcaaaggactgatgaaccacctagatgttttaaagttctgtttttgtttgcttgccttttgttttgggaaagttgaaggaacactaattatattagtgttcctattttaaaagacaactattttattcttcagaaataaaaacaagttaacattctaacagatattgaatatctcagctaaccacaagtcacaataattctaattgtcttttcatctttacctttttgtaagtctttatctgcaaactctagtcatgatgtttgagtttgtctccctgtggagcaggggtccccagcccccgacccccgcatcggtccatggcctgtcaggaactgggccacacagcaggagttgaactgcaggtgagtgagttaagcttcatctgtatttacagccactccccaactctcacattaccacctgagttctgcctcctgtcagatcagctctggcattagattctcataggagtgtgaaccctattgtgaactgcacatgggagagatttaggccgtgtgctccttatgagaatctaatgcctgatgatctgtcactgtctcccatcacccccagatgggaccgtctagttgcaggaaaaaagctagggctcccaatgattctacattatggttgtataattatttcattatatattacaatgtaataataatataaataaagtgtacaataaatgtaatgcacttgaatcatcccaaagccaccctgatcccccacccccaccctagtccatgaaaaaattgtcttccacaaaccccgtttctggtgccaaaaaggttggggactgctgctgttgagtaaagatgatcattacaaagtagattttgtatataaggtactgagcctgggtactgatttttttctagtttcagataaagttgtaatcctaatttcgtgggttgtgatgcctgacactgtaaaatgaatgaatagactttgctgtgggaaaaacctttactgtactatttgtccaggtagcttggtatcagttgttagggtctttgtcctgtctccccatgcccagagatgttgagctttaaggaatagacccagattggttcatgtaatccctggtgtgaggaattttagtgtgagtggtgaagtgccagtcatgggaataagtgttatttctcagccaatgggcatcagcaattaagggtagccactgagcaaagcagttggccagacatagaatctaccatagatctgaattgaccatctctgacgttctacagatgattctagtgttatagaggtcaccctcttttatctttctccaaattgagaaatattctttgatatgtttcccagtgctattaaatgagtttatgttaaatgtattccctcctccattgatttgttttaaatttaacatattttttcaagtgacaagataatttgtggtgtgctaggcattatgatatacataatattatacctaatagtgctagtgaagctctttacttttcctttgtgcccttttcaatgctttgaagaattgtaatccgtactattgtttaccttttattttctcttctctctttcacacagcataatttcatctatgcttggggatgttccatatacttagattcccaggttgcttccacttgaagctaataaagcatgtttcttttttctttttttctttttttttttttgagactgaatctctgtcaccaggctggagtgcagcggtgcaatctcggctcactgcaatctccacctcctgggttcaagcacttctcctgcctcagcctcccaagtagctgggattacaggtgcacatcaccacacccagctaatttttgtagtttttagtagagacggggtttcaccatgctggccaggacagtctcgatctcttgacctcgtgatctgcctgccttggcctcccaaagtgtcaggattacaggtgtaagccaccatgcccagcctaaagcatgtttcttaatgttgaggcctgatataatataatttttttgtgtgcattaatcatatattttaggtacttcattttatgtctaatacatgacagctgaaattaatttgtcttgatttgctctactatggggaatagtactatacttactgtttttagggaatagtattatacttattgttggattaattatgacattttataattgtatcaccagtatttgtttctacataaattcacgcttagaaacagactattctgcaaattcttcattcaggtaaattcattaatctaaaagaaagttgtaattaatatgaattcacccccaaatgggccattttccttttagagaaacactatagtagggaggggcatagttagacacaaaaccttggggttgagagttacaagctgtggcatttgttattttaagcctcaggactccacacctgcaaaaatattactgtgaggtcacaggcaggtatacagtgaatcctgcatgtcctcagaacaccccagctgccagctcacttcaacctcaatggctggtgctgtttttcacatcttcacttttgtgaaaggaagaaatgaaataaggaggggataaaggaatagctgacatgcctaagattcttttcttagatttttcttatcactccagaccaaatagcacttaaatatattgaatgtgtaaaacaaaaaaaaaattctaagcccctcaaccaacttaatggaccccccctttcagccaaggggacctcaaagaaacttagaaaattaattcaggccatgatgggaagtggggaacaggtcaagacatgcctcatcatacccttctccatttggagtctagacacaactgaccagcagtaacattaaaatagagatcttaagactaacaaaatagactctgtagtagtaagataccaacttccaacctgactctagtgtagtatcacatgacagatagcaggccctgaaggaaatcaaagtatttttccggaaaatatatttcttttgacatatttaaaatagccctgcaaagctgtgttttgtggggggaaatttgcattctgtagagaatctccttccccttaggagagtctgacaccttttaaggtcttttaagagacattcactggctattctctctgaagcctgctacctggaggcttcatctacatgacaagaaccttgacttccacaactcctttatctaaaggcaagcatttctttatgctgtattcaattgttcaggcagagctgaactcttttaaccaattgccagtcaggaaatctttgaatccacatatgatctggaaggctcccccacctcccttccctacaagatgtcctgcctttccaggctaaaccaatgtgtaccttacatacagtgatttatgtgttagcctgtaacttctgtcttcctaaaatgtacaaaaccaaactgtatcccaaccagcccatcttgggtacttgttcccaggacttcctgagactgagtcatgggccatggtccttaacctttgccaaataaacctctaaattgattgagacctgtctcaaattctttttggtttacaaatgaagtaaataaacattccttttttttactggtctgatgtgtgcaaggcactgtccatgaaggtaattagcattaggattctttagttgctaacttaagcagaaagggaatttattggaaagatactgagctactctcttgaaacttccaaaaggcatttatttgttttggttggctttttattttttttttattattattattattattattattattttgaaacagagtcttgctctgtcgccaggctagagtgtagtggcgcaatcttggctcactgcaacctctgcctcccgtgttcaagcgattctcctacctcagcctcccgagtagctaggattacagtcgcccaccacagcttctggctaatttttgtatttttagtagagacacggtttcaccatcttggccaggctggtctcgaacttctgacctcgtgatccacctgcctcagtctcccaaagtgctgggattacaggcatgagccaccgtgcctggctggttggtgttttaatgtcctagattcccagatcattcattattacttttccctatttggtttgtacataccctaacccgatgcaattttccaacctttcaatgctccctcccctaatgcttccactttaccttctacaatttatagtctgttgtcatgaaatagagacatagtattgaatataaaatgtctttcactttcttgccctacctggctattcctgggagcactgtttccctgtaatcctcttaagtgatgatgtattttcaccccacatctttaccacccctctcccatgtagaaccatttctcccatttgctgtgtttgtttctccttactcaaaaactgtagctcctcggaaatacatgctgtcagactactatactctccagatgtgtactaaactcctagttacaccttctcattagtacctgggcttgctacctttccacagttcctgtcatcatacttagtaattgctacatacacatggataatctgtccaacatctgacatctcattgccacctcagaagtctaccctcatggtcagaccacagacttgctcctcactggtaactgctgtacttacaaagtttttaaaagactgggccaggcgtcatggctcacgcctgtaatcccagcactttgggaggctgaggcgggcagattacaaggtcaggagtttgagaccagcctggccaacatagtgaaactccatctctactaaagatacaaaaaaattagctgggcgtggtggtgcacgcctgtaaccccacctactcgggaggctggagtgggagaattgcatgaacccagtaggcagaggttgcagtgagctgaggtcgcgccgctgcactccagcctgggcaacagtgcaagactccgtctcaaaaaaagactgaccaccatccatctggtttccatatccctcagataatatttattatccccattgggtagtcctgtccattagcccttctactttttactgtacttcattcatgtcttgatttccctgcttttctattttatttttatttttttgagacaagagtctctccctgttgccagactggagtacaatggcatgatctcaaagctcactgcaacttccgcctcctgggttcaagtgatcctcctgcttcagcctcccaagtagctgggattacaggcatatgccaccacgcctggctaattttatatttttagtagagatgggttttctccatgttggtcaggttgctctcgaactcctgaccttatgtgatctgcccacttcggcctcccaaagtactgggattataggcatgagacacggcgcccagcccttccctgcttttctagtttggagcctatgtttcatcagtgtaactgttcttttgcatataccccagctcccttgtccatctttccctctgtggtactcagctgacagaacctcactctgcttagattcagctttttattaaaccaccaccacatctatcaaactaccaatgtctgtacccatatattttattttattattaccgtagatgaaactatccctgaggctagccgctccacaacaccctggagcccatcttgcctacctaaggatttaatgtgtaaatttccttagattgttcatgctttcttgcatcctcaatctttccatctctaatgggttattacaattcctattaaaacactccctagatagaacaaatgttaacctttaagtcgtggcttttggggacagatacaggtacccagatgaccaggctcttttcagaaatagtattagtggatgtgaaaaagcattccaaaagatcctcttaactgtttaaatatacaaagcaacttcagataatccttctttgggctgaaagaaatcagtgtgatttgattttctaacagtgattaatttggtccctgtagggttttttggcttctaaaaatatcaagtgaacttagactttcccatagctttggagttgattttctcaaccttagtcctaattcttttccaatttatctgcttattcttgaggtggaatgacatttttagaactttatggcaaacattttctttgatattttctcagatgtatttttagttagaagagttggagctacattctaaaatgttaacgcaaattgtccttttgtaactaacttgtatgacgcattttctgttttgcttttgtttttgcagagtcttatgtcataaagaagtatttcttcttgtagttgatggagttatgtatatgtaataattttcaaatgatggtccatcagcagtagaattcaattacaactttacactaatcagacccagttttggaggtcagctgatattgtaggccattcccagcatcatggatatgaaatgccaagctaagctagggattattttaaatgctttgttgttctgagaatatttatataggttgcttacatcaggtgtctgtcttgtttgtttttaaatgactcatgccactgaagtcatcaatttgagtaatatatttgacatcatggtatatacttatatatgtgaatgttcaatataccatcattagtctttatcataaggcactatagtaataggatgtcatgtttcccataaacttgaatgacataataatgctaaatctggttttcagtaaaactagaatagtcatgtgtggtaagttgtcatctattattgatataaaatagtattgtggttacttttacatatgtaacactgttgcttgaatttaaacgcaccaatacagaacaatgagcagttctttgactctcatatgatgattcaatgtcagctagtccttagtatattaaaaaaaaattcctggcttactgtggtagttaattctaattttaatgtgtctctagggacacatttattaaggtcttttattcactgcccagtaagaaaagtcagtcaaatttaactgaggtatttttctaattcaaaatggctgactgaacatgtacttaaaattttccttttcttggctgggcacggtggctcaggcctgtaatcccagcactctgggaggccaaggcgggtggatcacttgaggtcagaagttcaagaccagcctgatcaacatggtgaaaccccgtccctactaaaaatacaaaattagccatgcatgttggtacacgcctataatcccagctacttgggaggctgaggcaggagttttctttttccccaaatctcagtaagaagaaaaagaaagaaaaaaagaactatgataccaaaaaactgaagaaggttctgtcggcagaaagcagcattaaggagagcaggacaaagacaggtcccttctctgaagctggaggagacggtggactccgttgtccaatcagactctcttgggaaaaaatatagggaggcaaaattcgaagaaaaggaacatatagctgaaagagactgttttaatcagtcagtagcttctgataaaggccagattatctataagaaatgaacaagctgtttttttatatatctgaatgtagcgaactttgtaacatatacattgagcagttaaacaaaaaagcaaaataagttctacttttattttaaaaattaagataactaaagatatggagaggattagatttatacaactaaacagtgtatgaatttacaacataatatgggtggaagttaaggttttttcagtaaaactctagaataatgccaagatagaagaacaactttctaaagtggggaaatgccatgaaagagaaaggcagagcagtatacctgatccctgttggtcttagagcttaacaaagaaacccttgtgcttagaagcaaaatgcttcctgtgtatactaaagcaaagccatagctcttaatttttagtctgtcaacagagccagggattgtataattaatatctgaattcacttccaaagcaatagtgattcccaattctgctttagtaatgcattctatagctacagctctttaatcactagcagcactgtccattagacctttctgtgatagaaatatgcccgataattgctatccattttggtagccagtaaccacatgtccctatcgagcacttgacatacaaccagcacaactggggaattttaattttatttaattttagttcaatttaaataaccaaatgtgaatactggttaccatattggataatgtagatttaggccctcatttataaatatgagctaagcagactaaactttttaggaaaatagaaaccatgaaacgcatgctagaaaccctcccatgcccagttaagagaggtaatgtaagtcacagaagagtacttttaaaaacccgaaacccgaagtatcctaaattatatccttaatgattcaaatagctttcaaagtccaaaaaccagcaaacactgctgttgaaaaaaaaaaaaaaaaaaagaatcctgtgacattgcttaaaaactaccactgtggttgtagaaatgtaaacatcttaatagaaaggctgaataggacaaggttaaagactaaattagtgatttgggagatcaagccaatgggcttgtctaaaacctagtcaaaaaggtcaaagtgataaaaattatgaaataaaatttgatatttggaggctcaagctaagaaagctgctctgtctaaaggaaatacagaggacatggaaggtaagaaagaaatgataaaaagaaaaaaaaaactccaaagttaaggaaaatcttaagccttcaagtagaagggttctatcaagtgctttctaggattattgtgggaaaaagatgttacctagacatatcatggtgaggttggtaaactccagtggtaaagagaaattgctaccctctttcagaggaacaaaagaggttaactacaaagcaactgtaagtaggcatcagacttctcatctattatcataaaaagtagggtaaggtctacaaaatactgtaaaggagtattttgaatttagaatttcttatagagctaagctatggctcgctcatatgtcagggcaaaaaatcatccaggctgaaagtttgtcaaaaaaaaaaaaaaaaaaagtatacatttaggggtgtactccagaatataaaaagatgcgagagaagaaactgatgaaccaagaacttaggaaaactgggttaactttaaaaatgattgacaatatggtagtgaaatttaatgctgttgttatatagaattataaaaatagaagaggtaaatcttttagaagaaaaaaaagtaaactcatagttccaggtttcaaccaaacctagggattaaaaataaatgcaagctaacgatcttgtcttgtttgggtggtggagaagccacaaacaagaaaaatcagtattgccatcaaaattttaaagtctgagtgcctatcattctggcctttgtagtgttaatagtctagctgggagataagaccagtgtacaagaagcaatagtaagcaatctagtaatattactaagaccttcttatgataaaaagcttaaaattaaaaatagctgataagttcttgaagtagatttttagttcattagtaaagtgatatttgaactgtagtagtatttatataatataacattaaaaacacggggtttctcctctctgtaaaaaacagttaactggattactttattttctgtcctttatcaagttacttgcatttcatggccaggcacagtggctcatgcctgtaatcccagcactttgggaggccaaggcgggtggatcacttgaggctaggagtttgagaccagcctggccaacatgatgaaactccgactctaactaaaaatacaaaaattagtagagcatggtagcacattcctgtgatcccagctacttgggaggctgaggcaggacactcgcttgaacccaggaggcggaggttacagtgaatcaagattctgccactgtactccagcctgggcaacagaatgaggctctgtctcaaaaaaaaaaaaaaaaaaaaaaaaaaaaaggcaatggcttatgtgaatatctgcacgagctgtcaattagccctgtatctatatgcctccttctcaatgcaaatttttctaaaagctcactttgaagaaatcagttagttaatttcttattttaaacactattttaactctaagaatatattgcttgctgttcagatttatagaatgcactgtgaggaagggactacacatcatgaatcttctgaatctttgagatgcttagcataatgcggagtacatactagctcatatttttttggattgttcctgtagacaataaagagatggtcatgatacagactgtacttaattctaacctgtgacacattttatagtttaatatgttggaaggagtcctaaacttggagtcagggccacaccaggagtagactcttcacatgaatactgagtcactctttatataactgtgggtgagttataccaactctttataagttagaatatcaataaataacagtaccacttattttccttcacacaaggatgatttgagaataaaatgaaaagaattataggacaaattcagatacagcaaaagtatggaaataaaaggtagtattttattacaggtaatttgcattcttcattaagaatatatattaattttatcccttagatttttatattcttgtcatcaaaatcctctttctgctgtttctaagagtgagaaaatgctctcaactgaagttaggcaggtcacatgtgaatactgagctttaaaccaaatgaatcatggtacaatctaatttcttcctgatgtgagttgactcttgaattcattgttaccataaatagggtattcttgtgacatattaatatgaccagagcgaggcacctatctttgaggaagttagttttaagatggtcattgtcctcttacacctgccccaagtaaatgacttacgaagcagattttttttaaagacaaaatcatttggtttgtggacattaccaattattatgtttgtaagacttaactccatacatccctattaggaaatctcattcttcttttttgtttaatacatgttaaacaatagtccatcagtggtttgtctcttttaagatcactaacttggggcataccgtaccggttggacaagatctcaaatggtgacttaacttttaatgagtgcttataaaaacatgtgtgttgcctcatgacactatgcaattgctgctttagtggtgctttttgcattccagttgaattgtacataggttggcccatattgctcaccatttagttagatcttcattgtttagatctcagtatgttgaaaatctgggaacagcatcatagaaaactatatcctcctctcttagaacattgcttagcaaaaattatgttttgttctctaaatgaacttttccaacttcgaaattttgtgacttttaaataatgtataatactctaatgttattctaggaacaagccagcatgtttggccttatttacaaagcagttaatataccagtgttagaataagtcaaaacactgtaccaatgaaaatgtgtgctcttccaagtagtatatgtgttttattttaatatttagaagatctaaaaagctataggaacacatgttccacttgtaacttaatagcatgccttaaacttaaagatatctttttatggattctgcctctgctgcttctgattaattttgtgacctcaagcaaatctcttaattctttgagccttaggtttctcatctgcaaaacgaggataattatacctactcgtagccacaagaatgttgtaaaaatagcagggagaatttttatacagaattagacatgtggtttgtagatttatggtagcagtcttttgaataaaaattatttagtttgctattatttttataataaaaaccaaaagatttattttataataaactttgtagataaataattcttccctaagaatgcttttgtctggacacctgaccaaagtacagccatgttccatgcacataaaatcactcagacttgagtaagcagaagaacattgaccagaaacataaacaaccaagcagggagctaaatgataaggatactagaagatctgagaagatagaaactcatgcatatagctatatttcctttaattttcatgtggatattctctgttggaagataatgttccaggttctctattccctgtttttccccaaaatacttattactctcccgttaattatgatttgccactttctgtatatgatgatgaaggtatggctatgtggacagtaaagacagaaacaggccaggcatgttggctcacacctgtaatcccaacactttgggagactgaggtgggaggattgcttgagccccaggggttggaggccagcctgggcaacatagtgacatagtgagactctgtctctaccaaaaaaaaaaaaaaatagccaggcatggtggcacatgcctgtggtcccagctactagggaggctgaagtgaaaggatcacttgagcctgggaggtggaggctacagtgagccgtgatcccaccactgcactctatctgggtgacagagcaagaccctgtctcaaaaaaaaaaaaaaaaaaaaaaaagacacaaacaaaggttgagaatcactgatctagaaattacccacatttcttagcatgttcctaattttagattcactagcacatttggtctgacctttgaacttataactaaggcagaggtaattcagtgggaagagtgaggaagaaggaatagtctcccaaccttcgaggtgtttagatttggcttaaatttcaggaataggaataaaggccagaaactactgatgtaaactttattttttctgaccatggaggaagtcaatccagaaaacagctgatttctgtacagtgcagtacccatgtcaatccatgtctgaattaagggactttagtcatacagagtgagaatctgggaaaaattacatctgggggtgatgccttttgatacgtgattttggaaaagcttcttaaatgatagctcttctggattcctgacttatgcctctaccatatcttttcctgtcagttcagagattattctggagactgtttctgcgtatgctagactaatatatcagatatctgaaacagtctccagaatgtttagtctgtaactaaacagtgtttagtctgtaaacactgtatgtttcaaagctttctttaagtcacttgtttggagctcagaattcatcaccccaaagaatcagtgctctcaatggtgaaattaaaaatcagtctaagatttagtttccaaaagaaaggcagtatggaatagtggggcaaatgatgaaatttggagtcagaggcgtggccttgagctctggttgtaatatttggtagatgtgtgatcttggacagattattaaacctgcctggatttgtttcttcctatataagataggaatagtactattcatccctcaagatagttgtaaggaaatgatttaattaattgtaaaaattgatttttaagcagaaggtactctacacttgtcagcgatttattatttctcacctacactaaccagtgttgtttaaactataagaatcataactttctttttcaggaaaagtatatcacgtccttaatagtattcccagtagcagaggtgagatagggaacacatttctctagaaatgtcggtttgctttagctgcctagggcagtggttcttagactttggtgtgcttaaggatcatctggaaagcttgtttaaaatgcagaatcccaggtgccagacattcttaatcagtatatcttagggttgagtccaggaatgatcattcttaacaagactcatctgtgattctgatgtatgtgctcctcaaatcatacatgaaactattctagtaattaccttctcctgtatttgatgctcagatctgatactccagtctacatgagtagctttccaaggagcacacacactcagtttgtacacactcagtttgtacagtttgtacacactcagtttgccttgggaaatggtcgggggaggaagagattattttcatagaagctcattctatctgaattctttcttggcattaatcataccttgcttgctctagtgcactccccatcccttaactgtaggttgtcaaagtgttgtctatacaacagaaactcctgagttataaaaccacaatctcagaaggtagggcctggaaatctgatttttgatatagtcttcagtagggtcttatagacactagagattgagaactggcttaacagttgctcttctacagagtcatgactttgcctcagctctgtactaatcattttctgtgtaaccatttattgaatctagatcatttcatctttatgagacaatctacgataataaaaaacaaaacaaaaagaagcaaaccctggggaaagaagagaatctgacttccagggttactatcttatttgattcaaatgttcggttttcaagaaaaaaatcataaggcataaaagaaaaggaaaatatggctcattcaaaggaaaaaagtaaatcaacagaaactgcctctgaaaaagaagtgatggtggatctattagaactttgaaatagctgtccgaaagatactcaaagaactaaagaaagatgtggagagagtcaagaaaatgatatatgaataaaatgtaaatatcaataaggaaaaatcctaaaaagaaaccaaaaagaaattctggagctgaaagtagagtaactgaagtgaaaaatttactagagggattcaaaggcatttttgagcagccagaagaaagtatttgtacacttgaagataggacaatggaaattgtcaagtatgagaaacataaaagaaaagattgggaaaaagtgaacagagtctaaagaatctgtgggatacccttaagtggaccaacttacatattttggggattccagaaggagaagagagaaagtggcggaatatttgaagaaatactgcctgaaaacttcccaaacttggtgaaaaacatgaatgtaaacatccaagaagctcaaagaactccaagttaggtgaatttagagacccacattgagatacattataatcaaactgttgaaaaccaaagacaaagaattttgaaggcagcaagagagaagtgactcataatttagaataatccccctgttatatgcaggaggaaatgctccaactttttcctactacacaaattttacagatagatttgttcttaccatagatcttagcaatctcaatgcacaatttgttttttctaagttgagaactttcaccttttcacttaaaggaaccactctacaacttctctttggcatatctgaatcgctagactgctcttgggctttggggccatgttacgtgtaatagtaacttaacacatggccaaggaagttatattcaggagatactttgtcccctgtagaaactaaagataacatcataacatatgtctttgagttgctttttggaaacctggactcccactagatggatctgctggcgcatagacctcagataagagggaactgagaactaaactctaactgctattgtttgttctaattttctttttgaagagccttcagaaggtcatgcccataagccagagctaacttttttttttctgatcccgaatttttagacaaagtttcacctccttaaccaatcaccaaccagaaaatatttgaatccacctatgacctgtgtgctcccatttcaagatgcccctcctttttaggtcaagccagtgtataatctccatatattgatttatgactttgcttgtcacctgcctttaaaaaccattacctgggctgggcatggtggctcatgcctgtaatcccagcactttgaggggccaaggtgggcagatcacttgaggtcaggagtttgagaccagcctggccaacatggtgaaaccctgactctactaaaaatacaaaaattagacaggtgttgtgccaggcacctgtaatcccagctacttgggaggctgaggcatgagaatcacttgaactgcactctagcctgggcaacagagcaggacactgtctcaaaacaaacaaaacaaacactgtctcaaaacaaacaaacaaaaaatccttacctgtaagccatctgggagttcaggcatgagctgcccagttctctttgtttggcgtcttgcaataaatgcctcactttctctttctgctatcagtatttggctttgctgaaaatttaaacatgtttttgcatcaaaagacacttatcaacagagtagaaaggcagctcatagagtgggagaaaatgtgtacaaatcatatacctgataagggattaatagccagaatatatggtcgagaacagtggctcacacctgtaatcccagcactttgggaggctgaggcaggtggatcacttgagcccaggagtttgagaccaacctgggcaacgtggcaaaaccctgtctctactaaaaaacacaaaagctaggcaggtgtggtgccttgtgcctgtagtcccagctacccaggaggctgaggtaggaggattgcttgagcctgggaggcagagtatgcagtgagccaagatggtgccattgtactccagcctgggcaacagagcaagaccctgtctcagaaaaaaatatatatatgcagaatatataatactataactattactcaacaacaaaagaaacagcccaattcaaaaatgggcagaggacctaagtagacatttctccaaagatatgcaaatggtcagtaagcacacaaaagcatgctcgtcactaatcactggggaactacagatgaaaactacaagataccacctcatactcattcggatgactattatttacaaacaaacagaaagtaacatgttttgaggctgtggcaaaattggaacctttgtttattactcttcgtgggaatatgaaatggcacagccgctctggataacagcatggtggctactcagaaaattaaaaacaaaatcattatatgatcatatgatttcacttctgggtatatccccaaaagaattgaaagcagggtcttagagatatttgtacatccatgttcatagcagcattatttacaataactaaaacctagaagcaactgaagtatccatctagggaagagtagataagcaaaatatgttatatacatacagtgtaatattagccttaaaaaggaaggaaattctgacatattctacagcatcaatgaaccttaaggacattatgctaagtgaaataagccagtcacaaaaagccaggcgcagtggctcacacctataatcccatactttgggatactgagacaagaggatcacttgaggccagcagtttgagatcagccagggcaacacagcgagaccctgccccccgacccaaaaaaaaaaaaaagacaaatactctgtaattccatttacatgagatacttaaagttgtaaaattatacagacagaaagtggaatgatcgttgccaggggctaggaggaagggacaatgagagttatgtgtttcagatttggaagatgaaaagagttctggacatggatggtggtgatggttgtacaatatgaatgtatttaataccactcaactatacacataaaaatcgttaagttggtaaattttatgctctgtgtatttaccaggggagaaacagaaaaaaaataactgttggctgtttggtctcactccctccgtctttactctgtaacccatcttctgtttgagaggccacttcagtaatacagattatataaggaagtaaagagatatacaggtgaaagaggaagaagtaaaaaaagtgacctaagtttttttatctaaagatttttaaagatgaggtttgggacacaggaggaacagattgtattgctaattgagtgattgctgtttggtctttgaatctgaggtgtctcaaggatttctgtgaggagaaaaatgggtatcttgcctgcaatctgagacatcagaacttccagagacatgagttagcactagggacatagttttggatgtaatcttcgttgagctcattgctgaggctgtagttatgcattcagttgacctggagaaaatagtgtcaaaagaagggactgaacagggttgagagagaaagttgatgactaaaagaaggagatgtattggcaaaacatcttgagaaggaacaaatgggattgaaagtattaccctacttgtagagagtcttttttttttcaggaaagacatattatttctagataaagtgattggcattcaaaattttgaggaaggaaaggtgtgcttcccatattactgctgcaacaatatagctatttgtttccatttacatgagtttttcttgagttattatttactacgagtgactcatagttaataatgaagatagttcaaagataattttaaaacattgcattgtagatcctttcttaaaaatattttctaatgttcataacacgccttgctgaattggaatggagaaaattaaaaatcttcatactagagttctttgttcaagctttttttttttttttttttgagacagggtctcactctgtcaccagtggtatgatcacagttcactgcagccttgacctccctggctcaagcgatcctcccacctcagcttctggagtagctgggaccacaggtgtgcaccaccttgcctggctaattttcattttttttgtagaaacgggatctccctgtgttgcccaggctggtctcaaactcctggactcaagtgatcctcccatctcggcttcccaaagtgttgggattatagccctgagctaccatacctggcctgttgaaactttcaaagttgcgatagatttatcagcgcagtgtttgttagaatgcttcgcaaatatttatttgttaaaatacaatgccaacctattttaatttccttaaaagtaagtgagaaaaatatacttgggaaaataaagttgcttaaataggttttctcaactgccagaaaaaggtactgccacagcatgtttctgcctgtaggtaggtgtggctccactttgtgtatgcattaggtttgtcagtgaaaatctcggtagtttgcttggttgctgaaataaatcagtggttagtttgtacacagaccctgtctgcataattgcaactgaatagctttgcccacttattgaaagaatggttctctgtttgggatgatcagaactcattttatattcagtctttggataaaaatgtgattgttcatttttgtagatgtcatttgttaaagattctagcagtaacaaggaaaatgggaggagggaaatattatttcttgactagaaaaagatattgtgagtatattgaacaagaggatcattttgagtatttctagtatatactttcacttctcagtttgttattggtgttttaaaaacttgtgatgaatttagagtgaatgggagcaagagggactaaacttcagagaatattattttagctcacagtgcagatctatatcacctatactttagatatcttttaattaaatttttatagattaaaaatcaaatattactgaaatattgatatatgtgtgcatatcaggttttttagggtaataaatttgctcaacttggacttaagtttttgtgaagaattcttataagtgttgatttctctctaattagctatgtggaacaaacgtaatttcctaaaaagaagtaagctagtaataactttgattttatatttctccttaaatgacaaaccaattttactaccagaactcatttcaaaagtatttctgggctatttgtatgactagctcattttgtgaaataataaaatacataaaaatagtaaggctcagtaacttgtccaaataaggtatttttgaggatagtacacatgcaaattattacttcatatcacattttaaaagggcttataggtttgaaagttttcatatagtaggggtgttctgtctgtaggaaatgtagtaagttgattatagcaagaattttaattcctttctcaaaaagggaactgtcagtgtcttctattcttttaaaaaatcttaactgccaggataaaaaagcgaagcaagtttttacggacggtagtaggaaacatttgcctcactatccaaataattatgtgtactcattctaagtttggtcatttttttaaaaatataagtcagttgagttgagtaataatgcacaaatttgagacttgttgtatactttattataatagcaacaatgtttacaaaataaaatcattttgtaatgatttctgtattgatacagtggcaaataaaacaagaacatgaactatttttttctcttattcttatccatacatgtaaactctttttagagaagcttaataaagaagtagtacacacttgaccaaagaaaggggacatttattttttactatgagattttgcatctaataaaattgcttgtattttcttacaatgttgttcatatggaaccagaacttgttatgtataaatataatgggatgagaatttacatgtttattagaagttttctgatatttataggccaatatatttaaaatatatatattcagaaattggaaacatttaaactgtcaaagagtagataataggttaactaaatgatggtattactctgagagactatagtacatacaataaagacatgctttgaaagtatatatattaatatggaaaaatgaatgttataaaacaacatatgtggaaaaaatgtgaacttatgtaaatatatacttgaagtgctgcaaagtgtagaatctctgagtgataggacttgtctttattctttatctgtatttttataaaatttctatattttgaatatttatatgtaaagactcgttttagctctataaaattgatctgtagaggtatttttcatctataaaagtaataaagtccagtaaaaaataatatatatatacaatgctatattattgtatgattttcttatgtgtgattttcttattattgtatgactttcttctcttgtgctcttctaagttatataaattctccagcacctgagaaccaaaacagacaaaaccaaaaccaaagacattggaaaaaaaaatccaaattactatagagtacaattcctcatgcatatatattccaaaatcattaaccaaatactagcatatggaattcatcaatgtataaaaaggacaatatattacaaatgactggggtttatctaataagaaatggaatgttcatggactgaaagattgaatgttgttaagatgtcagttcttcccaagattgatttacagtttcagtgtaatcctaatcaaaatcatagcagggttttttgttgttgttgaaatcaacaaacagattctaaaatttatatagaaaagcagaggaattagaatagccaaacaattttggaaacaaaaatagttggaagaattgaagtactgatttcaagacttaccataaagctacaggaatcaacacagggtggtattggtgaaagactagacacatagattaatgtgacaggatctgaatccagaaatagaccttacacatacttaatttttgagaaaggtacaaaggcatttcaatggtgctggaacaattgtacatctgtatataattttaaaagaacatctacttggattctgcactatgtacaaccaaaaattaactcaaaatagattatagactaaatgtaaaatgtaaaattactgaacttgcagaagaaaacagattaagatcttttttattcaagagtcaaaaagtatggttcatgaaagaaaaaaattgataaattgttctttgaaattaaaaagatctgctcttaggaaaaactattaagataatggaaatgaaagcatggattgggagaatatatttgcaaagcatacatctgataaagggctgttaatccagaatatattaatatgtagaactctcacatctcaataataagaaaatgaacaatttaaaaaaaaaagacgcaaaagatttgaatagacacttaaccaaagaaaatacagggtggggccaggcacagtggtttatgcatgcaatcccaactacatgggaggcttaggcaggaggatcacttgagcccgggaatttaaggttgcagtgagctatgatcatgccactgcgctcaagcctgggcaacagagtgagattttgtctcttaaagaaacaaacaaacaaaaaacccacgatggcaagtaaacacatcaaaagatgttcaacattattagttattagagaaatgtaaattgaaatcgtaatgaaataatactacatacctatttgaatggctaaagtaagaaataaaatttcaagtgcaggaaataatgtagaaaaactggatcttcatatatggctggtatgaatgcaaaatggtacagcaacattgaaaaactaatagtttcttataaaattaagcattccattatacaacccaaaaatatcattcctagtaattaacctaagataaataatatgtccacacaaaaactcgtatgcaaatatttattagcactccaaactagaaacaactccaactgtcctttaattggtgaattgaataaacattatggtaatttatacaatggaatactattcaccaataaaaaggaatgagctcctcaaatggctatatacttaaccatttcatttacacaacatgctggaaaaggcaaaactgtaggagcagatttgaaatcattattacctgggaggtagtagaaaggactgacaaccaaggggaattagagaactttttggagtgatggtagtattggaagtttggttgtcagattcattagaactgtatacttaaaatgggtgaattttttgatatgtatgtacttctcaaaactgatttaagctgacgatcttttttaaaaaattaatatagaaagaaaagaattcaagttagcattcttcatcacttagtaaaatgaatgattcaggcaaagatcatgagtggatgccaaaaccatgagggaaagtgttactgtggtacagtacattaacatggcctccatagattattgtagccgttgtaatttgaagagatctgggtcaccaccttaagcaagttatcaaattcagcattgctgacaaggcaagaactggacagtatgtgcctcctgacttggagtaataggaagtacacaacagtagcagcatcacctatgaattattctgatccaaaaaatatttaaactggatatagttaagcctgtaaacctaacttccactttacaggaaataaagcaatgagttaaattacagcatgagaaaatggacaaatccagaatgtaggatattctctaaaatgacttgcttgttactttcaaaaaatattcatgtaataggggaaaaaacatacataggtgaaaagagagataacagatatacagtacttgaatacggattgatcctgatttggagaggaaaaaacagctctgaaagctgtcttggagaagttgaaatttcaatataaactgactacattcagtgacattaaggagttatctttcatttttcttaggtgtggtaacagtattgtggttaagcacgagaaggtctttattgctaggatatgatgagtattaagaagtgaagtgtcttgatatccataagttattttacctgtacccatacacacaaaaagcaaaaaggtaagaagatgttaatagttgtctctgggagtgtatatatgtatgcattagtattattgtttccactgttttctgcaagtttgacatttctcataatagaagggaatgcttttagagctaagttgagagaaatagtgtttattgaagatggccttattatatgtagtgcattcctgcagatcctatgactatcagggatctgtacctacattgtacacctaagaataactgtattgcactctgttttggcattgtaacactggcctacattgagaaccaggatagaaaacagttctgtgaaatgctttgtgttgtaaggacatttttgcgagcatcgcttactgtatcacatggtataggaaagatgaaactttgcacttcagtaacaagaatacttgtgctgcttctgagaaactggatttttggcatgttacagacaatgagttatgttttactgggtgctagaaagctcagatttcatttgtggcccatctctaacaagtgcactttccagctgcactcctgactgctttgtaatttccctcctgcccttacttttctctcattctgattccctcctctattttttggttgtgttttgtaagatactttatgtccaacaatgttctagccatatttaaaggaatttaaataatgtagtttatgatttgaaactcacaggctaaagccaggtgctgtggctcacacctgtaatccaagcaccttgggaggccaaggtgggcggatcacttgaggtcaggagttcgagaccagcctagccaacatggcaaaaccctgtctctactaaaaatacaaaaattagttaggcatggtggcgtgtgcctgtaatcctagctactcaggagcctgaggtaggagaatcacttgaacctgggagacagaggttgcagtgagccaagatcatgccactgcactccagcctgggcaacagagtgagactccgactcaaaaaaaaaaaaaaaaggaagcagcagcctaaaagtcagattttcacattattgttattagtcacgtgagttcttgcccccaaatccagggatcttttatcctctagccaaatttagaataagggactctttccagcaaatttcaaagtacctacttttaaatatgattaaataagatataaaagtttctatttctggagtaacattgttacagcagtagtggcataaaataccttattttaggagaagagtactgcagggaaaagaacaaagccagtttatggaaatagatttttagcattggaattggcattggcatttttctttgagaatttcatttttttaattctgtttttgtttgttttttgttttcagttaagaggagtaaacaggcctttgttttacctttggcaattctgaaagaattatgtacaaaaaaaacctaaggaaaaattattttagttgcttttgaatggtattcaaatttcttttcaactaccgtagtatcttccttctgttaaatgatactttataaaatatttttcagcatcagcatgttgatacagatataatatttacaatttgctcttgctaccttcttgggagttgaagtcctttctcgcccagcttcttttttttgttttttgttttttttttgagaaggagtttcgctcttgttgcccaggctggagtgcaatggcacgatctcagctcactgcaacctccaaatgccaggttcaaaggattctcctgcctcagcctccagcgtagctaggattacaggcatgcgccagcaccccggctaattttgtacttttagtagagacggggtttctccatgttggtcaggctgttcttgaactcccaatctcaggtgatctgcctgcctcggcctcccaaagtgctgggattacaggtgtgagccaccgcacccggccctttctcacccaacttctgtatggcattactgtgttaaagatatattgtttgacaacaaatagaatgcttaaagcagcaataacaacactgactctaaaatatatgttgtataggccgggtgcggtggctcacgcctataatcccagcactttgggaggccaaggcaagtggatcacttgaggccaggagttcgagaccagcctggccaaatggcgaaaccccatctctactaaaaatacaaaaattagctggcatgctggtgcacgcctgtaatcccagctgctcaggaggccgagacaggaggattgcatgaacccaggaggcagaggttgcagtgagctaagattgccccactgcacaccagtctgggcaacagagtgagactctgtctcaaaaaaaaaaaaaagttgtaggaatgatggctaagacatttttaagacgttatgtatatattaagtaggcatgttttttgatgttccttaagtttattctaactttgaaaagtattcatttgataagtaagggtttcttctttcactgattcctaagttcagtggactcttccactgaagattttttttttcttcacaaatctggaaagtagcttgttgaacgaactaaatgacctttataggcttttgtatttataaaacttttgattttatatttggacagacttaagttttaaccttaattacctatgatcttctaccatgagggatacactaaaagtaattgccaaaatagggttaattgtaaatataaatgtgaataaggttagattgtcatttccttccccccaggcagaaggattcctagaactaggattaactttctttgctcacatctctggaattcacttctgttttgccaaagaatggtaaaacaggtatatacttttctttcttctgcacctatttttaagtgaaaagtactattctttctcattcttactctcattaatttcttaacacataaaaatcaagtttaatttgatagtagtgcctgttagtcatatgaaccctgtacaacatatctatttatactgcttcacacatcactcacaggacaagttcccacaaagacctgttttgttctactgttgatccaccctaaagaaaccagtttccaaactctgcacagctttgtaaatcaagatgaactggtcagaaattggatacagaaacaaacaaggaaccaaagaatgcttcctagttaacaagcagaatgtgttatatacaataaaattgcaggtagtgaaatgtctgtgttctaagaatgttccaattaggaagttaatatcacattcatattgaagtcatagttcaaagtcattcagttaaggaaatataagtaatgcttagtaagatgttctagacgacagagaagacaaatgatgaatgtgaactttgcttctgcatttcttagctagctttgtccatgataactattaataagtacaaaggttgagaggacgaagagtttggtgtgtaggcacagatttccttctttctggcaacagttaggggcctagagtaagcaggggatatagtagcatgcagaactgggactctccatctatgtccagaaggaaggaatgcacccatacacaatttgtaagtaacagaatgtatttctcatcacaaagttaaacataatatattcacacttcctgatggtgaagattccttgaagaaagagaaaaattaaataaaatgaaatatattcacagcttaatttatggtttttcacaatatttctaaaatattttctcattgaataaatgttttatcaaatattttatctttttgtttagaactttcaagaatatcaagcgctgttcaaaaattgtttctttcagatgatctgatgtaaacattgtgcttttaacttaatatctaatagcctcccaaagaatctgcatacttgtggtgcatttctttctccccttgagaaattttaaaagaaaacaaaagaagcaaagaaaattttaaatgtcttctgctcattattccaacaataggcaaagaccaagctttcacagccaaagcaaactagagaattctcagagtactcagtgaaaatatatagtctgtgtcctgaatcaaatgagtatgttacaaaaatataaaactattagagaaaatacatgacacatttaaatttttcctatcttccttctttcccaacacattttgaaaagaaaattacaataaaaaacttttccttataaagccctttctccactacagatatttacatacaaatacatattatttaagtttgaagaaaccaagttagtagggggaacttttctaaaacttttttaacatgagaattcaaaagcataaaactgaaaaatgaaatgcctttttgcttccagctgcttctccctggcaccccttcctcaaatttcagtctctgttctcttcaacaaactgacaattcaggacagcccaatttctcagtttaattccaactcacggggaggatttgaattgttgaaatgatagtcttcaaatatgagcaaggttttcttttctattattatgtttttattgagatataacttacatactatgaaatacacatatcttaactgtgcagttttgagttttgacacatatatacatcagaatcaatgggaaggttaaaaattttctagatgagggccaggccccagtggctcatgcctgtaatcccagcactttgtgaggccgaggcgggtgaatcatgagctcaggagttcaaaaccaccctgggcaacatggtgaaaccctgtctctactaaaatacaaaaaattagctgggcatggtggcacgcgcctgtaatcccagctactcaggaggctgaggcaggagtattgcttgagccccaggaggtggaggttgcagtgagccaaaattgtgccactgcattccagcctgggcgacagagtgagactctgtctcaaaaaaaaaacaaaaaaaaaagaacgattgcctttgtaagaaaaaataacaaattgagtaatatacataaaaatacataatatatcataaattgttatgcagattaaggttcagttatattttaaaacttacatctcatacactcttttatgggatttgcaatgctggctcacgcgtgaaattctcaatttgtctttctgtttgtttttaagaaaattaatgcaaaacttcatgatggagtatgtcagcgctgtaaagaagttcttgagtggcgtgtaaaatacagcaaatacaaaccattatcaaaacctaaaaagtggtgagttaagattcttcattaccttacttggtggtatatgtatcatagtttattatttcatttcctgattttcaaaattgtgtccaaataaatgttaaagtaaatgatgaaaaaattccattctcccctgtagaatttcatcttgtgtgctgaatcttggtttgtgaaggccgacagatttaaaaagttaaattcatcatttcctgccccattctttcataaatatgcatcatttttatagaactttattcatgaaaggtgggttagggctgagaagagagtatttgttttctacaattctgtcttccactgataaggtaatactatgcaccataaattatcaattcttaaaacggatcagacctttagaccttttaattcaactcatgaagattacagaaatggctgaggttaaatattagaagtgaatcactagattgataacttattatttctttgggaatagaggtctaaatgaaaagatactagattttgtttctgatcctgccatccctaaatccttttttttttttctttctttcttttttgagatggagttttgctcttgtcacccagcctggagtgcactgatgcaatttcagctcactgcaacctctgcctcccaggtttaagcgattctcctgcctcggcctcccaagtaactggcattacaggcgcccaccaccatgcctggctaatttttttgtatttttagtagagacggggttttgccatgttggccaggctggcctcaaactcctgacctcaggtgatctgcccgcctaggcctcccaaagtgctgggattacaggcatgaaccaccgcgcccagacttaactcttgtgtaattctggggttctcttatatcagccttctgtgcatcctctacagctccctgacatccttcagctcagctgtgtaaggacaatattggagagtaattgctgcatgaaagagaaaagtgattatcttaaataaaaattagcattgttccttttacattataagatttaatttggtaatctatatagtagctatttagactatatttgctctctgttgccttatttttctgactattcaatagtttcatcatctttgaatgcattccttcttcctttatgggaaaaaattttgcttacagtttagaaaatcagtctaaataatagatacaatatgacctttgtttatatctactaaaaaattatgacagccttttgcaaatctgaaacttaagatataaaataatttgtttacttcaaaatatttgaacactgaaaggcaaaagtgttaaggaaggataaactaacttaagctttttagatttttttttctgtactccgttttggagcagtctagtatttattacaggtatagttgaccccccttttgttttattttatttatttatttatttaatttattttgagatagggtctcactgtgtcacctaggctgcagtgcagtgacataatcttagatcactgcaacctccgcctcccaggttcaagcaattctcctacctcagcctcctgagtagctgggactacaggtacataccaccatgcctggctaatttttgtatttttttggtagaaacaagatttcactgtgctggccaggccggtctcaaactcctgacctgaagtgatccacccacctcagcctcccaaagtgctgggattacaggcgtgagccacgcccccccccccccctttaaatagttttaccagcttcttgctccttttagtcttttcttcctctagcatttcctcccaaaagaaaacactcttaaacaagtctgatgagttttatgcttagtggcccaaattagcagtaaggaaatttggcaactatttgcattacccaattttagatttccatgaatgaattgtgttctctgctagagtaattagatgttgattgcaaaataaatcatgtagttttagttaataggcctcatacaagatttgtagctttctgaatattttcaacaagtttttattcctataaaggtattttaagatttcatgatccatctccattttctctttatagtgttgtttcctaaaagaatttgaagtgtaggcaataaacaacatttatgtagtcacagcattttaatagattagtgctgtgtaacaaaggaaatgatttaaaaacattcctgccttatccatcatcagtatttaaatctcttacctttaatatgtgctaaatcctatatgtttatcttcattttaaatgtgtcagtgtgtaaaaaagatcacatcagttattgtaaattttccagatgctatattttgctgtagaacttctgaacttatgtattttgttttctcgcgacagagcaagactccatctccaaaaaaaaagaaactgctagttaaaacaagatcttgtagaggaggaaaaaagtcctttccttctaccagtctaagttctcacccttggctctctaacaaaaaccagattaagaagagaaaaatatacagatttatttaatgtaagctttttgtgacaccaaagccttcataaggaaacaaagacccaaagaaatgggtaaacctgtgtggttttatgctaggtttgatgggagtggaaaatcatggggaaaatgtgataggggataaaaacaaagggctaagcatagtaaactaaatgagctaagggtagtaaactaaacagcagggcttgttcattcagattcctcttactgttcctctgtttttagagataagcatggtcctttcctctaggtataggaagggcacctctcatataagggtcttatggcctacttcaggggtggatcagagagtccttcctacatttgctgtttgtcacatttcttcagctcaaaatactcagtatgccaaagcgccatattttggggtagcatgttctgaatcccatcagtctaaacatattacttaggaggttacttgcctggcctagaacatcatgtatttcagaaggtcctgaacacatggcacattagacatactggaaagcctagctttcaaactccaatccaggattgagagtgttatagaaagtaaaactcacttatattcattcacttcactttctctgcatattaagacttgaccaacattgtaagggatttgaatccattgcttatgctgatggtagcattacttaaaatgtttaatgttttgttcaagctaatcacttatgaattagatttgtcatttgttagggtttgtatatgaattttactggatataccttttgtctttgtttttttttgaggcagagtctcaccctgttgcccaggctagaatgcaatggtacggtctcagctcactgcagcctctgcctcctgggttcaagcgattcttctgcctcagcctctggagtagctgggactacaggcacacacatgccactgtgcccggctaatttttgtatttttagtagagacagagtttcaccatgttggccaggctgatcttgaactcttgacctcatgatccacctgcctcggcttcccaaagtgctggaattataggcatgagtcaccacacccagccttggatatatcttttgtataaagatttatttttctgccatgctgagtatttccatcagttaaaatgttgaatattgtttcatgtgtctatctattgccacaaattgtgtaactaaatgatgtagataaagaaaagttctgcacaacataaaatacagggcatggtggggctttttataagtgacatttcttttagaagtaataatatcctggatattgggaaaattaaaactttttctcccatttgtttaccttgtgaatcaccaaaaaccgcgtgttaattagcaaatttccatttgttcgtgcgatccaatgccaaaagttaaatcaaagaaaaagagtttgacctataaactcttcagacttacctgtttcaaccatgggaaacaaaaattttactgcgttcgtagctgacagaatattgcatgtttctctttttcttttttcagtgaggtgacatgctgcagtatttttataaacatgttctttatggaattttctctcagttactgaatacaatcctggaccatctccagagactttttagaaaagaataaatgtcctaacttaagttggaagagagatgaattgaaaattatgtatgtactgaaggaggataggatgatggctatgaaagatgaggggataaaaagcatctcacttatcagcgatacataaacagtgtgacagtggtactgtcctttgacgtaatgagataaatatctctgactactcaaagctttaggtctttataggaataaagtgataagctcataaagataaagcaccaagaccagccaccacccttaattagaagtcagcacaatctgtaccaagatcctcctacccatttcttaaggccagtacctactactccctgcgggagggctgcaatggtgctgtcagtatctcccttgacacaggatggcataagcattgttagacttgaaaaagagggttcagactttaagattattcatatatataagaattagggttcaggaaaagtctaaatctttttgtataaagttttatttttcaagtgccttgttttttacttttgaaaaagaaccccaaaataaatgaaaaccattcattaccattcctggtcaatcccaagtcattcatgaacctgtaaataatctcgatatggagctgaattgttggagaaacaagagatcttataaatataaaacaatcccagtcagtaatgcctatgaaaaaaataaacgtaaaaatatattaaataatttgtataaatcttaaggaaggaatcttgatatttttatacttaaaagtcattatagacatttatatatttttcaaggtactagaaatataaatgtttaaaagattttgtccctttcctcaagcagtgcaaggccagatgaaattagttattttctttattctgggctcagaaggattatacttcttaccaagacaaaagtaaagcagatggaggtaagattcaaatgcaaattgattggattccaaagccttgttttccttttctctcagtgatttctcagcattgtattattcaattcaaaaagtccttttctcctcttcacctggacctaatgcttcattaatttttacaaatatcacctatcttgtttatggacattgtctgctgttgagtaccacatatcctgctgaggaccaccttgcttttatttatttatttatttatttattcattctattttttgagacggagtctcgctctgtcgcccaggctgtagtgcagtggcacgatgtcagctcactgcaagctccgcctcctgggttcacacaattctcctgcctcagcctcccgagtagctgggactacagacgcccaccaccacacccggctaattttttttgtatttttagtagagacggggtttcaccgtgttagccaggatggtcacctcgtgacctcgtgatccgcccacctcagcctccccaagtgctgggattacaggcatgagccaccatgcctggcccagcctgcctttattttttaatacatatacttgtggaaagataattggattttgctttcaggccctgaaatgcctatgctggtacctagaaaccttttttgacttttatttcaggtaaccaagcaaccttttctcctattaatttagaaatgtggcagacgaatacccccatttatgtgagaatctcgagcctgcttttctctacctattaaaaaaaaaaaatcaccagcattataatgttagccaatgtttaaccttgccatagtagtagaaaagaaaagagaagctggtataaaacagcacagtcctcaaacagattggggtctgagcttggaactggacctgtgaattctttacatctgtggttctcagttaaggaggtggcttgaggatggagtttgtccccaggaagggtgctactgacacacagtgtaaagagaccagggatgctgctaaacatcccacagttcacaagacggcccgccacaataaagaaacacccagctcaacatgtcaagagtgtcttggttgagaagccttgctctgtaccgaatagatagatactcacaaagccaaggcactgaaacatcctgtatcttagttcagtggttttcaaacttttcagctgtcaaattctttaataaaacgcttatccaggagtcccatgaatacaacaggctaaaacagaactgccctaaatgaggagaagggagcccagaccttacaagctgtgtgataaatgttcactgaaagaagatttcatcataaaaatatttcaagtgaaggaggaaaaagctaatataacctgccttggaaccagcattactctagagatgtctggcctgagagtttcatgtcatgaggatgctttattccttaaaaaactgtttccttttcattaaatattttaattgaacagagtcactcttctggccctcacatccaggtatttaaccccaccagatttattgcctctcaacttttgttcccactgattgcccaagtgtaccccttacctattcatacttcattgcattgaataagtaaattctcctcttttaaattgatcgttgcatctcatctcacctctactcagatacctctgtggcttcagagttgactaaaccagtggtttaaaaaaaagtgggggagggaggcaggcacagtcgctcacacctgtaatcccagcactttgagaagctaaggcaggaggatcacttgattctaggagtttgagactagcctgggcaacatagcaagacctcatatctacaaataattttaaaaattagccaggcatgctgacgcgcacctgtggtcctagctgctcgggagactgaggcaggagactgaggctggaagatcacttgagcctgggcagtcaaggcagcagtgagctgtgatcacaccactgcactctggcctgggtgacagagcaagaccccagcttggaaaaaaaaaaaaaaaagcgtattttacataagttgagtcaagggctccagtggtgatgggtgggactctagcagcaggaggctaagagagctttgtcagcagagaagttctgcttttatatgtgtactataatgtgagagttggctggggggattggttggtcggggggagggggtcctctagactgtagggaaaaaggtgttactgtttgggagaaaatgagatgggggactgagatgttgccaaataggttatgttacaggacaggggtcccaatccagaccccaagagagggttcttggatctcgtgaaagcaagtttattaagaaagtagaagaataaaagaacagctactccacagacagagcagagccgagggctgctggttgcccatttttatggttatttcttgatgatatgctaaacaaggggtggattattcatgtctttgctttttagaccatgtaggttagtttcctgacattgccatggcatttgtaaactgtaatggtgctggtgggagtgtagcggtgaggacaaccagaggacattctagtggccatcttggttttggtgggttttagccagcttctttactgcaacctgttttatcagcaggtctttatgacctgtattttgtgctaatctcctatcttattctgtgacttagaatgtcttaataaccatctgggaatgcagcccagtaggtctcagcttcattttacccagctcctattcaagatggagttgctctggttcacacacctctgacagttatgccaccataaggctgccttcctaaccgtgtgcttgctccctctttgctacaaagctttcttgtaactaaattagccaaaccaagacgttaaagataatattttattaaccaacccctttcctttttttagcctctatttttaaagggaagaatttctatacccctaaaatgttgcttaatagagtatcactgtcctcatttttcaatgaagacaaattagtggacagagagatatattggccagtttatggttaaattcatgatagtttcttgcactcagtccttggcattgtattattgtatgtgtctatcaattggcattcattacttatatttgttcattgagtaagcactcaaggaaaccagagtctccttaaactagttgtaatcacaattttgataggttatgttaaaagaaaactttagacaaattaaatttaacagagtttaattgagcaaagaatgaagaatcaggcacctcccagaaccagagtagtttcagagcaactctcagggctgccatgtgcttcaataacggttttggacagaaaaagggaagtgacctttttctgtccaaaactgtccaaaggtcattttcctttttctgtccaaaactgaagtacataaacagctggattggttacagcttggcatttgccttatttgaacctactttgaacaattggctgactatggttggctgagacttggttactgttacaatagtaggttacagtcagtttacacatcaagttatgttacagttcagtatatagagagaaacctttaggccaaacttaaaatatgtacccaggcagctttaggccaaatttaatttatcagtagattccatctgtagccatccaagctgtacttgttctcagtgcttagaaactgagcataccactcactaggaggtacctgaggaataatgtatgctatatgcagtgatcagtacaaagtgagtccttgatctccatgcaatctgaatttgtagcatctgaatggagacctatgatttaaatggctaatttttatagtccgtatgttttaaccactttgacttgcctccattttgatatatttgtagtcaatgaaaaggaaaaataaatggatacaaatccatttagtttacaaataaatacatttgtagtcaaggaaaaataaatggattttttagtgcattactatgaaagaatttttacatgttttttcttctttaaagaatatgtttatttcaggacatctgaacattatatgccttattgtagaatcttctaataaaacaactgtttacatgctaataagcattgggtatcacaattggtaataggaaggggaatgcaaaagtttttttttttttttttttttttttgagacagaatttcgctcttgttgcccaggctggagtgtaatgcgcgatcttggctcgccacaacctccacctcccaggttcaactgattctcctgcctcagcctcccaagtagctgggatcacaggcatgcaccaccacgctcagctaattttgtatttttagtagagacggggtttcttcatgttggtcaggctggtctcaaactcctgacctcaggtgatctgcccgcctcagcctcccagagtgctggaattacaggtgtggaccactgcacccggcccacaaaagctttatattttataatacagttttagcgtcccaaattccaaatccaaaatgtcctaaaatctgaaactttttgagtgccaacataatgctcaaaggctatgtttataggagcatttcagatttcagatttttggatttggaatgctcaactcttagtattagcaaatatttcaaaacctgggggaaaaaaaaatctgaacacttctcaccccaaatattttagataagggattctcagtctatactagggtcatagccagagaagagtctttgacttgctcatattttctaaagagaaatagctaaagagaaatgaacaaagttaagtgccttcatgatagaatatatgacaagaagaaacagtatagaatgtaaaaggtcttggttaaaattgagtgtttaatttgtgtgtttattccctgaagactgactttttttttttttaagtagacacgaggtttcaccatgttggccaggctgaactcgaactcctgacctctgccagccttggcctcccaaagtgctgggattacagtcatgagctacagcaccggccaagactgactttctatagttttatgtttaccacttaaactaacatagcaatgtgattatttatccagttgatagattatcaagccccttcacatcctgccccaaatttcacccattatttttgttattaatttagggtatcagactaagtggaaatagaagatgaagttcatatcagttgtattcattacattttaaagatttattggctaagacagaagaattggtatttttaagcattgagttaaattttgcaccaaactccaggtgaaatctcagtcaatttcattgaaataagtaattattaaatatcatattactcagtgaaaaactgattacttactgctgcaaagaacataataaattaggaaggaaaatttgttctaaaatacaacaggagaaagatattaaatgattaaaacttcattgttagcctgttcctctctttagatgagtgtgtacctatgtgtagtttatttgaaaaatcaggtaagtttgtgatggcagaggttattaagatgaagatagtcaaaacataaatgctattttccagaatccaagcacaattaaaagatagtaaatacttcaacagtagtccaggtcttttctttctccttcctccccattcctcataaacacggtaaagatctactataaatagctgagaaaacccctgcagttgtgtatgtttttcccaccatgagccatgatacagcatcacttccacaaataaggattaggaatggcattgcagagaatatgtcttagatcaataaaatccttattagtaagaattgggatgtagaagtagctttggtattatagaacctttactggtattttggaagtgcagtctttgtactatttaaggtctgaatgatgtatcctttctagtggaattttaagtgtaaaaggttgaaaccagaacagttaagtcccttaaaactagaaatcatactctattggtgggaattttgagaattattgctggaattcttcagagaatgttcaggaagctggtgttgtttggggaaatagggtaaatggaaaggaaaagatcccaagtacttcaagctggcctaaggaggtaattgaaggtaattaaaatatatatatatattatatatatattttttatatttttatatatataaatttttttttttttgagacggagtttcgctcttgttgcccagactggagtgcaatggcatgatctctgctcaccgcaacctctgcctcccgggttcaagccattctccagcctcagcctcctgagtagctgggaatgcaggcatgcgccaccacgaccagctaattttgtatttttagtagagacagggtttctacatgttggtcaggctggtctcgaactcttgacctcaggtgatccgcccgcctcagcctcccaaagtgctgggattacagacgtgagctaccgcgcccggccagtaattaaaatattttaccctgaaaatatatttctttgatgtattttgaaatggctgccacttcaccatcctgacaaaagtggccttgcaaagctgtcttaagtagggaaaattggtatccgtatagaatctccattaatgcagtcataccccctcccctttctctttctttccccagatccaggagagactgagagcaggacacctttaaaagtctctctgagggaggctcctctacataaccaggccacttttgctggccaaacctcttccctgctctgctttaccagaatctaagcccccattctttctataacctcaagatattatataagtttctgaaactgttgagaacttggatcttcattctgaaggctcctgtgtatgcacattaagtaaatttatagccttttctcctattagtcaatccacctcttgtcaattatttttaacaaaactttaagaggccaagggccaatggctgccacatcatatatattatatattttaaccccagaatttgaattcagagtggacaaataagatatttattttaaatttaacattttcttcttttttttttttcttttttgggacagagtttcactcttattgcccaggctggagtacaatggcacgatctcggctcactgcaacctctgcctcccaggttcaaatgattctcctgcctcagcctcccgagtagctgggattacaggcacgccccaccatgcccggctaattttgtatttttagtagagacagggtttctccatgttggtcaggctggtctcaaactcccgacctcagatgatccgcctgcctcagcctcccaaagtgctgggattacaggcgtgagccactgtgtccggccaaagttaacattttcaaacctctgtcacatatgttggattctaataacaaccctgtagaggtagcaagaacagataaggaggtagccttagaaaaattaggtgtcttactctgtaagctagtaaacagtatactcaaaactagcatctagattttttaaagtttcataatctatttctggcttttattttaatgtcaggtccctaacttaagtagagttttcctttatagaaccaaaataatacctgttagaacaccttgtcttgtgtaaccaggtctgctgttacctgcaagaaccaagaagctggactggatgtgaaagataatttactataattcacgtgttgtattaagaacaaaattgtctctaggaacagtccatggttatattggggaataatattccaatcagagctcttaatttctgagcaaaagcaagattgttaaagatgacagataggaaactgcgttcaatttgcaattattttaaatagcatcctcaatgtacaagacactgtgttgtatgtcaaaagaagatagcaaatgaatctgtgacgcccaggaatttaccatctatttggagagagagactccacagataattctgggcagtttgcaaaaagtgctaggtgtgagtaaaaggagaaagagatgcagaggacacaaggtaaggctgcagaaaaatgaaatgaaacccagagagacaggtctagaaaaaacttaaaggtagaagagtggtatgaataatcacagtgataggaaaccctgtgaggagggaccagggaatggagggaaaatgaacaagaatcctgttgactttcatagacaatacagataatcccgggctgtctttatatgtcctgtttttttgttccacataaattatcatttcttcattcatttgctcttgttactttttcttttttctcattgcataacttttggtgatccatgaacagtaatcaaagttgcctatcaaaaggaggtttcagtctattttgaatatacattaaatgaaaagaaaactaaacttggaaagttggcttagggtctggatttctagtttttaaaaactgggttattatttttgttattttatcaaacaaaagtaaacagttacattttacaggtcttttttgtctgtttttgttttttgagacagagtctctctctgtcacccaggctggagtgcagtggggcgatctcagcttactgcaacctctgcctcagcctcctgagtagctgggaattcaggcgcctgccaccatgcctggctaatttttgtatttttaatagagatggggtttcatcatgttggccaggctggtctcaaactcctaacctcaagtgatctgccacaaagtgctgggattacaggcgcaagccaccacacccggccatattctacatatctatctgttccttcatgtttaccagtgtgtggcaatgcacattggccgtttttcagttccaaattgttttttttttttttttgagacggagttttgctctttttgcccaagttggagaaaagtgacacaatcttggctcaccacaacttctgcctcccgggatcaagtgattctcctgcctcagcctcccgagtacctgggattacaggcatgcgccaccacacccggctatttttgtattttcagtagagacgggatttctccatgttggtcaggctggtctcaaactccggacctcaggtgatccgcccacctcggtctcccagagtgctgggatttacaggtgtaagccaccacgcctggcctccagcatttcttataacaggctgaggctctgaaggttaattagtgatttgaaaattgggtcaccacggccaggcgcagtggctcacacctgttatcccagcactttgggaggccaaggcgggtggatcatgaggtcagaagttcgagaccagcctggccaacataagtgaaaccctgtctctactaaaaatacaaaaattagccgggcatggtggcatgcacctgtagtcccagctaccagggaggctaaggcaggagaatcgcttgaacctgggaggctgaggttgtggtgagctgagatcgcgccactgcactccagcctgggcaacaaagtaagactccgcctcaaaaacaaaaaaattgtgtcaccacattccaagagtattaaaatgttctagagtggagttttagtcattgatagctctttgtatcacatgatagtataaaataactgtaaactgtggctgtattgtcgtttgttgcccacaaccatggtcttactgtctttaaaggtgaaagcagtagagagcttttattacttccttcaatgcctctccagttcatgaggactccagttcatgctttgatttaaaattgcctgccctaaagtattgaataatttttattttttatttttcataaactacacttggtcagaggtaaatattttgtacccgttatgaattatgggctgtaaacccagtattttgggaggccgaggctggaggatgccttgagcccaaaagtgctagaccaacttgggcaacatagtgagaccctgtcactacaaaaaatagaaaaaattagctaggcgtggtgacgtgctcctgtagttccagctattctggaggctgaggtgcaaggattgtttaagcctgggaagttgaggcttcaatgagctgtgattgcactactgtactccagcctgggcgacagagtgagaccctgtctcaaaaaataaaattaagaattattgtaatctacttgtctactgcattaagacaaggtagtatatatagcctcttcatttactttcaaacttgtaatctagggacacaaggaagtgaactgtgtaataagttcttatactcgagatacttagaatttggggatattgtttccttaaaagcattctctaagtagcatatgatgttatcccatagtaaagttttatgatcttgctatgttgactacagatgacttagagccattgcaggaaaataggactttatgaaacttcagcaatgttgcgtttctgttttgtacaccaagggtggagtactgtggaacactgtttacaaaagtacctcgtcatcacatacatgaaagtacgacaggagctaaattatgttaaaggttaaagtgtaataaccaggaaatgaaggcagtgccagaagagttgtaatcacgtaaagtcttttatttctagcaagtagtaatctattttatgtcagtcccaaagggaaaccctaagaagatagaggagaaattttacttccttcaaacagatttgccagatgttgataggtttaattatacaatacaaaaagttgtgttactggctgggcgcagtggctcatgcttgtaatcctagcactttgggaggccgaggcaggcggatcacttgaggtcaggagttcgagaccagcccggcaaacatggtgaaaccctgtctctactacaaatacaaaaattagccaggtgtagtggtgcgtggctataatcccagctactcgggaggctgaggcacgataatcacttgaacccgggaagtggaggttgcagtgagccgagattgcgccattgcactccagcatgggggacaagagtgaaactccgtctcaccaaaaaaaaaggttgtgttactatgacaacagtgtcataaaaaaatcttaagcgttttttgttttttaactggggttgtggaagggatgatacagtgattactagtataatttgatgctactgtttttgttcatgctaagctgccaggacttttagtatccattataaaaaatgagactcagagaagttaaagtaactttcagagattacattgttaccgggggatccttgctcccagagctcccaagatggtggcaggccacttccaagatggcggtgtgctgcttccaagatggtggtgagaggtgacggcgtgctggcagtcctcacagccctcgctcgctctcggtgcctcctctgcctgggctcccactttggcggcacttgaggagcccttcagcccaccgctgcattgtggtagcccctttctgggctggccaagtctggagccagctcccgcagcttgcagggaggtgtggagggagaggcgtgagcgggaacccgggctgcgcgaggcgcttgcgggccagctggagttccgggtgggcgtgggcttggcgggccctgcactcagattagctggccggccctgccgccccgggcaatgaggggcttagcacccaggccagcggctgcagagggtgtactgggtcccccagcagtgccagcccactggcgctgcgcttgatttctccccgggccttagctgccttcctgcggggcagagctcgggacctgcagtccgccatgcctgggcctcccacccctccctggactcctgtgcaacctgagcctcccctaccagcgccaccccctgctccacggagcccagtcccatcaaccacccaagggctgaggagtgcgggcgcacggcacgggactggcaggcagctccatctgcagccccggagtgggatccacggggtgaagccagctgggctcctgagtctggtggggacgtggagaacctttatgtctagctcagggattgtaaatacaccaatcagcaccctgtgtctagctcagggtttgtgaatgcaccaatcgacactgtatctagctactctggtggggccttggagaacctttgtatagacactctgtatctagctaatctggtggggacgtggagaacctttgtgtctagcttagggattgtaaacgcaccagtcagcgccctgtcaacacagaccactgggctctaccaatcagcaggatgtgggtggggccagagaagagaataaaagcaggctgccccagccagcagtggcaacctgctggggtccccttccacactgtggaagcttggttctttgcaataaatcttgctgctgctcactctttgggtctacactgcctttataagctttaacactcaccgcaaaggtctacagcttcattcctgaagccagcgagaccacaagcccaccgggagcaataaacaactccagacgcgccgccttaagagctgtaacgctcaccgtgaaggtctgcagcctcactcttgagccagcgagaccacgaacccaccagaaggaagaaactccgagcacatctgaacatcagaaggaacaaactccagacacgccgcctttaagaactgtaacactcaccgcgagggtccatggcttcattcttgaagtcagtgagaccaagaacccaccaattccggatacagtggcaagccttgtgttctctgacctggggtgcttggcctcacggattccaaggaatgaaatcttgggccatgtggtgagtgttatagctctactagaagctgtgggtcacggaagagaactgtggaacccagtgactagtgtttagctcagttaggacgaacccgggcacttagccgtgcaggaacaatggcaagcctttagtccagtcaggagcggcaatgggcacctggtaagatcaggagcacagcggacaccctaccggatccagagggatggaagtcagtggtgggtctgcgacggcagcaaacagcagtggtggacaatgagtgaaagctcagctcgagcagtaacaaacagaccagaagagagtgcagttgtaagatttaatagagtagaaacagagctcccatacaaaggtaggggacccaaagagggtagccattgccggcttgaatgcctgggtttatatcccaattattgtccctcccactgcgctctcaggcaatagatgattggctatttctttacctcctgtttttgcctaattagcattttagtgagctctctttactacctgattcgtcgggtgtgagtttagttgcaagcctgatgtttaaaggtggatgcggtcaccttcccagctaggcttagggattcttagtcagcctaggaaattcagctagtcctgtcagtatgacaaggacatgtcaagggcgggctagaatcaaggtctccagtttcccaaactagtgttcttttcctactattttattgccagtgctcaagtgatcatcccacctcagcctctgagtagctgggactactacactctggtaggtggtgtgcacccctacacctggctaatttttgttttttgtatagatggggtctctctatgttgcccaggctgttctctaactcctgggctcaggcaattctcctgcctgggcctcccaaggtgctgggtttacaggcatgagccactgtgcccacccaatagtagtatttttaagaagtatattgtttcctttatcaagaaacatgtaaacagtggtgacctgtgtttttatttgaccatagtttccactaaaatgattagttgtggtatatgtatggtcagaattgtttgagtgattgtttctgggaattgtgtgtgttaaagtgaactaaagatagcttgataatgactccctatttctatatttgagtccttgtggatgaactgcaacctaatttaataggtagacaagattgaaaacctaagtttaactaacaggagtatgcgcctgtaacaatagctgagtcttggccaatcccagcagccatacttcaaccattcatacactgctgagtgttcaaactgttcaaataaggcaaatgctaacctgtaaccaatccagctgtttctatacctcccttcctatttctgtactgcactttactttttttgtctataaatttgttctgaccatgaggcatgcctggagtctctctgaatctgctgtgattctgggggctgcctgattcgtgaatcattcattgctcaattaaactcctttaaatgtaattcagctgaattttttcttttaacatgtgtattccataaagaaatgaaaagaaggcaaaactatcatcattttgacatttctgaagttttcttagcaatggactcataaaatacaatatagccatttttaagggaaatttggaaaaatttatatttaggagaatttaaaatttttccttaccattttagggaggtttgaatttttcccctgaagttttggtaatctgaatctataaaacaaacataatacatagattaacaagggaaaaggatgtacaaattttattgtgtgcatacgtgtgcacaggagtcatgactataaaaaaaacgcaaaggcaagatggttaacgcttttgtatcatcttgatgttacagagagaatggggggctcagattgtggcaaagcaggatattgtggaaagacagttatgagtgggggagaagaggagaaacctgggcaaaggcagtcttgttatgcagatgaaacctcacaggtggtagccccacagggcctctggtaaatgtttctgtcagacctttaaagttttagagctgagttgatctttcctagatccagacaagggcgggattcagagaaagcctgtttatatctgttgtttacttcactttatttcctctgcagatgcaaatcatcctcacaaaagacagctttgctggccgtttgtaagatgttcaaaatacttaataagttttgtgccaccctctggcttgttttttcattcttttaagagtgtgttttgaagaggagacattttttattctggagagggcccatttaacaaattattctttctagatcatggttttgttgttgtagataagatgtctttgcctagctgagggttcttcttctagaagttgtataattcttgattttatatttgaatttatgttctatttcttgttaattttagggatagtcagtttttccaacattgtttgttgaaaagactgtcttttctctattcagtttcctttctactatcttgaaaatcagttggtcatatatgtacgtgggtctgtttctggtctttattccattgatctgtgtgtcctttcaccagtactacactaccttgatcactaccttgtgataagtcttgaaatcacatagtgagaattctccaacctcatttttcattttcataactcttttggctgttgtaatttctttgctttttcttatacaaagtaattaatcattgctagaaacataaaaatacagtttatgtttgtttactgaccccatatattgtgattttattaaactcactgtttatgtccagttcattttaaaaaatagattcattggtgttttctatatagacagtgattttttcttctaaataaagacacttatttcttcttttcaatctctatgacctttcttttttttttttttttttttttggctgccattgcactgcctaggacctccaatatcatgctgaaaaggagtgttgagagcagatattcttgccctgtttctgatcttacagggaaggtattcagtctttcatcattaagtaggaaattagctgtagtttctttgtagttatctgtttttaggttgagagtgtttccttcagttcatagtttactgagagttgttataaacggatgttatatttttgtaaagcttttttcacatctaataacatcatcatatggtttttcttagaacattgctttagtgaattttttttattggctttgaatatactgaattagccttgtattcccaggataaatccattgctgcatatatatatatatagagagagagagagagagtgcatgcaagagaatgagcatgcgagagagtgagcaagcgtgtgtgcaagatgtttatatattgctggatttgatttgctaacattttgtcatggatttttacatctttgttcattagaaatactcatctgtcattttcttgtttgctttttttttgtcttgatattagagccttatcaaatgagttgaaaaatatttcttcctatttgtttttctggaaggatttgtatatgatcagtattatttcttaaatatttgatagaatttaccagtaaagccatttgggcctggagttttccttaaaaaaaaaaaaaaattaggagagtttttttagagttatgattaaatttttctttaatggatagaggagtatatttatttcttcttcagtgagttttgatattctttctttgcaaaactttggctatttctacagagttgttgggcttatatgcatagagttaaatctaaaattttcccattattctttgttttttgagacagagtcttgctttgtcatttgttagaaataaattttcggtgccaccaaagaaatagcactcaaacataaattttctcagcaaggcaattttacttctatagaagggtgtgtctcgcggatggagcaatggcaagagtacacctgaacaaaggaggggaaggggttcttatccctgacgcaggtagcctctactgctgtgtcgttcccctattggctagggttggaccacacaatctaagctaattccaactggctattttaaacagagcagggatatgagccagagtggcggggtgagcagtttcggcaggaaagacggttatggaataggtgactaaaggtgactcaggtcagagtaggtgaccaggggtgactcaggacggagcaggtgaccaggggaacagatgtgaactactgattagaactggcgggaaggttgtttactgaaactaggggcaaagagatgaagagaacaaggaagttaaacttgaaaatggagaacaaagaactgaacatactgacatactgattctttgaagagaaacttagaactcgctgtgtttaacacccaggctggagtgcagtggcgcaatcttggctcactgcaacctctgtctcccaggttcaagtgattctcctgtctcagcctcccaagtagctgggattacaccaccatgcccagctaattttttgtatttttagtagagatgtggtttcactatgttggctgggctggtctcaatctcctggcctcaagtgatccacctgcctcagcctcccaaagtgctgggagtaccagcatgagccactgcacccagcctcttattattctttcaatgtctgttagatctatagtgctgtaccatcttttattcctgatgtttcagtgtatgtatttatgaattatattgatcttttcaaagagcctgcgtttggctgcattgattttatttttctgttttcagtatcattgattctgttcttattacagcacccctttgtttgctttgagtttaatttactgttctattttctaaaggtaaaagtttagataacttttttgtttaatataatttgtaatcatgtattaaaataaatttctcaaggacttctttagctccgttttgtaaattttgatgcattttcattgtcattcaatcaaaatattttctttttgtgtgtgtgaattcctctttgatctgtgggttatttagaagtgttttattttctaaatatttgagcattttctagatattttctgttattgattttttgttaatttcactgtggcaagatgatatatactttatataaatttcagggttttttcttttttttttcatacaaagtttcactcttgtcgcccaggctggagtgcaatggcacaatctcagctcactgcaacctccgcctcttgggttcaagcaattctcctgcctcagcctctcaagtagctgagattgcagatgtgctcccccatgcccagctaattttttttgtattattagtagggacggggtttcaccatgttggccaggctagtctcaaactcctgacctcaggtgatccacccacctcgccctcccaaagtgctgggattataggcgtgagccacggcacccggccagttttttcttttttaaaatatgttgaggttggtttcatggcccagaatatggtctgtcttagagaatgttccatgtatacttgaagacaatgtattgctcttgtatagagtgttctaaaattgtcattttggctgataacgttcatacagaataagtacctcacgatccttataataatatacttccaattcctcccggccaattttgtattattgttgtcatacattttacttttacatattctataaatccataatatatttccactattttgcctgtagactctcaattctattctgatgacctatatacgtctattcttatgtcagtactacacagtctgggttactgtaggtttgtagtgtgttttgaaatcaatacatgtgaatcctcacattttattgttccttttcaagattgttttggctatcctgggtgcctagaatttctgtatgaactttaggattagcttgtcaatttctgcaaaaaaagccagctggaattttaatagagagttcattgagtctgtagatcagtttggggagtattgctatcttctcaatattctcaatattaagtcttttttttttttttcctgagatggagtcccactcttgcccaggctgaagtactgtggcacatctcccaggcatgccaccacacccagctaaatttgtgtatttttagtagagatggggtttcaccatgttggccagactggtctcaaactcctgatctcaggtgatctgcccgcctcagcctcccaaactggtgggattacaggcctgagcactactcccggcctacaatattaagtcttttcatataaaatatgggatgtctttccgtatagttaggtctttagtttctttcagtgatgttttgtaattttcagtgtattggtcttgcacttcttttattggatttattcctttattctttggtagattgtttcttggtagtgtatagaaatacagttgagttttgtatattgatcttgttttaacacatttttaatgacactttaaaaaattttaagagtggataaatatccagcagttttattctgcagctgtaaactgttatttagaaatgtgatataattaatttagagtgacataagataaacacctgaaattgaaacctaggaattttgatttcttaggctttttaactatacatttagacacatcttattttatcaaataagtctgaaataaacataaataagttaacattttattttttattttagtgttaaatgtttacaaaagacagtgaaggattcttatcacataatgtgcaggccatgtgcctgtgaacttgaagtttgcgcaaaatgtggaaagaaagaagacattgttattccgtgagtgtttccttttatgtttgaattttactcttagtgattgatacatgaatttcttttaagagatgatccttgctaggcgcagtggctcacgcctgtaatcccagtactttgggaggccaaggcaggtggatcacgaggtcaggagttcaagaccagactggccaagatggtgaaacctcatctctactaaaaatacaaaaaaattagccgggcacagtggcaggcgcctgtaatcccaattactcgggagtctaaggcaggagaatcgcttgaacttggggggcagaggttgcagtaagctgagatggtgccactgcactccagcctgggtaacatatagtgggactccatctcaaaaaaaaaaaaaaaaaaaagagatgatccgtgatccataacccttagacttaagttgtatgtcaaactaatatagacttttaaaattatttttctatcattacaataaaagtgaaactatatttttaagaaaataaaatatttatgtgtgagattcatattcattacaaaagaattacacattatttaacaacttttcttttaatagacatcatatattaatttatttgagcctactttagtgacaatagtattataattggttggatctcaagttagcgttcaatgattttttttttttgagaaggagtttcgctcttgttgtccaggctagagtgcaatggcacgatcttggctcactgcaacctccgcctcccaagttcaagcgattctcctgcctcagcctcccaagtagttgggattacaggcttgcaccaccacacccagctaattttgtatttttagtagagacggggttttgccacgttggccaggctggtttcgaacccctggcctcaggtgatctgcacgccttggtctcccaaagtgctgggattacaggcatgagccaccactcccaggtggatctttttctttatacttacttcattaggtttctgttattcaagaagtgtagtggtaaaagtcttttcaatctacatggttaaataatgatagcctgggaaataaatagaaattttttctttcatctttaggttgaataaagaaacagaaaaaatagaacatactgaaaataatctaagttccaaccatagaagaagctgcagaagaaatgaagaaagtgatgatgatttagattttgatattgatttagaagacacaggaggagaccatcaaatgaattaatatcactgtattaaaagtctgccgggcacagtggctcacgcctgtaatcccaacactttgggaggccaaggagggtggatcacctgaggtcaggagttcgagaccagcctggccaacatggcggaaccccatctccactaaaagtacaaaaaattagctgggcgtggtggctcatgcctgtaatcccagctactcaggaggctgaggcaggaggattgcttgaaccctggaggcggagattgaagtgagctgagttcgtgccattacactccagcctgggtgacagagtgagactctgtctcaaaaaaaataaaataaaaagtcaatttagaatgtgaaattctgaccaccttttggctttgagtattttccaaaagatatttgaaatcctaatgaggaaatcagaaaaagctatggaaaaatagacaaatttcatacatgaacaatataaattgtgtatattacttaacatcaaactaaacaagattcagaattgatggttgtataagaactagctcatgtaaaaataaaataacattattacattgcctcaaaaattggtcctcggtaagtgccttttgataaatgatctcaaataaatgactcatagcaa

SEQ ID NO: 1388 - DNA, 93223 bp, Homo sapiens
caattcgggagcccgttctcgcgggattttccaagaccgggttggaatttgcgggggttaggagacggaagtcagagcctaggaagatttgggggtcgccttgccggcctcctgtcctcctccggcggcggcggagcccgagagaactaggtgaacaccgctttgccagcctcacacagcgtcccctggctctgccgccgctccggacgtcgccctcccgttctgcttgggtccccttagtcgctacctttgctgggatccccctcctccatcctgtggcttcgggttgccgaagagcgatgctcggagggcggccggaagtggcgttggccgccattggcctgccggccagccaccttgctgtcctccgccgccttccgggtgttacatgcagccgggctcggcccctccccctggccggatggatccgtcggcgccacagccccgcgcggaaacctcaggcaaaggtaccagctccgcgctcgccccttacgcagaggcctgtgtactgcgtcgcgttggaccagttcttgccggtgcccttcgggttggggttttgccctgtagatcctcttcagtgacagctgcagattgtgaacccctccaggcctggaaccaaatctccgattcagtgttgagaacctggactcgggagtcagcccctgggatctagtgctgcctctgacagttacttgctgagcaactttgggcaggctcctcatctgtaaaactgggttcattactaggttcttgcgattattaaatgacgtggggaatacgcaaagtatttatgtgaccccgcgtgtggcccatattaagcactcagtaaatgttattttcattctttattcttgtatgccccagttgttagtgaatggcagaagtttgttgtaagtagataaatgaaggttgagatatttagttcagttgagttttattgcctattgagtcagggcattatattctgccttaaataggaggtttaaagaaggtgtgattatctaccacaagtcacctgggatgccttctggcacccaaatgagtagttttcattaataattgtgctgtataacaaaagctaccaggtattgagtgattttcctgagcccagcaatatgctgattgtttacttgctttcctttgaggaagatatcgatctcattaaatagatgaattcagagctaaagttcagagagggcaagttacaagcctgaattctgaggtctaggaattgatgacgctgtaattcagggaccaaacatataaatacctataggagactggcagctaaaaatagatgaagctgccgagtggatattgtgactgggaggctcattccttttgataaatctagtcactcttggtatttagggaaattggtggaaggagcagaaagctccagggccccgaggtgggaacacccttgaggaatgcttgaggaggcctttggagtgaaagagggagagagagaccctatcaccagaatgagttgagttggtaattagtttaaaccaaaacaaatgatttcgactcattaaattttaggacacttaacccatttccctgttaaatccaacaggaaatcttaacaatttaagcagttgttctgtagtttggatactgagagattccatttctaactcaactgaatttatttcgtcctagaaattatccgaactcaaacccaaaatactccaataagttgtgtgattcccttaaggcttttttttttttgcacatgctgtacacttatctgagatacagttcttagacccctttcccttttaaattacatttctcaatactcccttctcatagcactcttcttccaatgcagtttttacagttatgtatatgttggtgtactttttagttttctcgcaagatatcaaggatttgtgagattgataatttgtaataggccaggcgcatggctcacacctgtaatcccagtactttggggaagcttaggcgggaggatagtttgaggccagcctggacaacataagcgagaccctgtctctactaaaaataaaaaatttagccaggcatggtggtgcacacctgtagtcccagctactcaggaggctgaggcgggaggatggctgagctcaggagttggagtttacagtgagctataattgtgccatgacactccagactgggcgacagagacactcttgtctaaaaaaaaaaagaaaaaaaaaagaatgtgtaataaattcgcatgttcactgaatgtctgctgtgtgactctgtgttggtcctggggataaaatttataacagtacaaacttttcttggaaaggaaattactctctactggaaggaaaagacaaaaaaccagtggacatgataattaaatgttatgataagtgctacagaggcaataaaatgatgagatagagaataatgggtaccctacgctaaataggtggactgggagcagagagactggttaggcataatttagggaaagttgatggtggcatgctttaagacagaggtctgcaaactactgcctgtgggctaaaactggtctgacacttttttttgtaaataaagttttattggaacacaactgtgcccatttgtttatgtattgtctggttgcttttgcattacaagggcaagagactgtatggcctacaaaatctaaagtaacaaatagctaataactgactctagagaaaatgtttgccagcctttgctttagagagatagtggcatggaggaaagtgattcatttttgaagtagaaccaggatattctgatggattggatgtaaggagtaatattaaatgaggtttaagggctgactaatggttttctaccttgaaaagttggttagatgatgatgccagttttttgtttttttttaaatgccagcttttttttttattatactttaagttttagggtacgtgtgcacaatgtgcaggttagttacatatgtatacatgtgccatgctggtgtgctgcacccattaacttgtcatttagcattaggtatatctcctaaagctatccctccccccttccccccaccccacaacagtccccagagtgtgatgttccccttcctgtgtccatgtgttctcattgttcaattcccacctatgagtgagaatctgcggtgtttggttttttgttcttgcgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctgctattgtgaatagtgccgcaataaacatacgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggctttgatttgcatttctctgagatgatgccagttaataagatgcaggaagactattagtcaccatcatttttgacattagttttcttcattttatacccattgtgtggtataatatttggtgaataatttgtgcttaaatcacatatgttgaataatagataataaaataagtcttaagaaatgatagggtaggcaaacacataatgggaaatataagtaatgtgttaagaattgctgtaagggttgctttaggttttaaggtgcaaatagtactgttatgaaaattgggcccattgacctatatgttgttctacttgtacagtggatcgaggctttagtttgacattaaaacactcttttagaatggtgtaacagttgtcaacagtttgggtccagagagtagagtgggagagaaggtttttccctctgtactcattattgttatggtaaaataacctcatcaaagttagtggctttacttttaaggaacaactgatggatgaggaatttaatgagctattcttgctttagatagtataaacatgtcatgttgtagttataaatatctaactggaggtcatcaggaagaccctaggaaactgccagtggttatctgatctcagtgagaaatgtataggaaaaataattcctagtgttcttatgtttgtagccatagaattatttttggattcttgccataagaaattccatttggaaaattatttttacttagttttctttatttgatactttttaattgtaccaatagtatactgtggactccctcctcattcatagtggtatattttctgggaaaataaaatagctgtatggttagtcacagaataagttcataaagagagaggtaatactctttaaagtgtaataggatctttgcagaaagagatcttagaattcatctcttaaagtaaatattcaaaacccggaagaggaaaagctgtgacatcactgtagttgaattggaggttcccatggttagctgtatacaagcagtggttaaagtaaaggcttagaggcaacaatattgcagtgaaaagaaacagctgtttctagagaaaggcaatggaataactgtaaaaaagacagatgaaccacaaagcattgctgtccagaggattttagtttactcattaccaagtcctattcacgattactctaccatatcatgaaatatatgtatatatatatgttcatgagtcaggaagaatattttagtcagtggctctcaaccctggctgtgcgtcagaatgatcttttgaattcaacaataacaaccaaacaaaacaataaaaccagatgcccgtgacccctatccactgaataagaatcactagaggtggtgtctaagaatgtatatttttaaactccaggggagatgatgacacacagttagggtaagaaccactggaaataaagtatgtaccctttattctgtttattataggagaatatctgaaaatctattttagaaaaatatctatacatgttagaatttatcttgttccagttttttggaaaaggcatttatgtgaggtatatattgtttctcacagctgtgaataaatgaggtgttactttataagctagctttggaaactttattttctttattcttgcagacatatggcatccaggagaaagatgtcttgccccttctccagataatggaaaactttgtgaagcaagcataaaatctatcacagtggatgaaaatggcaagtcatttgcagtcgtcttatatgcagattttcaagaaaggaaaatacctcttaaacagcttcaagaagtgaaatttgttaaagattgccctaggaatcttatatttgatgatgaagatttagaaaaaccttatttcccaaaccgaaaatttccatcatcttctgttgcttttaaattatctgacaatggagactctattccttataccatcaataggtatttgagagactaccaaagagaaggaacccggtttctttatggacactacatccatggaggagggtgcattctgggtgatgacatgggacttggaaaaacagtacaggtatttaattatgttataacagtaaagtcactttactgtgtacatgagtggatactatatgtaaatctttatttgtactgctgttacgatagctattttgtgtgttcctgtgtatgtttgtgtttgtctcactaactagatagtgaagtcctcaaagttgaggacaatgtctcagttattttatcattcttcagtacctatgaaatattttattccaaaataatgttttggtaccacttggtttgattttacctttggtaatactggtactaagatatcaatatatttgaagtcatttaactttcttcatacttaatggaaggaaagcattctaacatttgttatgccacatagcatggttaaattgttcctataggccttttgtgcatattgttcgaagtttatcatgttagaagtttcttaatctggaatccctgggtcactagcagttctgtttgtgaacttcagagagacttcaagattccctaaaatgtgtactagaatttgtacacatacatactttcctaaagaggggatttgttgtagttaatctgtttctgtataacaaattatgccaaatttagcagcttaaaacaatattcatgtattgtctcacagtttctgtgggttgggaatccagctgccgcctagcctggtcctgtagctttgcctctcacagggctgcagtcatctcaaggtgactggggaagattcacttcctagcccacctgtttgttggcaggattcagttccttgtgggttcttggcctcagtttcttgtgagctgttggctggaggcctcctttgcttccttgacacatggacctcttcatggggcatctcacacaaggtagcttgcttcataaaaggagagcaagtaggagggcaagagacagcactagtaaaacagaagtcatagtctttggtgatgtaataacacaagagacatcccttcacttttgtcacattcttctcattagaagcaagttgctaagtccagccagaactcaagggaaggagattaaacaggactgggaatatgaagaggtgggtattattgggagtcctgtcagaagctgcctgctacagggtctttagctttccttagattttcaaagaggtttgtgatccaagaagaatagagttttgaatctagattttatactaaacgatcactttagattttcaggagtgtgtgcctagtttgtgattaagttattctgcttcctttcttataattgagtttaacttattttcttcttcatattacctccattagttattggaactcaaaggtttaagtggaaaactaaatttaacatttataaatagccaaatttcagacaccaatgatggaataaggaaaaagaaaagaaaaaaaaaatagccaaataatgctactgtgtgtaaaggtctggtgtgaaaaactaggctaaaataaagtcttttaataatcatattaccattaaccatactctatgttccttcaagcctaggcagtgcagatagtttagacatgcacactggacgtgctaaatgattgtttgtggaataaatgaatttaccttcttcgtttattccacaaactatcatttagcatgccggcctgtaggtggaggatagacagcaagaataaagaaaggagccttcaagaaattacctctgaaactgacccaacagtcccacagacagttttgtttgtttgtttgcttgtttttggataaacatagaaattgacccttctggtcctaaagctttaaacttgtatttgttttatctgagttccttcctcaggaaaggacccccaggcctctcaaaaagtatcaaagaactgaaactcaccagatcgtagaattcagacagtgagacaccaggcctctcattcatcagattacttccttagccctcccaacttcctgttttcccatacattgttacatttcttctctgctgtaaaaactcctaattttaatcagggagatggatttgagactgatccttggctacagtgcctgattaaagcatttttccttggcaatacgtgttgtctcagtgattggctggctgtatggtgagcagcaggtcttagaccgaacccgtggtgtttcagtaacgccatctgtgaccaagattacagatgagtactagaggaaaattaataaattaattaaagccctgctgtaactgttttcgcatatacttctactgtttttgcctgtggtagaatgtttgttaccacaattctttgattagccagtgcatgttcaacttcaaaataaacatgaggctgggtttggtggttcacacctgtaatcccagcactttgggaggccaaggcgggcggatcacgaggtcaagagatcaagaccatcctggccaacatggtgaaaccccatctctacaaaaatacaaaaattagctgggcatggtggcccacgcctgtagtcccagctacttgggaagccaaggcaggagaatctcttgaacctgggaggcagaggttgcagtaagtcgagattgtgccactgcactccagtctggcaacagagtgagactctgtctcacatacaaaaaaagaagaaacatgagggtactacatacaaaaagtgatctgtttgggaaccaccatcctgcagcttaaatacaattcgaattcaaattcttgcgcacattttagtctcaaatttgaaggctgtctttcatctctgaggcccatgttacaaagaaatttactttattttacagttcataggattatttttaaaggagctgattttactgcagaattttctattcctgatacactgtaatcattgaaggacttggagatgttctggtacatgctgttagtgtgctgtgcaagtctttgagggagtaccgtctgaagattaggaaatggtttctgcactaattttgatactcagatggatttgtctgatgcttggggacctagttctctggttactgttgttgtaactcagggaataatttctacatagataggtggtttgaaagacccatttaaggtagagcttctatagatagataaagcttctatagatatgactaagccagttgaagaaatgtgaatgattactgtgttaactaaaatttcagaatgtagtaaaattaattgataatgaaaatagaccattgacatttactgtttgagctatagttttatcttcttttcttcttttttttttttcctgtttcttgatttcatccctttagtttccccctttttatattctaatttggccatgatatgaaactgaagtctttttaaagcttgttttacataccaaataaagtttccttccctcatttcaaatttaaaagtaggtgaatttaatattttacactctacaggggatgagaattgaaaaatgtccatttgttctagtgacatagaaatcattggtatgctgagcaagagccattttgctggagctttcagacacaagccataatggagtaggtgaagacgtggacatagaaagaacgtatatttacctctttaagaaatatggcttcgaaagggaataaaagtgacctagtagtaggtgaagagagagacgagaatttgagggggtttcttttttgtttgttttgtattgtttgggggtaggaaagacttgagtatttttaaggtgaattggaaggacagatctggtgaagagggcacagataaatatgcaacatacataatgatatgcccacatatacatgtacttctgtaaacacacacacaaacatacatatgcaaaaaatggagtcacataataactactatcttataagcaggttgcagatttttttttgtcaaagattatgaactaatttttcccgataccttctgacatttttctaaaacatagaagagttaaaagaatggtacaatgaaaagccatattctcaccacttagattctgttaatatttcattatacatggttttgtaatatccatccatcttttgttgcattttaaaatagcagacattaatacattttatcccacatacacatatccaagaaaagatcatcacagccaagacgatgaacatgtctatcactcctagatttcctcatgtccattgtgcccttgatatgttcaacaccatgcagttcatcacctactatttttggttttagtgggactgaaaaattaaagatacttgaggaaattttaatacaaaatccaagatttttatgactatctcccaatatttcacagaattttcacatctaattcaacaggtaacttgaaaatgaatcccttttgtacatttacgtgataattagctagtttaagtacaataaacaatttcactggagtatacaggtttgggaacctgacctttggtaatcagacaactcagtgataggaaaagaggtgagtgggtgcttaccatggagtagtggttctctaaagtggatatttgggtcagcagcattagtgtcacctgggaacttgttaggattgtaaattccggggtctcactgcagacatactgaattgtgaactcggtgggagtaggagaggatggcaatctgtgttttaacagatgcttcaggtaattccaaggcccactaaagtttcagagcctttgctcagacggtgtgtttttcagagggttagaaaactttgattaatctggtgagttcagtgaacattggttaagggatgtttggtctacgtgaatcttttttgttgttgttctctttttgtttttttgagatgggggtctcactctggcattcagggtggagtgcagtagcgagatctcggctcactgcaaagtccacctccggggcccaagcgatcttcccacctcagcctcccaagtagctgggaccatagttgctcaccaccacgcccagctaattttttgtatttttggtagagatggggttttcccgagttgcccaggctggtcttgaactcctgagctcaagtgatctgcctgccttgacctctcaaagtgctgggattacaggcaggaactactgtgcctggcctctgtgttaatatgtatacataggatgatgatcatttcatttaaaaaaaaaatacatttagaaatggaaatgatattagagataattttgttcagctttttaacttagtacgtaaaacaggcacaggaatgacttccctatctagggtcaggcacagaagtaataattttcatttctattctagaactgttatttttttcctcttctatcatctactgccttcttttgacttaataatacagttaattaaaagccttttactcaacttttaaccatttgttcaattggttgacatttgataagtactcactctgggccaggcactgtgattggcactgaagagccaatatgaatataaatgcatataatacctactgtgatggttactagtgagtgtcaacttgattggattgaaggatacaaagtattgatctaggttgtgtctgtgagggtgatgccaaaagagattaatatttgagtcagtgggctgggaaagacagacccatccttaatctggcaggcacagtcttatcagctgccagcgtggctagaagtaagcaggcagaaaaatgtgaagagagagactggcctagcctcccagcctgcatctttctcccatgctggatgcttcctgtccttgaacgtcggactcaagttcttcagttttggaacttggactggctctccttgctcttcagcctgcagacatgctattgtggcacttcgtgatcgtgtgagatagtacttaataaactcctcatatatctctattccattagttctgtccctctagagaaccctaatacacctgccttacagagttcacaaaagagtaataaaaggaaatgaggccaagagtcatctagtctggtaagtgggttgggggggagaaacaagcctgcctgggggtgtcaaagaagactccacagggaaattggtgttttcatactttgcttttggaaacccaccaaactttgagttttgaattgagttttaatgaattttattttttactgaaggcatagctctaatatagtatttgaaaggtttatcacaagagaagagctcaaattcattgaatcaaaataatttagtttttaatggtagtgtggtaattagcttttacagacaccaaaatcttaaggactactattaagcagatgcagtaatatgtcttaccatattattttattttctcatctgctatgcaaagaagataatagtactttttgagtagcagagatagaattttgcaaagcatgaagacattctttgaatttttgtttctatattattagatattacattattgaaaatgtcattactgaaggctgtcttattaaaaagatgtatagtaaacctcactcttgagagaaatgggattgctgataattaaaggtttcttaggttattttcagtaccttttttggataataagatcttcagtagattcaaaacatactaaaatatgaaggttcttgggatctcaagtcatgttattcactcaggaatatagtaataaagagaaaaataatattgtctttattttcattcattgagaaaatgctataatatccagtgtggaaggttaattagcccccagatccctgagcccttttaagcagaaacaaaaatgtactagtatttcacagataaaattgtatttcttcttttggcatgtagttctgattttaggggagagctttgtaaagataagtgagctagaccccatttcaaaacagcactttgtggtttttttttttttttcaaagcgagcaaaaatacttttgaagtgtggttctgaaccactctctctgtacctttgtatctcccaggaagttgaaaaataaggtagtaaacatttttttctttttgttctgtaagaaatagacaatttttgctatgccttcctcttctggtctaagggaaggtttatgccctttttcccagcctcagatttactcagtatgtcatgagctgactctgtgaggaaagatgacttataaaactgttggcttgacagagtttagaaaggaatacatgtaaaaacagaaagctttcccagagtgatatttcatttctgaaatgcagtttttggcctttcactattctagaggtgactgattaaaatatttgtttttgttcttttcatctataagcaattttagaactattccacaataaaacatgttctggctttttctttgcagataagttttgtaaaccttcattgtaaatgtgtctttagtcttctgtgaattaatattttgatagacctctactggaccaccatagtgtggtaagatggctagatctccacccaaaatacatatttcctttgccttcttagagtttgggctagctgacagagactgcatttcccaaatctccttgcatgtcagtggagcttgtgactgggttccgccagcagaaataagggtagaagtgatgagtgccatttatagtcctggtccataaaatccacctgtgctgttcttcacattctcccttccctaactgtcttttgtgtattgacactttgctgctagcattaccacaatacctattagtatattttaattaatataattaatatatagctaagagtttgttagtggttttagctagcttctccagtttgtattctcaactaaagtttattactatttcaacttaagtttttcgggggtgggtggataagtagtgttaagaggtagtgtagatgatttaaatgagatacaaagatttttaaaaatcattagtggatttagtgaattaaataaagctaatctatacttagagtttataaatttagctgccacatatgaaatatcttccaaagatctgagattcttaaacacaaggaacatttcacatatctttgttttagagaatttgacaaatgaagttagaattaagatcgtatatcaccttggatagatgagcaaattgaattatgaatttgcacaattaggaatataattttcctataatgaaacaatctgtaggtgagttaagagcaaatcagtggatttgatcttatattacctcatttaaattgttatggtatctaataggtatctctcttgtcttttcagtagcctttgaggaccagttgcctaaaattaaaaagagtatatctgtcaatatatgtgtgtgtgtgtgtgcatgtgtgtatctttaattctttaattaaggtacacttaaactgtaaaatgcacagatctcaggtatactacttaatgagctttgacaaatgtctatgtctgtgtaactaatatactaatcaaaatataggacaattccattaccctaaaaagttttttcatgcccctttccagtcaatatgccaattacctatacttttaattataaattttctgtgatcagtgtaaagttatattccaaaaggtagttagaacccaaaatgttatgcttatttacaccatcaaggaattcagtaaattctaatattaggtgatgtatttttaaatagaaaacataactttaaaaatatttataaaatgaaaattgtgaacatgcatcaaagatcttttacttaggtggtgttaacaatatttaaattgtccaatgcctaaactcagttatttgtggagtatccgttctctttcttttaatttatgttctacatcagccagtttgcgcacattaatctctcactggattctttagtaactgtttattttctgttcatttgtccacttttttctcaaccatgctccttcaacacatctcctaactacctcttccctgtcaccccaaatcagcttgatttcatactactgaatgatagaaatagcctttcatctagactattccagcatctagaaatagcctttcacctagactattccagcatcttggtattgagtaggtaataaatatatttttattgaatgtgttagtgaattttaagttgaattggataacattatggttctatggttataacttatattgcctatatttgccaggctctatgataaacattttccattaaacattcatgttaattagatattcttgcctctatttaattggtgaaaatattaaaatttatagaaagtttatgtaaattgcccagtgtcacatagctagtatgaaactggttggtcagacaccaaagtctttgtgataagtcctgcaaattgacatgcgaattttgttagaatattttaaaacttaggacaagtttaaaccatcctatttttcatctttttataatattttagacaacataatttgcaaaagctactttgtttattatatacaagatcatatgcaagaaacaaagccttctaccttaaggaatgatgccagaaaaatagctaatgtgtttttgttttttgagacagtgtctcgcttttttgcccaggctggaatgcagtggtgcagtgttggctcactgcagccttgacctcctgggctcaagtgatcctccccacctcagcctcccgagtagctgggactacagatgcgcactaccaggcctgggtaatttttgtactttttgtagaggtgggatttcaccatgctgcccaggctggccttaaactcctgagcttgcccgcttctgcctcctaaagtgctgggattaaaaatagctactgtttgcctgtaatcccagcactttgggaggctaaggtgggcagatcaccagtggtcgggagttcaagaccagactgaccaacatggagaaactctgtctctactaaaaatacaaaattagctgggcatggtggcgcatgcctgtaatcccagctaactcaggaggctgaggcaggagaatcacttgcagccgggaggcggaggttgcggtgagtcaagatcgcaccattgcactccagcctgggcaacaagtgtgtccctaactctgtctcaaaaaaaagctcctgtttattgaatcattgatatttactgacttgacactttacgtacatactttttaacttttttctagaataaaaataattctgattacactgtaatacacaaacgcattcttataaaaatgcaagctgtaatttttaaattgaggataagtccacacagcattaattcattatataaaatgattaattgagtgcatttaatgcattcagaatgttgtgcaactcccacctctttctagtttctgggttgtttccacttttagttattatgaataatgcttctgtgaacatttgtatgcaaacatttctcttgtgtgtattcctagaattggaattagtgggttttatggtaattcagtgtttctttttttttttttcgaggaactgcaatactattttccacaatggctaaaacattttacattcctaccaacaattgtccaggtttcctatgcctccacatcattgccaacacttgttattttttggttttcttcattatagccatcctactatgtgttaagtggtatttcattacggttttgatttgcatttctgtaatggccaatgatgttgaacatattttcatgtgcttttttggccctttgtagatctttagagaaagaaatatatatttaagtcttttgcctgttttttaatttcattgtctttattgttgagttgtaagaatttttatgtattttggatactaatccctcatcagatatatgatttgcaaatattttctctcattctatagttgtctttttatttgcttgttattttactttgatgcacgaaagttaagttttatgaagtccaatctgtttttttatttggttgaacaagttgtaattttaatgtatgtgtaaataaatttaaaaaataggactattatttctatatgttattctactccttgtttttttcacttaaacataggtcttggagatctttttatgttggtacataaggattgtccccattcattaattaataaattactgcatactatagattatatgttctgtaacttattttaccattcctctagggacctagggagaaggatttttgggttgttgcctattttaggaaatagcaaatagtgaatatctgtaggatagaattctaagagtatttctctgtaggatagattcctaaaagtcaagtttctcggtgaagtgtataaatctttttttttttttttttttgaggcaaggtcctgctccctcacccaggctggagcgtggtggtgatctcagctcactgcaacctctgcctcctggttcaagtgattctcatgcctcagcctcccaagtagctgggattataggcatgtgccaccacacccagctaatttttgtatttttagtagaagcagggtttcaccatgttggccaggctggtctcggactcctgacctcaagtgatccacccacctaaacctcccaaagtgctgggattataggtgtgaaccactgcgccaagccagatgtgtctatttcttttaatctgctagttttaccttcatatattttgaagctccgttattagggtcacaaacctttgtgattgttatatcttcctgatgaattgaccatttttttactatgaagtgtcccttgtagacagctcttttattcattctgacaatctctgatatttaattggaatatttagttcatttacatttaatgtaattcttatgtatggatttggatacaaatctgttcattcagaaacagtctgatttgccttttgggttgatatgatattttttagaattttattttaatttttctattgactttttatctatacttctttgctttttatttttagtggttgctctaatgataaaatatacattctcaacttcttgcaatgtacctaataatgtactgcttcagataaaatatgtttcttgtaaataggtcattctattctcattttaaggaatctaagagttaggaatgctaagtgtaatgcctaatatacctagctgataactacctaatacctaaatttcaaaggttaagtcaaacttatatttgcagaatatacccagtttggttttggtatatattatttccttttttaaatttctgtgttctgtgtgctaatattttgtttaagagtttggcttctatatgagtaagataaattggcttgtaaatttcctgtattataatgttcttgtcaggttttcttatcaaagttacgctgaactcataaaacgaggtcacagtattttcccctttttctaaaccctgaaagggtctgttacagattggcattacatttttcttaagcattaggtagaatttgttggtgaaactatctggcccttaactttctttgtggaaggtttataattacatattcaggtttatttcatggttttatgagtatttaaatttccttttcttgtgttggtttttgataagttctatttctaaatttcctctaaattttacatttattggcaaagcattattatggcttatacatattttttgtttgccttttctctattttttcttcatcaattttgccaggggtttattgaaaaaattctttcaaaggatgatcatttggcattgttgatcattttcattgtatgctttagtaatttctgcttttttgtgttaaattttctgttattttcataagtttttgagatagattctttgataactgattaatagtccctcttctttcctaatacagatgctccttgacttacagtggggttatgtccccataaacccattgtaagttgaaaatattataagttgaaaacacatttaatacacctaacctactgaacgttatagcttagcctatcctaccttaaacatgctcagaacacttacgttagcatatagttgggcagaatcatctaacacaatgcctgtttcatactaaagtgttgaatctcatatagtttattgaatattttgctaaaagtgaaaaacaatgattgtatgggtacttgatttacagttatactgaatgtgtattatttttataccattgtaaattgaaaaattgcaagttgagctatcataagttggggactgtctgtaatattcatttaagtccctaaggtacagctttagccatattctacaaattcaacatgtattgttactcattatttaattcaaatattttataatttatattgtgagttgtttgaactctgttccttactgtccaaacatttggagattttctgcttatatttttgttatttctagtttcttgtattgtgatcaaagaacatattctgtatggtttctgtctactgaaatgtattgagacttctgtggcctggcatatgtcagcctttttttttttttttttttttttttttgagacggagtttcactcttattgcccaagatggagtgcaatggcgtgatcttggctcaccgcaacctccacctcctgggttcaagtgattctcctgcctcagccttccaagtagctgggatcacaggcacacgccaccatgcccagctaattttttatatttttagtagaaacgggatttcaccatgttagccaggctggttttgaactcctaacctcaggtgatccgcccgcctcggcctcccaaaatgctgggattacaggcgtgagccactgcaccaggcccggtatgtcaactttggtaactatttcgtgggtacttaaaatgaaactgctttgcagtagtgtgcagtgttctagcaaatattcgttaggtgaaggttgacaatcatgttattaaagtcttctgtatctttactgattattttgtttgttcttgctgagttattttaaaatctaccattgtgcttgtggatttgtctacttttatttcaataaatttttctttattgataaatttagacttcttaaaatttccaagtgaactaattttattatcaatattaagttaaagtgtgcctctttaatttcataatgcttttttgtctcagcatctttatctgatatgaatatagctatatcaattttctttgatttttgtttacatggtctgtcatttttattttcttattagaatttttatcccttttttaagaagtttttcttgtaaatgacaaggaaatatattttatttggacagtctttatcttttgtttagacagtttagtccatttccatataatgtgctttctagtatatttggatttaaacttagtattttactgtttgatttttatttattccatgtcatgtttttcccactttttttgtgtccttttgggtagattgtttcctattactttattatccccttttattaggtacacattcttttattcttctattaatgattaccctagagattacaacagataccattgatttatcataatctaacataaattagtactttagtttcctccctacagcatagtgacctcagaatattataactacacttgtgctccttctgactcatatacatttgttgtcatagctttttttttttttttttgagacagagtcttgctctgttgcccaggctggagtgtagtgcgcgatctcggctcactgcaaactccctctcccaggttcacgccattctcctgcctcagcctcccgaatagctgggactacaggtgcccgccaccgggcccggctaattttttgtatttttagtagagacggggtttcaccgtgttagccaggatggtcttgatctcctgacctcgtgatccacccaccttggcctcccaaagtgctgggattacaggctgtcatagcttttaacctgttacttgatttcaaccaaacttttttattgtttcataatgtcaatcaatgtacatatatattttgtatatatttaccatttttgttgctctttatctttccctgtgtcaccgatcttctaactagagtcattttccttgtacctgaaaacattctttagttagtttctttagtgtggctcttttggtgatgaattggctcactttttggttgtctgaaaatctttacccttcattcttgaatatcatccgtaggtataaaaatataggttgcttttattatcactttgaaaatattctgttgtatagtatcttccattctttttcctgcaaggtcagctacttgtctatttgtttttttgtttgtttgtttgtttgttttttgattttttttttttgattttttttttttattttgagacagggtcttgctgtgtggcccaggctggagtgcagtggtgcagtcacggcccactgcagcctcattctcctaggctcaagcagtcctcctacttcagctttccaggtagctagtgatacaggcatgagccaccctgtgcccagctaatttttctaatttttgtagagatggggttttgccatgttgcccacgctggtctcaaattcctgggctaaaatgatcctcccgtcttagcctcccaaagtgctgggattacatgggtgagccactgtggccagaccagttgttgcttttttgtaggtgatctgttgttatttcttctggctgcttttaacaaacattttgctgtctcaagcacctgcttgtggttttttgtttgtttttggttttcattttgttttggttttggttctggttcttggaagaagatcttgaatctgtggcttgatttttaaaatcagttaagttttcagcttttatttcttcagatacttctgtatcatttcttttcttctatcatttgggattcagattataggtatccacacccttgttaagtatacttttttctataatttttctaattctcacatagttttttgttttatatagtttttcttcttatttatttttgtaaggtaatgatcagttattttcttccatatggatacctcatatacctttcttcccaatctttaaaacaaccttgccaaaattattttttgccatttttacagatattattcagagaggttaacgcccttgcctaacttcacagagcagccaagcaatcagagctaacatttgaatcaaagtcaaatcaatttagtatttcttgctctaatttattatatgaggttatggttccttttttctgttttgctcacttgatttttggagatgagctgttattcaaaatgttgcatacattaatgaattagtctgtcttaaaataacatttttccatttcacctatatttattagataaatagaagtgtacaaatttatgggccaaatattatcccccttaaggaatttattttctacatggaaacaagaatgtatacagtttattctgatagaggatacgaagagatagtttccatggttagaaacaaataagaaggtagtgtctcaagtgatggaattaagaaagaattcattgggtaggtagaagttatgaaaagaaaagatggtaatgtgaggatttttgtttgtttacaagagtgaaaaacagtttgttattacaaataaagaaaatcagtactaatatttcatgttctatttcccccaacaaatctctttgtacatactttgtcactaattgaatagtcatgtaagcagtgaaattttgtacgtcatgatacattatacacagtgattgaaaaagtcttttttccccaggttatttcatttctggctgcagttttgcataaaaagggaactcgtgaggatattgaaaataacatgccagagtttttactaagaagtatgaaaaaggaacccctttcttctacagcaaaaaaggtaaaatctctagacaatgtatattctactcatgatgctggtattacaaaagcatatagaaatatttaaatatcacacattaaaatgtattggtatacattttaaaacctaagaatttaaagatgttattaaaatatttgttttataggcctaatttttgaaagattaccaattttattcccaagttaaatttgattgactgtcatggcaaaacagaatttcagcttggttttgctttgaggttttaatctgttggttggctggatttacatgatttacttaggttgatttgttaaacttacagaatgtatatgtaaagttaattgaaaccttcattatattgttttttatttatgtgagaatgaaaaggcgatagttacagatattggtaacaaaagtgcgtcattgacttatttcaagttgcctagctaattgcatccaaaaaatatgaaataagttctaccaatataggaaagttggaatcagaaagactaggtaggtctgtgcttatttctctttctgcccatatgactgaatgctattcatatccatacttcagttttcttcttcataaacgtatgtttataaatacgttatatatgattcttacaaaaaagatttctaataaagcaatgaaatataaaaaagtatattatacttacatgtcttttaaaaaatattatcctcagcctccaggaaaccagataagaataaaaatgaagtgattttatgaaatcttttattatatttggtaatgagctacttacagcaagttttaaaacagactcttttatacaagtcttatgtacaagattgctgagaagtccaagtttactcttgtctatcataaagaccatttcaatgcaaacttttcagaactactggcttaagatataattgctatcattttaaattctctttatttttcagtagaataaatgcatcctgagtatcagattcaatgtgatcctgaagagaataatggttcttaatgtattttaagtattcaatagctcaagtactgtttttagctctggattcagttgttccctggttctaaatgtcaccacagagcctatatatatctcttttatgccactgtgacagcagatagaagagagaacaaagaaggaaaagtaatattttaaatatattaaaatacttaaagatatttaaaatattatagaacaagaatgggccaggcgcagtgattcatgcctgtaatcccagtactttgggaggccaaggaaggcgaattgcttgagcccaggagttaaagaccagcttgggcaacatgtcaaaacctcttccctactaaaaatacagaaaattagtcaggtgtggtggtgtgtgccagtagtcccaggtacttcggaggctgaagtgggaggatcacttgagcctggggaggttgaggctgcggtgagccatgtttgcaccactgcactccagccagggcaataaagtgagacccctgtctcaaaaaagaacaagaatgaaagaaaagaaagttaacaaagatactcatttgataatgtggtaaaatatgcttataatagttacctcagttgactccagttcctctccttccttctttcctttctttctttttttctctttatatatatatgtgtgtgtgtgtgtgtgtgtgtgtgtgtgtgcgtatgtatgcatatgcgatgtatcatatcacacacacacatatacagttgtcccttggtatccatgtgggattggttccaggacctctcttgggtaccaaaatgtgtggattctcaagtccttgatataaaatagtgtatttgcatataacctgttatcctcccatatactttaaatcatctgtagtttacttagtgcaatgtaaagtctacataaatagcttttatattgtattgtttaggaaataatgacaaggtctgcgtacatgtttagtgcagatggaattttttagtatttcaatttgtagttagttgaatccactgatatgaaacccacagatatggaggaactgtaaattccttgctataatgtacattgctatttaccttcttcagttgatttcttaatttatttattttcagtctttttgtattctaataaattaccttaaagctataagtgttcctttgggccaggcatggttgctcacacctgtaatcccagcactttgggaggctgatgctggaggatcgcccaggagtttgagaccggcctgcgcaccataagaataccctgtctttacagaaaataaaaaaataaaacaattagccaggtgtggtagtgtgtgtctgtggtctcagctactggggaggctgaggtgagagaatcgcatgagcccaggagttctaggctgcagtgagccgtgatcatgccaatgcactccagcctgggcaacagagaagaccctgtctcaaaaaaaaaaaaagttcctttcagtactcctttgtctgtgttctatagtttttaatatgtagttttttcgttagtcttttctaaattatctgtggccctaatttttattctcttttacccaagtactatttgaaagagaaattaaaaaatttccaagtgaatagctattgttggggctcaggatgatgggagggctgaaccctttttgacaattctagttttgttgcatcagataacagccttgatatttttttctttgtgattacatccatggatcagtttttatgctttgatgtagtgcattgtgtagtctctgttgttttaaaatgttgcttatattgtgcattctttgtaatcatggtcacatggttttatatatttctatttaatcatgtttgttaattgcattgttaaaatgtttaatagtgttattttcttcttgtctgaacagttggatctggaaagaaaaacgttaaatttttttatttctctttgtgttcataccaactttttcttaacgtcttcagttaattcttcagaggccaggtgtggtggcttgtgcctgtagtcccagctactcaggaggctgaggtagtaggatcacttgagctcaggaggttgaggctgcagtgagccatgactgtgccactgcactccagcttgggtgacagagtggtactctgtctcagaaaaaaaaaaaaaaattcttcagtaaattttatgtgtttgtatattgctctcacacttgattatccataggcttatctgcctatggaattttaagttcaaaattttcttttataatgacaaaacatcttctgtcactccatattgcagatgagagttcagtgtcaacccgatttttttccttggaaaggattttttttttaattgtttggaagtattaaggacttttttaattgatgaaatttggaaatttccatgagccctaacactcaccatagaattcttccaaataagttttgctttagaaaatatatatacagtgctttatgcagggaaagttgcatactgatgctagaatcagtttctttgatgactggtgtaacttttccttcttaaaattacttggccattatttttcttgacttagtctttccaactaccttagctgttttgttgagttttgttttgcttgttgttgtttttaggttccttctaggaaaagtaaattttttagcgggggagggcagggggagtttttgctttcagaggtgtagggcggattgctcagttcttcaggtgtgccagttctcatctgctcctgcactgttctgacctgctggtactgcccttccaggcattctgccactattatggatttattatgtttgttcttttgtttcattggcatcaatacaaacgtgttgagttagtcatttgaactggaatttagagtttttaatggcatcaccagtgacattctacagtatttcccagaagtaaatacaaacaaaaattataactttgaaagttttaaaagataaatttgtattggttcatttaaaacaatgtatgttttaaaaagacagtttatgaaatggagaagaaatcatttcttttgtatttattatgctaatgccagaattacaattgaattctgaaaaattaatgttgaagcttgttgaagaaagccctttaatgaactgaatgttacaaattaaggagtggtgggtctaaggtatgtgtgtgtgatacgatacatctcatatacatttaaaaacttttcaagtgtgaataaatcatctgaataagaatgcatgaatgttttgtgccaagaataaattcttaaaggaaaagacacaagctctacattttaaacattgatttttggaatggttctttagatgtaggctaagttttgattgaaattcaatttttatgaatcataataaatttattataaaatattactatcttgcatgatgaagctttagagattctaagtaaaattcataattaatgcaaaagaggaggatttttgtagcaatcacaacaccagcatcggaagcaatttcaatgacaatttaacaaaaatattttataattattttatttactatacactatttttttagttcttcatatgtaccaagaggattatgttgcacatgatgctaccgtgagcatccttatgcacaacttttgcaataataactgtaggataaattcttagtactggaattggatagcaggtagagctggatttaggggattactttttgataactggagttaaattaccccatatccccacgagtgatgtataagaatgtctgtttccaccttttcgtttgcactaggtattagcaaacataaatttatgactacctgagagatttaaaatttttatcttgctttgatttacatttcttaatgagtgaagctgtagcatttcagatgtttaaaagctatttttaaatctaattctcgtttttaatcatagtccttgattaatagtccttaacgatatatcctggaatctaattttttgttcattatatattttgaaaatatttcttccccatgtagagtcagctttgaattatttattgattttttaaaaatgtttatgtggttacatgtattggtctgtatagtttctgggttttatgtttgcctagaaaagccttttgtactctaaatttataaatacattcattcatggttcttttataatatgtgtgattttattttatacctttatatctttgtttcagctagaatttattttgctgtaggtgtctagtaatccaattttattttcctcagttggttaaccagttatcttaatgtcatttgttgagtaagcctgcttttccacagtgatttgaagggccactttggtgtaaaattaaactcatttctatttctagacgtattattctgtcctaattatttgttcatttctcttccagtgctaaacagttttagttattttagctttataatgtaatttattatttggtagttactcctcaagttttctcaacttatgaaaaataaattttctcaaatttctcctcaaaacctattgatatattagttgatgttgtgttgaatttatagttaactttgcttgtcatttccattcttatatttcttatttacttctcttttttaattgcaagagttgatatttattgatctggtttgtaactttctgttttgatagaatatcaagttttggcataatgccaaactttaatacttcatatagtacttagaaaatagaaggtgttcaattgatgaatgaattaataattgaagccatacatgtcagtgctaagttaggactaataatgtatgttcagaggacagtgacagtagagttgaaacaaaggtttcacatgggaagaagtgtgatatcaaaatgaaaaataaattatacctttacagaaaaattacagaatgtaaaattggaatctttgctagaaaactcaaagtactaaaaaaaaagttttcgtatttatctctacaatcttaactctctcaaaaatacccaacataggtaattaatttatttaatgccaaaacttgatattctgtcaaaaattaggctgtttttatacaaaggacttggaagagcccctgactacagtggattctaaactgaaatttctgtatatgaaataactgcagcatactgaaggagaaaatgatcagctatacacacagtagggtgtaaattaattatgttaggtatttttgagagagttaaggttgtggcgataaatacaaggctttttttagacctttgagttttctagcaaagattccaattttatgttccgtaatttttctgtaaaggtataatttatttttcattttgatatcacacttctttccacgtggaacctttgtttcaactctactgtaatctcactgtcctctgaacatatattattattccgaacttagcattgacatgtatggtttcatgtattcattcatcaattgaataccttctattttctaggtactatatgaagtactgaagttaaggtaaataaagttacacatctcaaggacgtagactttttgattgaaggtgctaacaggatatgtcatggtagttaagagttttagaattaggcagacctgggttcaaatacttactttgctacttaatagcagtatgaccttgagtgtgttgcttaatatctctgtacctcagtttcctcatctgtgtttctgggtaaagtccctgaattaatttctgtaaactacttctaaaggccttggcacacagtaagtgctcaataattgttatgttattattaatactattactacttctgccacaaaaattgtcacgttaatctttgagtatctcatcacagtccacactacatcattcttctatgccgtggttcctgaggaatcagatttgatagaaaactccttaataattgagcaagatttattgaaagatataaataattcagtattctctagttgcattatttaacctagcttctgttaattttaataatacgtaagcaaatgaattttaattttatttgtgttaattttatattcagttttataaaattgtattttagcttcagaataagaattatcacccttcccccatgtctacagcaataccactctgaacacaccacatctcgtctgatcttggaagctaagcagggtcggacctggttagtacttggattagaggaatagctcccagagttgctttgtgtgtagtgacttagcagttggacactgctttccattttattattttggcatcatttgcttaaaaaagacttattaaatgaaatattatttattggattgtaggaaatgctaagttcttatgtactttccctggactctgcataatagcataactcagttctctgacatctttcactaccaaaatgaatttttgaaccattatttcacctttcataattttgaagaccaatgtttgtaagaaatatcaagaattatgttgccaccttaatttttaaacatcttctggaatcttagggctgatgccaggactctttagattcattggcacctttgatgaatggcctctcaagtggaaaactactaagactgctcagatgcaatttgcacctagcattgtcatctcgtaatatacaaaaaaatcaaagggagacactgtaattggacttagtaattggaggcctaatttcatatttgaaagttaaaaatggaaatcataggattaaccttcacccaaaggacggacatacttgagatgaatcaagtataagaagtacttacatatgcttgatgatggcttgggaaaaaggaactctcacgttcagcatgttgattttctttcgttttcttctttctctttccaaaacacagtcacaaatttgactttttagagttgacaaatggcctaggttaaatgtttcacagaaaacagagcagaatttagagcagtattgtattatttcttggttaaactgaattttttcagtatgtttaattggttcatctctatcaagtagatcaagtataaaactttagaaaataatcgtactggtaaccctattaaacttaacaggataggaatagtggtaacagggagaaataaaaacattaaaaagttaaaatggttgatgacagcaggattctgggttagtacaggaaaggtacatgaatgtgaggaataaccagagagttacgttggtaatcctcagagggactgatttggtaggcattattagggcacaagtcccatttacctgagtttcaagagagagcaggaggagagttaagcactgataactcttgatctttgctatagggagagtagagtaatgaggtaatagagatagatgttgggttaaggaaaagaagttttaaaaaatttttgtttttcggatttttttaaccctgggaaatattctaacatgcttgtccataggtgatgtggttcattaaaatggaaaagttaatcaggtaggggagattgggggcagtttctgcagcattgactttaggttggcaagaaggaatgggagccactgtatgaggggtttttttggagaagaacatgagcagcgtacccatggcaacaggtgggagggcaaaatatatggaaatgaatatagataggttattgataggatactgagagaagttcatccaggaagttttcttctgattgcttcaattttccagtgaattttccagttctttaactgagagtatctgaaagagggggagcggaaatgggctaggaaaatgcagaaggaaagagagctccaggagaccatatatttcaagaacacgtggcctgcttgtgtatgtacattacccacttggcctttgaagctattactgggatccagattttattcttttctctcttttggaaagttacttctctctcatttctcagtgcctttttggtagggggaaataaaaaacacgtgtttctttgagcaaggttaggtgtctgtcttgtcctgataaaaagctaattaaacagcaaattattttttgagaatcttcaatgtccagatatagctaatcactcagttgtatttattgttactaactagatgtcaaaattaaggaagaggactattgatattgatattgtggatttcactttgggattctttttcagtttttaaaaaacagcaaaatttttttattcttgttttagatgttcttaatagttgctcctctttctgtcctctacaactggaaggatgaattggacacctggggatatttcagagtcactgttttacatggaaacagaaaagataatgaattaattcgtgtaaagcagaggaaatgtgaaattgctctaacaacttatgaaacactacgcttatgcctggatgaacttaacaggtaatgggaataataggaataggaatgattgtattaatagtctacttacatccctttatattaagagtttttttttttttttttttgagacagagtcttgcttttgtgtttttagtaaagacggagtttcgccacgttgcccaggctggtctcgaactcctgagctcaggcaatccacccacctcagccttccaaagtgctaggattataggtgtgagccaccgtgccaagcctatattgtgattttttaaaaaggaataatgatgattcctttgcttgatttaatttcattttagaattattgaaatatttagttcataataacttactctctgagaaggaaaaacctgcatcaggttttctagaacttcttattctatttcttacattgaatacaggatacttcttcaaacactgattgttaaagaatgataagacttgtcctaaatctcatgtacagccttttatgcagacactgcctctgaactaggtcagtaattttcatgaattatttcaattatgggagtctgttgtgaatatagaggggcaaaaactacacacacacacacacacacacacacacacccccacacccacacacccactgtagcatagagtgtgagggagaagtggccaagaggtaacaccagtgagataagcagggaaaagattatagagagtattggaaggtactttgaggattttgatctttatcctgagagcaatagagtgccccctacagtgttgtcagcagattaccgataggataaaaatgatcagatttgcactttgtaaataccttagcttctgtgtgtgcagataaaggagagccaagctgaatggagaaggaccaattaagaggcttgttatgtgctgaattgtgtcgcttctcctcaacccccattccacaatttaaatgttcaggtctcaaccccagcacctcagaatgtaactgtgtttagagacaggtctctttgattaagttttaaagaggtgattaaaaccgaggctgattgggtggggcctgggtccagtatgactggtatccttataggaagagaaagagacaccaaggacacacacacaccacagaggaagggacttgtgaggacacagcaagaaggcagtcatctgcaagccaaggggagaggcttcaggagaaaccaaatttgctgacaccttgctcttgaaattcgagcttccaggattgtgaggaaataaattttggttgttttaagccatccagtgtgtggtattttattttggtagccctagcaaaccaatacaaggcttttatagtaatgtggtcacgggaccatggtagtgaggtctgaagtcttcatagttgttccagcagtaggctgggccttggtaaaatcattagtttccatctgcttgtagcctagatttgtctctacagggatacaatttataccttttaggtgaagattaaagcatggcattagaaacagttatctagtaagtctttaaaatgtttagacattatagttatactcaatttgaactactgctaatgaaggagttaatgatattcccccaaagtcaaccgaagtttagaaaattggtaatttttttaaggtgatactttcacatcagcattaaaatgatttagcataggatgaaaatgatgaacaattgatagttgtctcaaattttatgagcacacaaaaaagagagtaaaaaaatcactaattagccatgtggctttgggtaaattagcccatctggaaaatgacagaggatgaattaaatcagtctttgtgaaaactagcccctcaagcccagctggagagttgtattaaaatcaactttaatgagagttaatttgtgtagaataattatgccatttcaggaatacaatttgatgaatcttgaccagggattggtaaactttttctgtaaagggccagatagtaaatattttaggcttttgggccacatatagtctcggttgcatattcttcttttttatttttatgaccctttaaaatgtaaaaactattcttagcttactgaccatacaaaagtggccacgggctggatttggccatgggcagtagtatactgactcctagttttgacaaatgagtgcaatcactatcccaaacaaggtaaaaactatttttatcatcccaggacttttcttttacctctttacagtggcttttcctcaaccctcaccttgggcaactactgattttaatttctgccacttataggtgagtttaagctattacggagcatgtcaatggtattatacaggaagcacccttttgtgtgtgtcgcatcttttgttcagcatgttttttgagattcattcatgttgaggagtgtatcagtgattgttctttcttaatgttgcattgtattccatttcatcaatattcacattttgttacccattcatttgaggatggatttttgggtttttccagttttggattattatagataaaacttcaaggcatatttgtatgtaagccttttttggacatatgttttcatttctcttggagtagaattactgtattatatggttaactgtaggtttagctttagaagaaactcccaaaccattttccacagtggttttactccagctagcaatgtgtgagagttcagttgcttcgtattctcagcaacgtttggtattgtcagtctttttgttttagctgttttagtagatgtgtagtagtatcttgtagtgtaatttgcatttttctgatccatgtgcacttggaaaacaatgttctatagttattggatgtagtgtttataaatatcaataagactagattggccaagatgttgcttaggtgttttctatctttgctgatttccttttcgattggcttacagtatctgagagaggagagttgaaatcttcagttgtaattgtagatatgtttatttctcctttcacctctgtcagcatttaatttagtattttgaagctcttttatgaggtgcacatgcatttatgattgttattttttcctgatgaattgatccttttatctttaaaaaatatacctatttatttctaataatatctcttatcttgatgttttatctgatatgagcatagccatattgtggtacatttcagtagtttgttcctttttattgccgatggtactattatatagctatcccatattttgtccattcaccagttgatggacatttgaattgtttccagtttttgactgtatgactaatgctgctgtcttatgctgagtcttatgcttactgcatgtaaatagcttttcctgtttttattgcagtatatctgttcttaatatttggagtgagtctccaaatattgctttttcatccattcggataatctttgcctcttatttgggtatttagaccattcactttgaatataattattggtaaaattggatatggagctaccacttttgtcaggtctgggatttaattttataaatcaaacttacaagctaataaattagcctgttactatttcatggatcctgacagaagactaatctgaggcatagagaggttaaataatttttctaggccttcacaactaagtcagtggcagacatgaggactgaaccttgaccatctaacgccagacctcaggttttgttttgttttctttttgagatagagccttgctctgttgcccaggctggagtgcagtggtgctatcacagctcactgtaccctcagtctcccacctcagccttccaagtaactaggactacaggcatgcgccaccatgcctggaaaatgtttttgttttttgtagagacaaagtctccctgtgttgcccaggttgatctcaaacttttggactcaagtgatcctcccacctcggcctcccaaagtgctgggattataggtgggagtcaccatgcctggccaaaccttaggtttttaaccaatatactgtaccaccccaaaagatgttttgcaattagataaatgtaataaattcttctatcatagcatcagtcatattttaattatttcttacctgtctgtccccttagactgtaagctctttggtgtaggaaatttttatctttaatttctgtatctcagtacttttagcacataagagttgccaaataaatgttttttaggtgactttttttctgattgttataaatattgttataaatattaaataagaattctgaagtagaattatgtaactataaatcatatatttataagattagaggaatgtttatgattttatatttatttatttagttgaatttatttgttcaaatgcctttattttgtttgtgtttggcaaatatttaaaataattaatattttacctgagcaaatattaagttgtttttgtgaggatagtgctctgtgcatttatcacagatactctgtggaggggatgaacgtgctatgaactgaatgtgagtgagctgtagtttttttcttattgctgttatattttttacttcatttcagtttttatcaaagttaattatgtatatgatttaaagagccaaacatgataaaaggcttttagtgaaaaactgcagttcactgtccgccaattacctttacctcaactcttactgatcttcatagtctttacttccttattgctaaagaacatgtttatgctgcaacttttcaatttttctttagttttcagcatcatctattgatttctttttaaggaaaattaggatttttgcccttctcttgcccgctttaggatgacctggcccatctactttgtgcagtgggaggattcttaaacagactattgaacatttacatgactccaatttccagaggcatctggagccaccaattcttaacttttcaagaatgtgtaaataatatgaattagattgcttcttggctttttccactattggcataggacactagtctctgcttttgtcagccatcttgtccatgttctttttagcttctagaatttttgctatttttctcctgtctttgttcttgaggcttctagcttttttcagctttatattaagaaaatgatgaaacctatagaaaagttaaaataacagtacatgagcatctagattccaacagttttgtgtgtgtgtgtgtatgtatgtatatacattcaaatgttggcaaaatgtaagttaatgtatgtaaatgtgtgtgtctatgtctatgtctttgtgtacggtggtggtaatgagtcatttcagcaagttgcataaaacatgacatccttatccctaagtattttagcatggatttcctaaaactagtgatacttcttgtcataccacattatcattgtcacacacaagaatattaatagcaattaaaatttcctcagttattctcaaaacatctttaatatcttatgtttataaagcaggattcaataaaggttcaggtgatgaatttggttgtctgtttattcttctaatctacatcatttttccaacttgtattttttaattatatgactttttgagaggaccaggccagtcagttgttttaggatatctcacatattagatttgtctgattactttctcaagatatattcatctgtcatctgtattttagtaaagtggttttggcccaaaggcttaaatagattcagattaaacatttttggcaagaatgcttcataaatgatgctgtggacttcatattgcatcacttcaggaagtacctaatgtcaggttgtttcactgtcagtgatgccaagtttgtcccacaggttaagaaggttaccatcatcagatctctccattgtaaagatatgtttctccctttgtaatgatcaaataatctgtggagtgatactttgccaccatttaaatatcctggtatccctcaatccttttacttagtagtattagcacatacaaattgttcttgtctgaatcagttactttattatgtttggcaaaataatatttttctaattttattatttcttttctacacattaattaccggtattctcctgtaaaggaaagctttctccattaattaggaattaaccacaattttgactttaaaaaagcaaggtgaatgctcgattctttttctttaatgactaatttttggagtaagaagttagcataatggtcatctacaatggtggcaaagtttcttacacccttcgcttgcttgcccgcttgcttgcccgcttgcttgctttctctctttctctctttctttctttctgaatattgctatggacttgaggattattgaagtatatttgacataaaacgtacccttgtaagttagaatgatttttagtgaattttaaaagttgtgctattaccacaatctagttgtagaacatttccatcacctcagaaagttatttgtctatagtcagtccctgcttccatctccagtccctggcaactactgatctgctttctctttctatagatttgccttaactgggtatttcatataaatggagccattcaatataaagtctttggtgtctggcttctttcacttaacataatgtttttgaagttcatccatattgtagcacatttcagtagtttgttcctttttattgctgaatggtactattatacagctatcctgttattttgtccattcaccagctgatggacatttaattgttcccagtttatggctatacaaatttgctgctgtgaacattcacatacaagtctttgcacctaagttttcatttttcttggatagatacctaggaatggaattgtgaggtcttatgctaagtatatgtttaactttttaagaaaccgccatctgttttagaacaatcgctgtgcttttccaaaagcagtgtttgaggattctggtttctccacatccttaccaacacttgatattgttaatcatttttatcatagccattctagtgggtgtgttgtggtatttcatgttttaatttgcagttctctaataactaatgatgctgagaattttttaatgtgcttatttgacatctatatcttcagatagacatttggtgtctattagaatcttttgctcatgttttaattgggttgttttaaattttgttgagttataataatttttttttttgagacggagtcttgctgtgtcaccaggctagagtgcagtggcgcaatctgggctcactacaacctctgactccctggttcaagtgattctcctgcctcagcctcctgagtagccgggactacaggcacacgccaccgcgcccagctaatttttgtatttttagtagagacaagatttcaccatgttggccaggatggtcttgattttctgacctcgtgatccacccgcctcagcctcccaaagtgctgggattacaagcatgagccactgtgcctggctgagttgtaataattctttatatattctgtatacaagtcctgtatcagattatgatttgcaatatagtctgtagcatgtctttttattttcttaatggtgtcattggaagagcaaaagtttttaactttgatgaagtccaacttatcacactatttttaattgactataagttttgtgtcatatctaagaaatacgtgcctaatccagagtcgcaaattttttttcccattttttaaaagtttgagttcatatttaggtctgtgatctgtttttagttaattttcatgtgtggtgtgaagtaagtgtttaaattcatttttttcatagaactcctggatttttgtttattcaatattttcaattgtagtcaatatttgtaacaatgctcaaatattccaattaggctggcgtctctattctttggacatattcgcatttgtctttagatacatctgtgcttttcggctgttcagtgtttcccccaacatatgcctgaaatcagctgtttctccattcttccgtgaggctctcattcctttcagtaaagagaccactatgggtgctcattgctactggggtaacaatcaactctaaactttcttagtggacagggctatggaatacagcttttaaaaatcatgagtttatattgatatttttcattcagaaaaatattgcaataaaacattgcaagttttatttcttttatatttgtttttctggtttgttactttaaaaaattcctttattgtcatttcagtgatgtttaaatgaaatttttctttttaccatcattaaagaatgtctataccctttcttttctacgcattttatttttgtcgactgtccaagggtgtgaccatttaactaagtgggtaagaatccaatggagtcatcaaagagtaaaaaggaaaaaataattccaaaactttgatagagaaagctactgtctaaaattgtaaggactaagaaaggaagttttctcaacctcacccttcttttttcttactttatagtttggaatggtcagctgtcattgtggatgaagctcatagaatcaagaatccaaaagctagagtaacagaagttatgaaagctttgaaatgtaatgtccgcattggcctcactggaaccatccttcagaacaacatgaaggaactgtggtgtgttatggactggtgagagaaaacactttttaaaaaattgtttaatagttcttcagctgaatacggtcttgtttgctaatcattagtttccaaacaaacgaaacagtcatttgtctggttttagatgtgtttgatcccagatgtggtatacacagtagagagtcccatgaaaacctatctttatatatattactcttggtccctgaagtaaatatacatgttcactgccagtttcatcctcatatcatagttagaacctgaaactgtcgtaaagaaagaacattctgttttcttggcttttgtttttgttaccgttgataatcaagtaatgtagtatatctcttagaagcaagaagttagtgtttttagataataaagcccttacatttttcttattgtctttataaagggctgtgccaggccttttagggagtgggacctacttcaagaagcagttttctgacccagtagaacatggtcagagacacacggcaacaaagagagaactagccactggccgaaaggccatgcaaagacttgccaaaaagatgtctggctggtttctcaggcgcaccaagactcttatcaaggatcagttgcctaagaaggaagaccgggtaagaaccgcatttgtatatattattaatttgtggtcatattttttttttcctttttaagaaaaagtctgtctcctgtggcattttgtaaatacagttttttgccttttattctgtatggaaaaaattgttgcgcgcagaatttcagaaaccattgattgagctcagttgttttccttactgactttattaacctgttagctaacaggtttattattagtatacattaaactcatttctcatcaaaaccttttttttttttttttgagacagagtcgggctctgtcacccaggctggagtgcagtggcgcgatcttggctcactgcaacctccgcctcccaagttcaagcgattctgcagcctcagcctcccgagtaactgggattacatatgtgcaccaccacgcctggctaatttttttgtatttttagtagagacagggtttcgccatgttgtctaggctggtttcgaactcctgacctcaggtgatccacctgcctcggtctcccaaagtactggaattacaggcgtgagccaccgtgcctggcctcatcaaaacttttgatgcagtttttccccagtaaagaaggaagagcttctctctgcagtgtgttttctgttcacacgttgtccttcctatactgtgtactatccaccacacagtgtattctttggtaccttaattctagctgtaggatcaaagtggttaagagctttttaaaaaatatataggtttgtttcttgtagaatgctatttgcagttacacaactaacctaacttttagaatttgtaggaaaactacattgttaaattgttcaagaaaatatgaggagtggacttcaagaggattttaaaaaaatatagtagtcttcttttatagttcttcatcttgtgtttcttctagcttgggcaatggaataaaggttctgtagattactatggaactaaacctaattaatgttgtcccaaataagggcaatcctatgaaatgccctctaattttagtgtatcctcttgattgtttctttaaaaagatagatttgaaaggaaaatacgatattgatatgcaagttggggaaatagatacatctgacttttgatatttatctaaagcaaatattgttactaaattgagatacttcatgaactctcacttttaaaaatgttttatgcaacttcatatatgtgatttagctatctgtctagtaggaacagtacaaaagtataagaaaagaattgttcatagaggtttagagcttggcctctgaaatcaaatactatttgattagagtatttgtgacttgcagcacctctgcttagagttttgtgacttggagcaatttgtgaggccctggaacctgggtttcttcctctgttaaatggtagtgatgataatagtgcctgcctcacatggttactctgaaatgcatgacacataagaaatattgagtaattggtactatgtttaataataataaataactgaagatacctttgtacttcaatcattgaccaccaacttctatattctctttttttcttatatgtacttttatatttaaggttggggtcaggctgtactaaatattttatataaacattttttaaaaatctagcatcaggagggggcaggctggatgtgtgctgccatgcatccttcttcagtctggtttgggtctttaaaaaataaaagataaaaatagcttccaaaagagttgtggtcatcctggctaaaggagcagaggaaatggaggcagtcagccctgtagacatgatgagacaagctgagattaaggtcaccattgcaggtctggctggaaaagacccactacagtgtagctgtgatgttgttatttgtcctgatgtcagtcttgaagatgcaaaaaagagggaccaaatgacacgatgtttctaacaggaggtaatctgggtgcacagattttatttgagtccgctgccttgagagagatactgaaggaacaagaaaacgagaagggcctcatagctaccatttattcaggtcctgcaggtctgttggctcatgaaataggttttggaagtaaagttacaacatacctacttgctaaagacaaaatgatgaatggaagtcattacagctactctgagaattgtgtggaaaaggacggcctgatttttacaagtcggggggcctaggactggcttcatgtctactcttgggattgttgaggcctaagagccaaagaggtggtggctgaagtgaaggctcgacttgttcttaaagactagagcagaaaaatgtgaccatcagttagagaaataagccatttggaatccattctcattgtgttttttaaaaacagaaaaatggtaggttaatatgctcagaagccatcatcagtcctgctgttgtgaagtaacaactacacagagatttctcaacctacaaattgtgtctgtttttttttttaagacggagtctcactctgtcacccaggctggagtgcagtggcgtgatcttggctcactgcaagctccgcctccctgggttcaagcgattattctgcctcagtctcccaagtagctgggactacaggcgcacgccaccatgcccggttaatttttgtatttgtagtagagacagggtttcaccatcttggccaggctggtcttgaactcctgacctcgtgatctgcctgcctcccaaagtgcttggattacaggcgtgagccaccacgcccggcctgtgtctacatttctgagcctgtttacagaataaacatggcatttagggaaaaaaaaaattagcattgttttatagagacattactgtatttgcttgtatgcacctttgcctgtttattgccaataatctgatgtagtgatataagcatacaaatatttacaaatatttatatgtttctattttacaaataaaaaaatgtcactgctttgtccctgaagtcaggaagtgccttgccagtaaaggactaccttttaaagttattttgatgttggataatccttgtggccacccagaaccccatgagttcaacatcaaaggcgtcaaagtggtccacttgcccccaaacacaacatgtctaattcagcttctagatcagagggtcataaggacctttaaggctcattacacctggttctctatggaaaggattgtcaatgctgtggagaagaaccctgatagaatatcatgaatgtctggaaggattacaccatttgaagataccgtcgttgttatagaaaaagccatgaaagccatcattcctggaatagtaaattcctgctggagaaaactgtgtccagatgtgcatgacttcacaggatttacaacagagccaatcaaataaatcatgagaggcaaaaaaggtgaagggtttcaagagacggatcttggagaaattcaagagctaatttaaagaaattcaggacaccacaccagaggaattaatcgaagatgacttgatgcagataagtgctttcaaaccagtgccagacgatgaggaacaagacgcagaaaaagcagtgccagaaaacaaattgacattaaataatgtggcagagggattctgattatttgagactgcttttgacttcttttatgacatggacccttctatgatatgggcactgaaactaaagcaaatggtggaagaaggactggcaccatatagaaacatttttttagagaaatgaaaagcagaaatgtcagacagaaattacgacatgtttctgtaaagttacaccaagtgtgcctgcctctcctgcctcccttgacttccttttcacttccttcacctcttcatttctgccacccatgagaaaacaagaccagcctctcctcttccttattctcctcagcctactcaatatgaagccctttatgatgacctacttccacttaatgaacagtaaagatattttcacttttttgtgattttcttaataacattttctttttttctagttttatcgtaagaatataatatataatagatacacaaagtagtgtttctcaactatttatactgttgttaaggcttccagtcaacagtaggctattagtagttatgtttttgggaagtcagaagttatacatggacttttgactgtgtggggagttagcaccctagcgccatccatgttcaagagtcaactgtgtaaggaacatcatttgtttgttcatattatgatttcttttaattaaaaaaattctatgaggtttatttgaaagtgaaattatactttatattatccagggtggggtggagagcaaagaatataagacagtcagtagaaatcatcataatgatgtaaatagagggaaaaattagtttatagcaattttcactattttttttgagacagagtctcgctctgtcgcccaggctgtagtgcagtggcgtgatctcagctcactgcaacctctgactccttggttcaagcgattctcctgcctcagcctcctgagtagctgggactacaggcgcgtggcaccacgcccagctaatttttgtatttttagtagagatgaggtttcaccatgttggccaggatggtctttatctcttgaccttgtgatccgccctccttggcttcccaaagtattgggattacaggcgtgagcctctgcgcccggccagttttcactgttataatctatgaaatcagatgtagattatgatttttattattgttataaacaaaatactaataactaccttgtattttatcttggcagatggtgtattgttctttgacagatttccagaaagctgtctatcaaacagtgttagaaacagaggacgtgactttgatacttcaatcttctgagccttgtacctgtaggagtggccaaaaaaggagaaattgttgttataaggcaagcatttcaatatatctttataatcatgcttttgattacatagtactctcttctagtgtaaaagaaagtagcagatgataaaataccttttcctcagacagttctttaaagctatgtcttaaaaaatagttttcaaaaatattttacaatatcaaatagtaatcacatataaaatacaatattcaaatatattttcaaaaagttaattgcagaaagtaagcttaattttgatatcctccattttagcttttcttgggaagtatcctttcattttgaaatttcatttcattttcaagaagtttctcattatccactaatagtaaacgaacatactcttgtataggaggcttaaaatactattctgatgttagatatagtgtcaatttaatagaaactgagtatcaaagaaagtgttttttttaaagaaacaaaatttatttgtactttttctaaccttttgtttatatttcctgctcatgtttcacctctgttttattaaattatgtcacatatctgtgtacgtagagaaaccctaagtgaatatttatctagtttgatatttatttggtctcatttattttgctgtttttaactacttcccttttttgtaatagcccagtttcctaggagccttggagcataaatgagaaggggtctgcatagcactgccactgcacttagattttgttaccaggcacctcgtaacagcaacatttccatcactgtgtgtcatgaggataaatactttctgtaataaggattttctccctttatgaaaaatatagttgtattatgatttaccaaaagtatgcttccacattagctatttgtggatattttgtgcaatagttgaccatcattttcttggaatttattgtgccaaagtaacccgataataaatgttattgtaagtgatacattttatgatgtaagcaggtgcatagctatgctggtcctttttattttctatatttttctggttacagaccaattctcatggtgaaacagtgaaaaccttgtatctcagttaccttacagtccttcagaaggtagctaaccatgtcgcgctactgcaagctgctagtacttccaaacaacaggtttggttagcattttacatttctttgtgatgctattgttgtgaatattttataaagttttaaaatagttattaaataaagtttttgtggatgaaatttaagaggaaactgatttgcttatttttaaatgtagatatcaaggagtatgtgcacttaagtttttaatcaaagtgaacaaatttaagcttaatttaaaataagaactatcttttatgcctttaataatgttcatatctttatttttcaaaacagtctttggtataattactaaataacatatttgatgggtcagttctattcctctaataatgtctgtaatggtatttaatctactgggtaaaatgaggatttataataatttgtatattaaatattagggctgtttaccaaactggcaaaaatcagtaatttcaaagtttactttggttgtttccttttattctagagcacacataaatgaaaagatgtttttgtaatgattttatatttttttctgttatagttgatgccatttaaatgtaattttgaaatctcataagaatttgatattgttctttgatagtactctttactctttgggagtatttagcaccttgttttggaaatcttaaaaaattgaaaagtaatgatcaagttaataaccacatcattaagaattcagtgccatacgtttaacatataactttaagagtttttgaattcttagtctgacttagggaagcaaaaatctttaaagtaatacattctttctaaaaagaatttttttcataaattatttcaatttatacaggtttgaatgtgttaagtggaaatatcttttcttctgccttttcccttcaaggaaacacttatcaaaaggatatgtgatcaggtattttccagattcccagattttgtgcagaaaagcaaagatgcagcctttgaaacactttctgaccctaaatacagtggaaaaatgaaggtaagtgctcctctttcaggttgcatacagacatgatacacaaaatatttattcagtggtatgacagagacaccaactaatcagaacaggtgctcagtcattcagaagagatggtggctatggacaagtggtgcaattgtatcagcatttactaggtcactatgaaccccgaatacagatggtgtgcactcgataggtcctctgtagtagttgcttcaaatatacttcaaattttccttattgatatattggacttatgccctcttaaaatgcgtgtgctgttaccacatagataatagcttgtcttcagatgtttaaggaaataacctaccagaaatataaaagctaatgcaaaacaggggggtaaggaaaggccttaccttggaattagagaaaggaatttcttgaagagtttaagatgggcaaggtctgtatgtctagaattttctgcatgttgtttttacttgcagaactagatcgtaaagttgcaaatagtcatttgtcatacacaggaaaattgacctgtagctgtgctgctcttggtaatgtgttaccgagggaagggtgggaaaagtaaggctaagttctccaaccttgacccaggccttgggcattgcctgtggcagcagcatgaaatgctgacagcttcctgcctccttgcaacaacagagtttgtttaaccccttagtgtctatcaagaatctttatttgtagattcacagatttttacagaacaaaactcaactttgttatagtttttaaaaggtaagttctttttgacataaaaagaataaaaaggaagtagttcaaagcagtttttgttttttttttatagaaatacttttagcaattgatctagataagttcatcatggtttagtttgcttgggacctctaaaatcaatgaaataaaatagaaggtaggaatatacatacatacataaagactattgcattaaaaacttgcttttaaaaaataaatgtttatattaatgaggatatcatgtgatttattaccacaacaaataattcaaatctaatgatatttcctaaggtagcaaatttttgtcatccatttcattgactttaattatttttaaattaaaatatataaaaagtccggtttagaactgagcacttactatcccacagtttaaaccagtagaacatttccagaaattatagcctcctctgaaaactgcattagtcattgctactcatttaaattttattccctgtgactcttcactaaaaaattgccagtcttgaaattaagttttataactctgcattttatattttttatatattcattaatatatacttgtaaaatatacttttaaagttaatctccctaggaataatagtgtctgattaagagaatgattaaatttaattttattttaatttttaggagggaaaaggtaagcataaattgttgctggaggctgggtagtatttttatatgtgaatgatgcaggtaatttacttggtttgtgagagagcaccagccaaacagatggatagtaataagctagggatatatttttaggactatgttaaatcatttgactaacagcatcatctggtcatatattgatttggtaatgcagacttacaggcttatcatagaatcattgcctatgggtttaagaactctaagaattgagttgcatttaccttttgaattcaggtgataaaagatctttgtttagcttgtcttgtcacaggtcagcctgcaggtgcaaggactctgaacagaatgcctgctataatctttatagcctcaaagctacacttatgaccccacctctttctcttgagtgtcagagttttgacctcaactatcattcaaggggttagtcacaagttgcaatcattcacctgatgaaaatcttcacttttctttctcttgagaaatgccgcagagccacttactgtggagggtggaaaaaaagacaggaatccagcttggtgctgctgaagtcacacaagggtcatgttcatctttctaggcctgactgaccaagttgaggaaagttaagatccaaggttccttgctgttaacacccccaaataatacgattcctttataggtggattgtcttgttctgtggaggacaactgagtgataaaacattgggtctatattgttaagactccaacatctgttgattacattgtcattttggaaatttctgggatcttaatttatagtcgttcatttagttagtctctttaaactagcctaattaagatctccagtctaaaaacatttacttttcctgtgacttgtttttgtttttactgtaaaatacttgaaaacacttaaagttgcaatagttatgataccaccccaaataatgagaatggatttctatacaatatatccttggtttaaaatgttaatatcttaagaatgaaaaacaaaccacagactgggagaaaatattagcaaaacaataaaggactggtttacaaatatacaggtaactcttaaagctcaacaatgggaaagcaaacaatccaattgaaaaatgggcaaaggatctgaacaggtacttccccaaagaagataatagagatggcaaataagcatgtgaaaagatgctcaacaacatatgtcattaaagaattgcaaattaaaacagcaaggagataccactagatacctattagaacggccaaaatccagaacactgtcaagcccaaatgttggtgaggatgtggagtaacaagaacccccatctgctgctggtgggaatgcaaaatggtatagtcactttggaagacagttcagtggtttctcacaaagctcttaactaaaaaatattaccttaaatagtcttactatatgatcccgcaattgtgccccttggtatttacccaaatgagttataatgaattaaattttattgagttttaatgagttagaaacttacatcccgacaagaacctatgagtttatttataattgccaaagcttggaaacaactaagatgtccttcagtaggtaaatggattaaaaaagctgtggtacagccatactgtggagtactatttagcaataaaaagaaatgagctatcaagctaccaaaagacatggaagaaccttagatgcatattgctgagtgaaggaaaccagtctgaaaaggctacatactgtataattccaactatataatactatcaaaaggcaaaactatggagacagtaaaaagaacagtggttgctatgggttctgggggaggaaagaatgagtaggtgaagcacaaggaatttttagggcaatgaaacaattgtgtatgatactgtaatggtagatacatgtcatgatatatttgtcaaaacccgtgaactatgtaacacaatgaataaaccctaatgtaaattatggactttagctaataataatgtatcaatattcactcatcagttgttacaaataaaccacaccaatactaataatacttgatgttatattttctaataatattattaatacagatattaataagagaaagtgtggaggaggttggaagtagggaaagaggagttttgtgcattttctactcagttctgtaaaacagaaaaaataatatctaccaatttaaaaagtcttatgtgaaattcaaattacatacttcatatagaatcagttattttattaaaaaatgaactaaatgcaaataaaacttcatatgttctccaaatgtgaaagtaatgtttacccgatccataacatttttatttaccatttgataaataaatttggttatctgagtagaagttttttttaactccatagctttttttgagggactagggggaggtagaggtcaaagttagcacaatagcttctcttgattgagtaagtgttatattgagtattttttttatttaaaagcttaaatgtttatcattaaataaattgttttagtgtttgtttcatctttcagaagaatttagactttgtatagaaaatttctttttcccctctgtggattgcttttccacattgttctggagctgtcattgccagatgtggaaataaaagtaacagtgtgactgttatacacaaggctttggactgtttgtttcctccctgaaagcactgtgtgtgggggcagattactggcattttgaggtcaaaatcaaatctggaagtcagagcttactgtaaatagagaaacaaaggggagaaaatgagaagaggtgtgtatctgactgattattctaagaaaataaatatcaagacttttagaacctagatgtaattgaacacatttcattacatccatctagggacaatttaaatacttcctaaaaggaatgctgctctataatttagtttcttagcatattgtaggtataaagaaagtgtattttggaaattaaattaatccatttaaatgcatcccataatccaaaatgcttcctttttattaaaaccagatgagatgaaataaaagtctttgggaactttacctccttattgacaatatgatgatgaataacatttgatgtaatagctaatactttatttctctaacttggaaaaaatgaaaggaattagaaaaaatgaatgaggttagtattgtatgaaaataattttaaagaaattctcaagtgatgtttatatgtataaagtgtacttttagttggaactggttcactgattttctgtggttcattttcaggtccttcagcagcttttaaatcattgcaggaaaaacagagataaagttcttctcttttctttttccaccaaggtgagttcatctaaagtatatccttgattggccagcctcaacttttgaggcataaagaataaagcatatgcctacatgacaccttacagccacattttctcttatctacacagtaggaaatagtgaggtaagcaacttgaagtttttaaacagacactaaaatttcaattgtttcagggttgctaaatatcaaactcaaagatagatttttattttctgttgatgttcttaataattacaatgttctttaagacatttcatatattttagaacttaaaaaatagcatgcatatatttatgtaaatgatttgaccagtaatattgtttgtttcttaaaaatgaaaagattgatttttaaaacaagttctgaatgttaaagccataatgttgcaggataacgggaataaatatatgggtcagaagtgagaaaaatatttattgttcttggaattataagaaagaaattatgaacaccaataattaatacttaacaagtctcaactttgtaatggtctgaaacttacttaaccaagattcatgtttgcccatcttcatacctctcgtctagttgcttgacgtgctacagcagtactgtatggcgtctgggcttgattaccgacgacttgatggaagtacaaaatcagaggaaagactcaagattgtaaaagagttcaacagtacacaagatgttaacatttgccttgtctctacaatgtaagaaaattaaatttaataactagatttttatccaattgtttttgagatttagcataatttttaaaactattactggattaatttttaatggctatgcttatttagaagcagcaaaaatactattatgaccgaaatttcaatgtcttaagttttagctaagcttttctctcatttcctttatcaacattgaattcctcttagaagtctgggtttataaaggtaacaataaaaaaattgatacttcctcctatgaattttccatggtagtgttttgacccaagtctcctggtgagaataatcagacttcttattaactggataactgagactcactgtagcagcagttttcccactgtgtcagggagcccttgagagcccactggggctaggggctcacgtttccctcctctgcctctacctcatctcaactggagcagctctgcagttagagtttttatgaaaggtaaattggttctaacccctatgtatgaatatccctttaagaccttttagagaatatacacacttctgaaaagatttaaatcaacataaacacctaagtaagattaatcccattttaggaaggaacagatcaataacttttgacatcctgtgtaataagaattttatagattcactcccactgtctttcagaatttcaatggactttaaaaataaacatatataaaatgcacaaagtaaaaattaaatcagaatagaaattaacttaaaatgaggaataaaatatacttatgaatgagccaacattgttgagcactttaattattcttgaattcctaccactaaggcaaatggggaaaagctttggattcccattttcctataaaggaatgcaagaagtaatttttttcatgcgtccttacatacagagcactaaatgacatagaatactgtggtcaattaaatttcataaaacatataagcattctaactttaaagtgtttccagttgatagatgcactaaacaatggttccaataatagactctataatgacaagcagtagtctcttatccttcttctgctcacttccagctcatttgctgagatcctccataaagttcctaattaccccttcacctctatctgtcagaaactgctatttaacctatccattgaatttttaattttaatcatacttcgaaaaacatctttttggatggcatttttgctctattaactcctgtacttggtggtgctgatccttctatttgttgtttcctctggctcttgcttatggttgatagtttcttcatgtttggtcattttttttcttttgagcttatcttcaatgggatttttttcctctggaaatcctttggagaccggttgtaggagttttctgcttgtgtggttttgctttggcttctgctgggcatcctgacaagacaagggaaaaagttttggattcctatttttctgtgacaatttgagtaatttatttcataagtcattatataaggaaccttatgtaatataataaatacattcttcagctgtgttttgcaaaagacacataagctcagtttttgtttagtttctatcattttgcaagggtttatatttaatatgttgtgacagaaatgttttcacattggcttagccattatcttgccagagtacaaagtcttcattatcttttagtttatcaactttacataagttggaacttctcttaagaaagatgattaggctactttcactactctctccccgtttttttctcacagtgtttgctattttaaaattatttgtctataaactacttttgtaactttcaatctttgtacttctgcattagatccattgaattttctcttagatctttttcctggatcccgtgtcttcttctttcttggtttgccgccatgttttactggaaaatgattcaagttttgatgtttggtccattaactttccacatgccttctaagtctttgtaatgtgtggtattagcattagcacacacccacccacccttctacttttgtcacctatacatattatgttaactattttaacttttactttgtcaagggtattaatgttttcaataagccctgtaccagtaaccggttattgtccataggttggcattaaaatttgaaggcaaaaaagcgtttacattactatgtttttataaactaaacatctttaatgcaggggcaagtagtgctaagataatttttcttaatgttcacgaccttttggtcaatgcaagatcagtcttaacatcaacctcatatgacttctctttcctaagacttcatccatgttttatgtttgcactgttcagttcacttcaaatttcaatcatgactttttcggtcttttccccctctcagtctgtttctgccctttgtaataatcctcaatgttactaattctcattcacacattctcttctgttgagtcctctgtatcctgaacctgcctcctgaaacttttattccttagtttcaatctggcccagttttctaggcctgataaagaactgtcatgttgaagctttctttcactgctcttctgtgttggatctttttcctgggttccatgctgtttttattcttgacttgcccctttgttttcctaggaaatatcctctggtaactttttaagccagaatatataggaagtaaattttctgcatctgtaaatacagaaaatgtcttttattgctctctcacttaattgatactttgtccaactatataattctaaattgaaaatcatttcctcttagatctttgaagggcttgcagcattgttttctgatagatggtgtggctaaatagatgtgcagtgccaatctgattttcattcctttttgggaactcgtaagagtttttcttcatctacactattctaaaatttcacggtgatatttgagtcttggtgtggatcttcgttcatttttttgtgctgggtacagtaggcttgtattctgaaggcttatgttctttttcaactctggaaaatgcttttttattatttctttaacaatggccttttttttttcttcctttttctctgctccctccctctggcatgccaggtcatcagactttcaaactttcaaactatattggttctttaaatctctgaacttttctctcagactttgtctttttgctctgttctgagaaatgtcatttttcgatcttattattttgtttgaaatgatcacttttttttttttttaagacagtgtctcactctgtggcccaggctgtatggtgcaatcttggctcactgcaacctccgcctcccggatttcaagcaattctcctgcctcagcctcccgagcagctgggactacaggcctgtgccaccccacccagctaatttttgtgtttttagtagagacaggatttcaccatattatccaggctggtcttgaactcctgacctcgtgatctacctgcctcgccctcccacagtgctgggattataggtgtgagccaccatttctgccatcacatttttaatctaaagtttttcttgctttctgacctcttttgtttttggagttaccttttgttttagaacatcagtgtgttaaactctagctttttatagtcatttcattcagtttatttaaagaatgatcatctggcatttttcctggggtttgttttttgtttttggagaatcaatgaatttattaatgagtttgaggaaaattggagtttttaaggtatgaagccaccctatccataaacatggtatctctttatatttatttaggttttcttagaagcattgttcaaatggatacttcgtttgaccttttataatacttaatacataataataaaacttatttcatcaaagacatgtttgtagaacattaagatgtagttaaggtgtactttctgatatacttatttgatacaggaagagcatgtggcagacctaaggaataaacagcctgcatactcattaagtgtctcaaataccagtcctcagttcgaaaagagcaatattaaaattttttttgcttaacaagtaaccctttgctgttaaccatgtaagaacagagtgacaagttttaaagtttaggtttctgagttgtattatcatcaaagggagaattatctcatctgcagagagagagagagtctagggcctttttcttcttctttaaagggagctttgcttcttcagcaaggactgaagttattacttcagaatctcttggaagattgctacctcaactagtagagatcttatctgtggctcatatatggcatctgagatggcatcatacatggttatgcctgaccttgccatcaagaaggtaactggaacagttgattagatttattcaacatagaaacctttaacttcgtttctgcttttttgctgtctaaattccacccaatcccctaacttatccatttttttaatcctttctaatactttctccctatcccacctcattcttttcttagagttcagtcaagtctctatgacatcttcatggtatgtctaataagcagttttccaaaggagaaaattcagtttctactgagcactgaactttcaatcaggacatttgggtttgaatcgagacacttgctacttaggagaccttgaacaaattaatttttgtgattgtcaattttctcgcctgaaaaatcaggatattttgcttatagaagtcttcagaacaggccaggtgcagtggctcacgcgtgtattcccagcactttggaaggccaaaacggatggatcacctgaggtcaggagttcgagaccagcctggctgacatggtgaaaccccatctctactaaaaatacagaattagccaggtgcagcggttcatgcctgtagtcccagctactcaggaggctgagacgggagaattgtttgaacccaggaggtggaggctgcagtaagctgagatgacgccactgcactccatcctggacaagacagagcaagactctgtctcaaaaaaaaaaaaaaaaaaagaagtcttgagagcaaaagaactagcatatatgaaaataccttgcatagttcctgatatatagtagatgctcaataaaggttaatttatttgcatttttgatagaaattgtaggagaaaagattatcatttttcttcccctggatgattagcatccagtgtaaagcattatctaagtgtgagttgttttgtgatacagtgtaggcagctgatgagggaaaatggcaatgcaaagcctcagaggaaagcctgaaagacagctgggctcaggaaaacagttgaggaagagaaagaaaatcattgtgttcttggattttggttttgccttttctttgtaaaaatgtaaaaatttatcatcgttgtcttacagagtattaaatacaggatatgtagatcagatagttcaaaacatgaaaagatcacaattattgttatttaaaatctattaaattatataggcagctggaatcttcaactcagtatacaaacattatatacattcagttttgccaaaagtttcctttagaaattttattccaaaagaaataagtagtatgctgatagaaaaaaatgaatctagcaaaaccaatatgtgatttttatactaataataaaaactgccaaaaaatatgtctttagtgacttctcttcactgttaccttaaccacaggtcaagttaaatgaagacaaaacttttggcttccatttaagtgtcaaaaagactctgtagcatgaatactaggcacaacttcattcttggttttgactttcagaatcatacactagttgactacaaacagctttctaagcaaaccctataatttgaaatacaatgctttattcatacttactaacttgtgaggattaagttaaggatttggggtaccatactgcaaaagtaaaattttccagatgatataagtacctctaggtagtccaacaccaggaatcatgagctttgaagggatcaggagaaacatcattttctgtctctcataacattattccaaaacactgtcaactttcccagaaagatgaggacatttcttttgttatgtaccccaagagaaagacattctaaaccactcttttcaaataaataatgagaatcatattatatgccttttgttaaaatctgcctttactgctttattttgtctcagtctcacacctttttgttcaactactaatatcttcatggacccttaatgtgcagcaagaaaaataagagaatttttgcctttgaagagcagtataatgcaataaatgctttactggagtttatgtgtgaagattcataggcatttaagaaatagatagatcaaaaaatcccatagaaggatggtgatgttttaactggttctttagagataagattttattaaaaagaaaaggaaaagcaggttttggtaaagggcattttaggcacagagaatagcataggtaccaaaataactagagaacttatgtgtttagtgcttaggatatgtggaggcaacagcttgggtgtatgactacataggagaactcatgagttattttaacgaagctcagtttaacagagtgtaagtatccactctgtgacaggccctggaggagacacgtctcttaaagtttataactcaaaaagtagaggggtacaggaggagttgttcagaaacatgtaaaaggatagttcaatacagtatggcgaatgcagggtaggaggaggcacagaggagaaagatttagttcaggctttgttaatgacacctgaaggacaaggaaaagttagccaggcaaataagatagcagagaaaattgtatgaaagcaactttaaatgttttggtcacttgtggtatagttatcaagaatgactggtgtgataccagctgcagagacggtaggcctggtcattgaggccgattggtctctgatgaataggaattaatgggttttaagctacaaacagctttctaagcaagccctgtaatttgaactacaatgctttcatacttactaacttgtaaggattaagttaacgatttggggtactatactgcaaaagtaaaattttccagatgagtagtacacttagttctgtatattctgtgcttaaaataatttttatgtaatgtgagaatgggcatgggtgtaaggtctgaagtaagagaggacaatcagaagaccaaagaagtaatacatgcaagtgcaatctaataacagctctgaaaagggcagtggtaataggaatggagaagggactcaagagaaaaacatttctgagctaaatatgacaggacttgatactggttagcttttagtgggaaagggaagtagtcatggagaagaagaagtctatagtgatacttagcatggcttttgactttgatgagtgagtatatgggtggtatcaccaggaaatatatggagaaaaagaactctgggtccagggaagtattagatgtagctcattataaaattagcattgatgttatttcatcttgttctcttccttttggagagagaacatgtggcatcctgttgcagtgtaactcttggctctctctgtattcactatgacaagcctgaagcatatgcggtagcaccctgactgcctgtcttgtgatcaacatgtgatggtggaaataatctgtacttaagaatccattctgtgttaaggccatatggatgttagccacatttttaaattaaactttttattctgagatatttctagattcacaagtagttttaagaaataatacagaatgatcccatgcactctttacccagttcccccaatgtaatatcttgtaaaactgtagtacattatcacaaccaggatactgacgttgatacagtgaagagcagaacatttccatcacaagaatccctcatgctgtccttttgtagtcacatctgctttcctctctcccctttctccctgagccctggaaaccactaatctgttctccatttctgtaatttagaacaacataatcaagaatgttatgtaaagggagtcataaagtatgtaaccttttgggattggctattttcactcagcgtaattccctgtaaattcatccagttgttgtatgtatcaatggttcttttctttttattgctcttagtattcatgatatggatacaccacagtttgtttatacattcatctgttgaagggcatctgggttgtttccagttttcggctgtgacagataaagctattaacatttgtgtacagacttttgtttgaacattagttttcattcctctgggataaatgctaaatattgcaactgctgcattatgtgatagttgcgtatttcgttttataagaaattgctaaactgttaacaaagtggctatatggttttacattccccacagcagtgtgtgagtgatcaggttcctctgcattttcactaacatttgctatcgtcactatttttttcattttagccattctgatgggcatgtagagacatgtcattgtggtttggatttgcatttacctaatgtctaatgatattaaacatcttttcatgtgcttcttgtataaagctggtgttaatgcttctgtaaatggtaaaattctccagtgaaatcatctgggcctggaggggttattttttttccctaagagttttgaaaataacatactcaatttctttaatagttataggactattcaggttgtctgtttcatttagttgagttcagtggtttgcggtttttgaggaattgtttctcttctaacttattgaatttatgaccataaaattttttatagtattcatttatccttttaatagctgtaggatctgtggtgatatcccttgtttcatttctaatattggtaatttgtgtattctcttttatctttgtcattgctagtttagcaacgaatcagctttttttcactgatttttctctgttatttttctgtgttcagttttattgattctgcttttttatttattatttcctttcttctgcttgctttttttgcttctttttctagtttcttagggggaggacctcagattattggtttgagacctttaatttttttctaatataagcatttaatgttacaaattttcctaagccctgcttagctgcatcctacatattttgatatgttgtattttcatttgtgttacattattatttatttctccttgtattttttttcacagtttttttggatttcagattttgtttgactcatgagctatttagatgtatgttgtttaatttccaagtgtttggaattttttttgttgtcctcctgaaatgtattgctagtttgactccattatcgttagagaacatactcagtataataccattatattcagtatataccagtatagtttcagttcttttaaatttgttgaggtttgttttatggcccaggatttggtctatcttggtgaatattctataggaaccaggaaaaaaaagtgtgtgtggtgctgttctaggtggagtgttctgcgtatgtcattggttggtcattttgttcttttatatccttgccaattttctctctaggagttctatcagttgctgaatgtgggatattgaaatcctcaactataattgtgcatttgcctgtttctcttttcagcttaatttgacttcatgtatctttcagctctgctgttttggtgctgtttggtgttttggcagattgatctttttgtcattgtgcattgtccctcttttaactattaactttctttgctctgacatatacttggactaatattaatatagccagtcttgcttttttctttaataattgcctggtatatcttttatcatcctttcactctcagcctagctgtgtcatcatatttaaagtgttttgttttgttttttgtggagagcatattgttttttcaaactaccctgccaatcttacgattttaaatggtatatttaggccattatattgaaggtaattattgatattttttatttaacttttatctttttatctcctatttctagttccactgtttctcttattcagacatttctttaggattctgtatttgtttatgtatagtgttttttagtgtattgctttgtgtagcttcctggtggttgctctgggtatttacattgtacatagtaacttctcacagtctactggtatacaggtttaccagtttgaatgaagtatagaaattttacttacatttaagcttcttttcctactccacttttaagatattattgtcttagatatttcctctacatgccctaagcagcatatcagattgtattgcagttttcctttaaccatgaaatgtgatttatgaaatgcatgagaaataaaatagtatttatattcacccctattttaacctattctgatcttcctctttcctttctgttctagttccaagccttattctgctttttttttttttccttatgaactttctagccaccaatcttttaggttaagtctgctggtaacaggtgctcttagttttcgttagtctgagaatgtcttatctcctttccctttctgaaggatattttcactgagtatagaattctgggttgacagttcttttctttcagcacttgaaagataatgccactttcttctgatatccatggtttctgatgtttctctctgttgttcatatttcgtgaatgatactggttctcatcatgcttactgattctgtcttttgtcttttccactgtactgttcagcccatttggcaagttttgtatttcagctatttttccattccaaaatttttattttgctctttatatccatttttgttttgtttgtttttgctgagactcaatttttttgtttgtttcaagcatgtttgtaattgcttgttgaaacatttttatgatggctttgttaaaattcttgtcaggtaattccaacatctgattcatctcagtcttttcttattcaggctgcaattttcctggttcttggtataagtgattttttattgtatcattgtgtcttggacattttgagtattgtgttatgagactctgcatgtgatttaaatcttccattttagtacacctcctctttgacaccatgccagccaagtaggggtggaaagctaggttccgtctttggcctctgctgatagcctgagagggaagtgctttactactgctcccacctggcgtcccctgacaccatggagggagaccctgttatcattgggaagaaaacgaaagctctagctcttcactcagtcttctctgacaccaccccagcaagaatcagtggtagtgtctcattatagccaggcaagggtagaagtctagcatcctcattcagcctttgctgactaaggtagggatggggctgcagattgttccttggtgtttggcaggagtagagtggttattgtgtcacatttttctgcctttcaaggctacacctttcctggttctttggctaaagggaaaaggcttttcttgggatatatatatatatttttatagtctgtgactttcggcattaccaacagcttgggatatgttaagaacccagcttgtggtatcttaagcaaaaaagaaagctagactttcttctcacagtttttttggatttcagattttgtgtgactcatgagctatttaagtgtatgttgtttagtttccaagtgtgtggaatttattttgttgtcctcctgaaatgtattgctagtttgattccgttattgttagagaacatactcagtataataccattatactcagtatataccagtataatttcagttcttttaaatttgttgaggtttgttttatggcccatgatttggtctatcttggtgaatgttctataggaaccaggaaaaaaaaagtgtgtgtgttgtgctgttctaggtggtgtgttctgtgtatgtcatttaaatcctgttggttggtcagtttgttcttttatatccttgccaattttctctccaggagttccatcagttgctgaatgtgggactccttcagctaggctttcttttttggaaaagccatggaagctttcttttttggaaaagccattcctttttttcaggaaagccatgactcactgccatgccattccttaggccttgtagtccctagcctgcctatcttctctgtacctttcagagttttacgtttatttcctatgtaatatccagagttttagctgcacttagtggaagaataagatgtgcatctattcctgaattgagttttttaatgtatgcattactttatttagctagaatgtactaacactttttaaaaattatattaggaaaatcttgcagaagtagtatttgagtatcaaaaaaaagtaaaaaccagcacaaactatttacgtgggctctaatgaccagttttttagggattttctagagtggtagaaataaaattgtgccttaaatatttaatttgtggcatatttgtattttaatcaccaccttactttgatgaaattaatgcaatatcgtactgttttggctatagaaacctggcacagttgagttatagcacaacagttagtttttgctgttctaatgtgctttttttttttctctttcctccagggctggtggactaggcctcaattttgtcggtgccaatgttgttgtattatttgatcctacttggaatccagccaatgatcttcaagccattgacaggtataatactgacaaaatttaaagtgatctgcaaatacttttaatctaaaaatactcttgaacttttaaggttgcttatactatgactatgattagaagaaagggggaaactggtaaaaacgtacatttaatataatcctgaccttctcaatccaaataacagtccaaaaatagccatttttcatccatctcagaatcctattaatatgacagaaatgacttaagaagaaagaataaattcctaatactgtaggaaaataggatagttctgtactagtagatcagaagttttgagaaactcctggaagatagaaagcaagtagaatctgtgatcagggtatccgcagagaaatactacaatccaaagtctgcaggaaagagtacagaaattttaagcatgggcttgcaactacagtatgtgggagtagacagagtgcatcattctgggaaattgataatgtcctgactctaatacaaattcccctctgacaccctactttacagagagattggccgtaacaggtactctttgattaaagctgaaagaataattttacacattttataaacaaatggggaatctgactgtagaaagcttcctagaatggatgttggaaccagatcataaagccagagccaagcctgaagtacttccagatctccccaggacatgaaaaagggaaatacacgtgttacctgcatggaaacacagaccggctttccagtgatgcacctagtcgtcattttaattatgaatgggaaatgaagaattatgaaacattttaataaaattaacctagcaagaaagcaaaggacaaaggtgaaaaacagacattgaagggaataaaataagaataggatgccaaggaaaaaagtacataaaaaaacaaattagttcttataaattaaaactattgccaaaataaagtgactcagtagaaggtctgggaaaaaaaatggagagggctaatggaaggatatggaaaaaaatgaaggtctgaaaaaaaatggagagggctaatggaaaaatggagaaggatatggaagataaaaggaatgaatattttaaaacataaagtcaagtagcaaatagatgtgaaatatgagtaaagagaaattgaggaaaaatcccagaaatcatcatctgtgtattccagaaataatgaacagagactggaggacgggagataattgatgacatgattggagaaaattgttattaattttgaaggggcatttagtatgaagtaggaataatgactgagagagaaaacatacatgttagtaatatttctaagtttcaaagataaagagaagggctaaaaggttccaaagtgagaaacagggagagaatgatttataaaaactgcaacaaaaaggaaaagatacattgttaacaaagaaatgagaatcagactcaattcagcagatcagactttgaagaacatacatttcatcagcattataggattctagaatgacaacagaattgtcaaagtgaaaaaatttatatggctatatgtgaaagaaaattattttgagttgtatttacaatttgtggctaaaattttaagtctaaaaaattactgggagtgtggctgataggcttcatgcagttgtaaagaaagaattccctgaaatatgaagggatggtatgaaaaaattagtaacaagaactaaaatgttatataaattttgataattgtcagaataagggtagaggtgggtaaagttgtcttagaattgtttttttttcctcaggaaaggaccaggataccctggtcagttctcaaattgtatgccaacaaatgtttttaaatgctagcaaaaaatttaggggcaacaactaaaagagtgagttataataattacctggtacaattttcaaaaacacagatgctcaaactccaccctgcaggcattctgtttatgtagatgtagaatgggactcaacattctacgttttaaaaaacacccaggttgtggatcaaaggacactatcaacagagaaaaaaggcagtctacagaatgggagaaaatattttcaaatcacatatctgataaagtattaatatctagaatataaaaagaactcctaaaactcaacaacaacaaaaaacacaacccaatctaacaatgcataggacatttctccaaagaaggtatacaagatatataagtggccattaagcacatgaagagatgctcagcatcactaatcattagggaaatgcatatcggaactatagtgaggtacaacttcacacacgttggatgactattgtaaaaataaaagcaacaacagaaaacaagtcctagttgaggatatggagaaattagaacccagaacccttgtgcattgttgatggaaatgtcaagtggcacagctgctgtggaaaacagcatggtggttcctcaaaaaattaaacataaaattaccatgttatccagcaattacacttccactttgggtatataccaaaaagaattgaaagcagagacttgaagagatacttgtacactcatgttcatagcacctgtattcacaatagctaaaatgtggaagcaactcaaatgtccatcgatggatgaatggataaacaaaatacagtttatacataaaatggaatactattcagccttaaaaagaaatgaaattctgataaatgctacaacatagacaaaccttgaagacattatactacatgaaataagccagatatgaaaggacaaatattgtatgattctacttatatgaaatacctggaatagtcaaatccatagagatagaaagtagaatggtgcttattaggggatagggaggaatggggaattattgtgtaatgggcatggaatttcagtttaggataataaaaaagttgtagcaatggatagtggtgatggctggaaaactgaatttacttaatcccgttgcactgtactcttaaaaatagctaaaatggtaaatcgttttgtatgttttgccacaattaattttaaaagccacccacagtgattatgatacaattggttctcaactccactttgaaaaacactggatattaggtgtatcggggaaattcagccagatatcgggcgaaattcacccccaatattttacataggttttttttctattttccctaagtgtcggccggtctgagaaataaagagacagtacaaaagagagaaattttaaagctgggtgtctgggggagacatcacatgtcggcaggttccgtgatgccccctgagctgcaaaaccagcaagtttttattagcgattttcaaaaggggagggagtgtacgaatagggtgtgggtcacagagatcacatccttcacaaggtaataagatatcacaaggcaaatggaggcagggcgagatcacaggaccacaggaccggggcgaaattaaaattgctattgaagtttcgggcatgcattgtcattcataacatcttatcaggagacagggtttgagagcagacaactggtctgaccaaaatttattaggtgggaatttcctcgtcctaataagcctgggagcactacaggagactggggcttatttcatccctacagtagtgaccataaaagacggccgcacctgaagcggccatttcagaggcctaccctcagggatgcattctctttctcagggatgttccttgctgagaaaaagaattcagcgatatttctcccatttgcttttgaaagaagagaaatatggctctgttccacccggctcactggcagtcagagtttaaggttatctctcctgttccctgaactttgctgttatcctgttcttttttcaaggtgcccagatttcatattgtttaaacacacatgctgtacaaacaatttgtgcagttaacgcaatcatcacagggtcctgaggcaacactcatcctcctcagcttatgaagatgatgggattaagagattaaagtaaaacaggcataggaaatcacaagggtattgactggggaagtgataagtgtccatgaaatcttcacaatttatgttcagagattgaagtaaagacaggcgtaagaaattataaaagtgttaatttggggaactaataaatgtccatgaaatcttcacaatttatgttcttctgccatggcttcagccagtccctccgttcagggtccctgacttcccgcaacaggtgtaaaacttccaaaagaaataagagtaccaagaaaatgtaattattttagtacatgataggaaatatatagttgtgttgggaagatggaggaaactcagaaagcatgaccaatgaagtgtcagaactaaatccaaacataaatatgaatatgttgaaactttttttagaaagaaggagaaaagtggggctggcagaaaggaaaaattagactcaggtttatgcttattatgaaacatatatgtaaataaaaaagacacaggaagttgaaaataagataaaaaaatcaaatcagggagatggtaacaaaaattaagaatggatggcaatgctaatatcaaattattaatagaattcaagacaaaaggcattaagcaaaacaaagagggccacagtccactaggaagttgtaatagtcactacataacaaagccaaaactcttatatatgatgagaaacagacaaatccacaactataatgggaaactccatattcctctcttaaaaaataataaattggccgggtgcagtggctcacacctgtaatcccagcactttgggaggccaacgtgggcggatcacgaggtcaggtgatcgagaccatcctggctaacacggtgaaaccccgtctctagtaaaaatatcaaaaattagccaagcgtgatggcaggcgcttgtagtcccagctacttgggaggctgaggcaggagaatggcgtgaacctgggaggcggaacttgcagtgagctgagattgggccactgcattccagcctgggtgacagagcgagactccatctcaaaaaaataaaattaaataataataataaatccactaggctaaataaatatataaattacttgaataaaagttatctaccataatttaataattgtgtatacagatacatctcattttattgcacttcactttattgtgcttcacagataattgccttgtttacaaattgaaggtttgtagagatgttgagtcaagcaagtcttccagcaccatttttccgtggcatatgctcacttgtgtctctgtgagaatgtagttctcacattatttcagattttcattatcacatctgtgatggtgatctgtgatcactgatctttgaagttactattgtatttgtttcaggacaccatgaaccatgcccctataaaaagatgaacttaattggtagatgtgtgtgttctgactgctctgcttactggccattcccctgtctcattccctcccttgggcctccctcttccctgagacacagtatttaaattaggccaattagtaactctgcagtggcctttaagtggtcaagtgaaaggaagagttgcatgtctctcactttacatcgaaagctaaaaatgattaagcttagtgaggagggcatgttgaaagccaagatgggccaaaagctagcagttggccaagttgtgaatgcaaaggaaaagttcttgaaggaaattaaaagtgctactccagtgaacacatgaatgacaagagcaccaaacagccttattgctgatacgaagaaagttttagtggtctggatcaaagatcaaaccagccacagcattccattaaaccacagcctaatccagagcaagtctctaacacacttcagttctttgaaggcagagagacacaaggaagtagcagaagaaaagtttgaagctgcagggattggttcatgatgtttaaggaaagcagccacctccataacaaaaaagtgcaaggtgaagcagcaagtgttgatgtagaaaagctgcagcaagttatccagaagatctagctaagatcattgttgaaggtacctacattaaacaacagactttcaatgagaacaaaacaaccttatattggaagaagatgtcattgaggactgtagtcaataaagaggagagttaatacctggcttcaaaagataggctgactctcttgttagagactaatggagctggtgactttaagttaaagccagtgctcatttaccattccgaaaatcttagggcctttaaaagttatgctaactctactctgcctgtgctttgtaaaatggaacaacaaagcctggataacagcatatctctttacaggatggtttactgaatattttaatcccactgttgagacctactgctcagaaaaaaaaagatttctttccaaatattaactgcttactgacaatgcccctagtcacccaagtgttctgatggagatatacaaggagattaatgttgtttatgcagtaacacaacatccattctgtagcccatggatcaagttgtacttttgactttgaactcttattatttaagaaacacattttgtaaggctatagctgtcatatatagtgatttctctgatggatctggtcaaagtctgttaaaaaccttctggaaaggattcactattctagataccatttaagaacatttgtgattcatgagaagaggtcaaaatatcaaacaggagtttggaataagttgattccaaccctcatggatgactttgaggagttcgactttagtagaggaagtaattccagatgtggtggaaatagagaactagaattagaaacaaagcctgatgatgtgactaaattgttgcaatctcatgataaaactttaatgaggtcaggcacagtggctcatgcctgtaatcccaacattttgggaggccagggcgggtagatcacttgaggtcaggagtttgagaccagcctggccaacatggtcaaaccccatctctactaaaattactaaaattagccaggtgtggtggcgtgtgcctgtggtcccagctactcaggaggctgagaatcgtttgaacccgggaggtggaggctgcagttagccaagatggcagcatacccaggcaggatgtatacccagaaatgacctgagaagacttttagccttcaccccatgttgttcccaaggctcaagacacaccctgctaattagtgaaggtcttccttaccagtttgcaaagacttggggagttggctgtctttccaaatggtagttttcaagaaaagaccacaagacattagaaaaaaaaaaaaaaaaagaaaagaaaagaaagaaaatgaaaatacagctcattcagagtaacaaaataaatctctagaaactaactgtccctgaagcaaaacaggcattggagctactagacaaagactttacaacaagtgtcttaaatactccaagagtgaaagtaaaacacagagaaagaactagtgaggaaaaggatatatgagcaagatgagagtatcaacaaagagatagaaattaaaaaaagaaaaaaagagagagaaccaaacaaattctggacacgaaattcaattttggaattgaaaaattcactagaggagttcaacagcagaccaaaatagggagaaaaaatctgcaaacttgaagataggttatttaaaattatttaatctgaggagcaaaacaaaaaggggaagtgaacatataggacactatcaaatggacccaatatgtacgttatggaggcccagaagaaagggaaaaggacaaaagggtagattaagaaataatgaaaagctctccaaatttgagggaaaatatggatatacaaatacaagaagatcaaccaagtccagatagtataaacccagtgagatccacactgtggcacattataatcaaactgtccacaaagagagcatcttgaaagcagcaagagaaaagcaacatgtcatgtacaaggaatttccattaagattatcaagtggatttgtcagtagaaactttgcaatccagaaggcagtgggataatatatttaatgtattgggggaaaaaaaaacaaacaaactgtcaactgagaaacaaagaaaaagtgtttaccgagaattttatgttgggcaaaactgcccttcaaaaatgagggttaagatatttgcagacagacaaaagcttgagggagttcattaccactagaccagccctgtaaggaatcctatccctggtgcagtggctcacgcctgtaatcccagcactttgggaggccaagatgggtggatcatgaggtcaggagttcaagaccagtctggtcaagatggtgaaaccccgtctctactaaaaatacaaaaattagccaggcatggtggcaggcgcctataatcccagctacttgggaggctgaggcagagaattgcttgaacctgggagacggagcttgcagtgagccgagatgccgagattgtgccactacactccagcctgggagacagggtgagactccgtctcaaaaaaaaaaaaaaaaatcctaaagggagaacttcaagatgaaatgaaagtacactagacagtaactcaaagtcatacaaaaagataaagatctccagttaaggtaagtatcatggacaaatataaataccagtatcgtaattttggcttataactctgcttttttattttctacaggatttaaaagacacatgcataaaataattataaatctatgttgacaagtacattgatatcaatgtaaaatcaattgatttaaggttgttataactttaggatattatatgtaatccctgtggtaaccacaacaaaaatatctaaagtatatgtaaaaggaaatgagaaaggaataaaaatatgtcactaaaaaacatcaattaaacacaaaggaaggcagtaatggaggaatttaggggcaaaatagttataagacatatagaaaataaataaagtgggaaaaatgagttcttccctgttcttaattatttcaaatgtaaatggatcaaattccataattaaaagatgtagattggcagaacagatttaaaaaacagtgtccaaatatatgctatccataagagactcactttaggtccaagaatatacacaggttgaaaataaaagcatggaaaaagatatttcatgcaaatagtaaccaaaagagaacaggaatggttgtattaatgttagacaaaatagacttcaagtcgacaactgttagaagaaagacattatctgatggtaaaaagtggattcaccaagatttaacaattatatacataaattcaacaaacaatagagccccaaattgtatgaagcaaacattgacagaattgaagggagaaatagctctgcaataataatgggagacttcaacacctgactttcataataggtaaaacattcagacagaagatcaataagtaaggagaggatttgaacagcaatatagacaaattggacctaacagatatatagaattttccttccaacgacagcagaatacatacttttcttaagtacacaatgaacactctccaggataaatcatgtgttaggccacaaaacaagtttttaatacattttaaaagattgaaatcattcatttttttccagtcacagtacaatgaaactagaaatcaacagcggaagaaaaattgaaaaattcacaaatatgtagaagttaaacaacacacacttaacaaaagggttgaagaagaattcacaagggaagttagaaaatagcttgaaacaaatgaaaacacacaccacaacttacaggatgcagcaaaagtaatgctaagagggaaatttatagctgtaaatgcttacattaaaaaagaataaaggtctaaatcaacaattaactttccaccttaaggaactaggaaaaggaaaaacccccagagctagccagaggaaggaaataacaaatattagaacagagataagtaaaacaaagaatagaaaaacgacagaggcaatcaatgaaaccaagagttggttgtttgaaaagatcaagaaaatggtggataaatctttagctagattgactaagagaaagaagactcaaataattaacatcaaaaatgaaaggggacattgctactgattttacagaaataaaaaggagttcaagagagtactgtgaacatttgtataccaacaaattgaatagtctacgtgaaatggatgaattgctagaaatacacaacctaggaagaatgtcatgaagacatagaaacctgaatataactataactgtgtaaggagattgaatcagtaatcaaaaacctcccaataaagtaaagcccaggaccttaaggctttgctgattaattctaccaagcatttaaagaatttgcaccaatccagccaggcacggtggctcacacctgtaatcccagcattttaggaggtcaaggcaggcggatcacgagttcaggagttcaagaccatcctggccaacacactgaaaccccgtctctactaaaaatacaaaaattagctgggcgtggtggcgtgtgcctgtaatcccagctactcgggaggctgaggcaggagaatagcttaaacgagggagttggaggttgcagtgagccgagatcaagccattgcactccagcctggcaacagagtgagactccatcttaaaaaaaaaaaaaaaaaaagaatttgcaccaatccttctcaaatgcttccaaaaaactgaagaggaagaaacacattccaattaattctataaagccagcattaccccaataccaaaatcaaagactctacaagaaagaaaactacagaccaataatctttatgaatgttaatgcaaaaatactcagtaaaatgccagcaaactgaatttcagcagcatattgaaaggatgatacacagagtaggatttattcctggaattcaaaaacagttcaacatcccacaaaaatcagtgtaatatgccacattaacgaatgaaggaaaaaagacacataatcatttcattgatgcagaaaaagcatttgacaaaattcaacatctttttaaagatgacaaaaacaacacattaaaaataaaaggaaacaagccaggcacgttggctcgtgcctcttgaggtcaggagttcaaggcctgcctgaccaacatggtgaaaccacatctctacaaaaaaaaatataaaaattagccagcatggtggtacatgcctgtagttccagctgcttgcttgggtggccaaggcacgagaatcacttaagcctgggagacgaaggttgcagtttgctgagattgcaacactgtgctccagcctgggcaacagagtgactccgtctcaataaaaaaaaaaaaggaaactacttcaacatataaggtcatttatgaaaaacccagagctaacatcgtactcagtggtgtcatgattgaattgtttttcctgtaatatcagctacgaagaatggatacctgtttttgccagaaaaggacaaagattgtatgatttcatgttgtacctagagtcatcaaattcacaaagacagaaaagagaatggtagttgctagtagctgggggactggagaatggggagttattgtttaatgagtacagagtttcagtttggaaagtgcctgtagctatataggtgttatagttgcataacagtgtggatatacctaatgccacttaactgtacacttaaaaatgcttaaaatgattaaattttttgttttgtatattttgccacaataagaggaaatcaagagagaaaaatttgctatttagaaacaacaatgaggccggttgtggtggctcacgcctgtaatcccagcactttgggaggccgaggcaggcggatcatgagatcaggaggtcaagaccatcctagctaacacggtgaaaccctgtctctactaaaaatacaaaaaaatagctgggcgtggtggtgggcacctgtagtcccagctacttgggaggctgaggcaggagaatggtgtgaaccaggaggcggagcttgcagtgagcctagattgagccattgcactccagcctgggagacagagtgagactctgtctcaaaaaaaaaaaaaaacaatgaaattactgtggatcaatatttaaattctggtgctaatttcaatttttaaattcatttattaaaaaagaaaggccaaaagtaaaagaataatttagaaaactagaaaaggaacaaagtaaagaaaatagaattatacacattattacattattaagataaaaataagaacataatataaattgtaactaattcattgaaaagaataaaatagagacacttttgaaaagtctaatctgagggaaaaagtcaaatacatagaaacacttaagcagaaaggccatctaaccaataacaatgtttatttataatacttaatattttgtgtacaattttattcaagtacatttggaagaataaggacaaaggaataatggctgcacttattgagtgtttatggtaaggtaggaactgtcattcttggtgctttccatggattatctcatttaatactcagaatatccatatgtgataggcactattatacccattttacatatgagaaagctgaggcacagtgcacttaagtagcttgctcaaggtcatagccaataagtggcagggtcaggatctgaatccatgtggtcttactgcaaagcttacacttttaatcagcctctctccacagacagctgtcaaggaaattggtcaaaatgaaaaccacagaaaaatttcccccttttttttgatcttgttgtattttgtactttttcattaggtcatcgagacatattatttatcccagtattcttccaagcacagtgtactgtgctttggtattcactgaaagttagttcacaataaaactgaataaatggcattccttttcctctccctgtccttccactgactctgacagccggaactgagaacagaaataaagctaatgacctacctatcgtataacagttcctcaacacttgtctccacttggtgaaaactcatcacttacaaatccttgctttatggatcaagaaatgatgaagtataggcgcacagtaacaagtgtctaaaatttttgtctgtaaagattaaaggatgtgcatcctaatggaatctctcccattcaccaaacaactggcttaagcatacatccaaaggacattttcttagatccatttctggttttctttagaacccaaacacattgtaggagagaaagggatgctgagcccctctcctctgctcctgggttgcagaatggaagtgagaatgcagtaccttacccctggtggtgctgtgtcacaggagcctccatttcctgctggagatgtgagatttgcaggatccaagatgtcctcgagtaaaagtccattgtgaggagggacaggtaaaggaggcagagagaacatcaaatgtaacatatgggtgaccttataagttcaaagataaatttcccccaaattgtgacattttcaagcatataggcagtatggccttgccccggttcccctcagcaactgtaacaggcattgggtgctcatacagagcatcctataaagcctccatatgagagaagctgtggggaatagacctatagttaaaccactgtgatgaatcagtttagaattttaattagcactatggtctgtatggaaacaccttggatgccagtaaactgagtgattcagtcagatccacctcatctacggatgagaactgtagaccagcacttcatagactttacagttgattaattactttttgctaagttgtggttttttttactttttaacagttttaataaagtataattgacatgcaataaactgtacatacttcaagtatacaattgataagttttgacttatgtacatgtaaaaccatcaccacaattaacataataaacatacccatcatcccagaattttccttctgcccctttgtgacccacctctcccattcttccccatccccttatccccaagcaaccactagtctgctttctggcactatggattagttggcattttggggatttttatataaatgaaatctttggggaacaatctgtaagcttaaagctgctataaaagaaaaacctgaatttaggaaatgtttttagacagtggaaagtgatgtttataacaaaaatgaagttgatacttgtaggttttctgtaatattttttctccttaataagctttttatatgagtttgaatttttgaattattactaaatagagcatatttaaacataaaatgtttatttttaaattaattaaaaatttaatgattttccatttttatgtccccaagttacctcttcaacccaaagttgcttcacttgatttttgtttgtatttttaatccttttacagagcatataggattggacaatgtagagatgtcaaagtgcttaggctgatatccttgggaactgtggaggaaatcatgtatttacgacagatatacaagcaggtaaatatgtttccctttttctgtttcagaggtcaacatttatctgttttcaaaaattaggaacaaatttgtgtaaaatgtaagttttaaatcttactgtattgcggaatttaataagattataaaaattacccttgaatacacttttatgaaacagattctttggttcattgaatttttgagctgaaagttttctagagcagtacctcttaaactttagtgtacatgcgaattaccaagggatcttgtcaaaatactgattgtgatttagtaggtctgagttagagcccatgatgtggaatttttaactagctcccaggagtcctagtaaaactaatcagcccacattttgagtagcaaggtcacagctccccaaattacaggccaagatgtaatggtttaccacaaatgggctacaggtgcactgatatgttggtcccacagctttctggacagcaagagtacctaagccagtgtgttagttcattctcatgctgccataaagaactgcccaagactgggtaatttataaaggaaagaggtttaattgactcacagtttcacatggcgggggaggcctcaggaaacttaccatcatggtggaaggggaagcaagcatgcccttcttcacaggatggcaggaaggagaagtgctaagcaaagagggaaaaaccacttataaaaccatcagatctcttgagaactcaatatcctgagaacagcagcatgggtataactgcccccatgattcagttacccactggatccctgccacagcatgtggggattatgggaactgtaattcaagataaaattcgggtagggacacagtgaaaccatatcagctagctgccagcctttgagtaacctcttctttttacaccaggtagatattcatatgttaccattttctacatgtgccatcacatgaagattagggagcactaccttagaggtgcatgatgtacatgatgaaactgggaccccagagatcccccagtaaatgaaattataggaatagagcttaagtgtgctaactactttcctggtacttttagtattcgtccgaaattgcattaactctttaatatgcttgagatatcaattactacttcatttatgcctctaaacaaacaatatttatttagtttacaactggatacttgagacaatctggaataaggttcacgtgtaatcataaatattacatttgaattgcttcctatatgttcagttggcatctatttaagagcaaacatctgccacatgtgttggtagttaacctaagaatgatccaatcttaaatttatgctattttcttcattctaaaaatagaattgtacacagcagtttttgttttgtcttaaagcttttagctctgtaataaacagttcatttttttttttttttttggtatagcacaactacttgaaaattatttttttctaacctatttaaccaaccttgggaaaaagtgggaagttactcatcttaggagctgttcttttgagtactgtcttagactactctcaagtaagagtctttcctcaattatgtagtaatttttttcagtccattactatatacatttcctttttacctattcatgcgactcatttaatgaaatgtcttgttataaaatatacattgtgcagtagtatatgataaaacacgcttcagaagatgaggtaatttaagaactttatatgacacaaataaagataagatggcaatcatggaaggaaaaggcactaaatatggtttaaagatagtttggaattttaaccaatggagcacaccttctagcctcccaggttggctttcaatcttttggggaaaaaaaatccaaaaattatgtttttgtttttttttttaaattatactttaagttttgggatacatgtgcacaatgtgcaggttagttacatatgtatacatgtgccatgttggtgtgctgcacccattaactcatcatttaacattaggtatatctcctaatgctatccctcccccctccccccaccccacaacagtccccagagtgtggtgttccccttcctgtgtccatgtgttctcaatgttcaattcccacctatgagtgagaacatgcagtgtttggttttttgttcttgcgatagtttactgtgatgatttccaatgtcatccatgtccctacaaaggacatgaactcatcattttttatggctgcatagtattccatggtgtatatgtgccacattttcttaacccggtctatcattgttggacatttgggttggttccaagtctttgctattgtgaatagtgtgcatgtgtctttatagcagcatgattcatagtcctttgggtatatacccagtaatgggatggctgggtcaaatggtatttctagttctaggtccctgaggaattgccacactgacttccacaatggttgaactagtttacagtcccaccaacagtgtaaaagtgttcctgtttttccacatcctctccagcacctgttgtttcctgactttttaatgattgccattctaactggtgtgagatggtatctcattgtggttttgatttgcatttctctgatggccagtgatggtgagcattttttcatgagtttttcgctgcaaaaatctccttaagctgataagcaacttcagcaaagtctcaggatacaaaatcaatgtacaaaaatcacaagcattctcatacaccaataacagacaaacagagagccaaatcatgagtgaactcccattcacaattgcttcaaagagaataaaatacctaggaatcctacttacaagggacgtgaaggacctcttcaaggagaactgcaaaccactgctcaatgaaataaaagagggtaccaagaaatggaagaacattccatgctcacggataggaagaatcaatatcgtgaaaatggccatactgcccaaggtaatttatagattcaatgccatccccatcaagctaccaatgactttcttcacagaattggaaaaaactactttaaagttcatatggaaccaaaaaagagcctgcatcgccaagtctcaatcctaagtcaaaagaacaaagctggaggcatcatgctacctgacttcaaactatactacaaggctacagtaaccaaaacagcatggtactggtaccaaaacagagatgtagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaatgctgaaactggatcccttccttacaccttatacaaaaattaattcaagatggattaaagacttaaacgttagacctaaaaccataaaaaccctagaagaaaacctaggcaataccattcaggacataggcatgggcaaggacttcatgtctaaaacaccaaaagcaatggcaacaaaagccaaaattgacagatgggatctaattaaactaaagagcttctgcacagcaaaagaaactaccatcagagtgaacaggcagcctacaaaatgggagaaaattttcacaacctactcatctgacaaagggctaatatccagaatctacaatgaactcaaacaaatttacaagaaaaaaacaaccccatcaaaaagtgggcaaaggacatgaacagacacttctcaaaaaaaaattatgttcttaaaaaaaaaataaacctgtaaaaatgttagaaagcaagaagagttttcttggtggccccaaaattgtaaggagtcctaaaagacaaaaggaagttgggatcagattgaaggaagaagccaagttaaactcagaagacgactactgaaaaggtaggtgcagcctctggatattccaagtttagagtcagcagatactaaaaaagaagggagccttagggtaactgtggagccctcttcagggtatcactgatggtgtaacaagacggtttagcccttataatcctatcccatttggaccaaattacagccagcagaggtgtctactgtcaagtgagaacaataagtagaagtactggaaacaaagaagcaagacagagctccaaatttttctaatattcagaagaaagtccctcctgttgcccagaagactaattacttgcaccctccactttatttcagataagcactgcagtagacagagataagcatgtgaagtatttaaaggcagatgaatagcccagccaaaaataattacccaacagtttaggaaaataaacactttgaaaaaggcactatagcgggctgaatactggccccgaaaaatatcaatttctaatccctggaaattgtaaatggtactttatatggaaaaaggatctttgcagatgtgattaaattatgggtcttgagattcggggattatcttggattatccacaagtgtccttataagaaagagctagaggacaatttgacacagacagaagaggagaagacaatgtaaccacagaggcattgattggagtggtgtgccagaagctaaggaatggtggcagccaccgcaagctggaagagtcaagaagtagattctttgctagagcctccagaaggagtgtggtcgtggtcctgccaacaccttgatttcagtttagtgatactgatttcagatttctggctcccagaactgtgagaggctcaaatgatcctcccacctcagcatcccaagtagctggaactataggtgcgtgctaccacaccaagccaattttttatttttatttttgtagagatagagtttcactctgttgcccaggctggttgaaactgtgttgttaattcagaactctcccacaaagatagattctagcccggatgacttcagtggtaaattctatcaaacacttaatattgtttttgaaaacagaagaagagggaacacttccaacttacttcacaaaaacagtagaatcctgataccaaacttgacaaagacattgcaagaagagaaaatgacagatgaatatctctcatgaacataaatatgaaaatctttaaccaagcatctgttttgagtccattgcaccccttcccctcaaaagataggttgaagtcctaacccttggtacctgtgaatgtgatcttatttgtaagtagggtctttgcagatgaggttaagatgcgatcacactggatgagagtggtccctaatccattgactgataccttataagaagggggaaatttggatacagacagccacagaggaagagcaccatgtgacaatggaggcagagattggagtgatgccaccacaagccaaagaatgctacggattaccagcaactaccagaagctagaaagaggcaaggaaggatcattccctaaaatcttcagacagagcatggccctatggacaccttgatttcagatttagctgcacaactatgagaaaataaatttctattgttgtaagacatccaatttgtagtactttgttacagcagaattgggaaactagtgcagcccctaaggcaaatacagagtattgtaaatttgactatatttttgtatgaaacttctgtatgacaaaggaactgcaaaccaaattcaaagacagactaggagcatatgtttgccatatatgtaataaaagagcagcatgtacaaaatataaagaactcccactgtattagtctgttttcatgctgctggtaaagacataccagagactgggttataaagaagaggtttaatggacttacagttctgcatggctggggaggcctcacaatcatggcagaaggcaaaaggcacatcttgcatggaggcaggcaaagagaatgagaatcaaacgaaaggggtttccccttataaaaccatcagatctcgtgagacttattcactaccacgagaacagtagggggtgaaccgcccacatgattcagttatctcccactggatccctcccacaacacatgggaattatgggagctgcaattcaagatgagatttgggtgggaacacagccaaaccgtatcacctacaaaccaatgaaaagaataataggcatttcactgaattaaaaatgcaagtggttaacacatgtgaaaaaatctttttaaccacactcataatctagagatagaaaataaaataagaccatttgcattgtatattctgcaaaagcttttttaaaaaatgcatattgaggtgttttgggggggttggggagattggtgctgttcattgttggttggggcatttgagagatgctcatatactactgttgagagtacaactggtataggtatatgtagagtctccatagctaactgacagaaatcctctcacatacgcacagtgaaggatgacaagggcttttacttagcattgcttgcatttgtttaaaaaacaaaggaaacaacctaaatgtctgacagtaacagaataaattctgatacctatattactttgtgacagcaaaatttaaaaaattatagtcagatcaaatgtactgatgtggcaagatgtctgaagacatttttaagtgagttgaaaaagcaatatacagaacaatatctacagtgtttcagtgtgtttagaaataaagctatttctgtgtgacagactgtccctgatttatgacatggttcaacttaatgtttttcagttttatgatggtgctaaaatgatacctatttatgtatgaagtatgttcctctacttacgatggggccacatccagataagcctatcgtaagtccaaaactcactttagacctaatggtgttttcaacttacaatgggtttatctagatatagccccatcataaattaaggagcatgtgtatgtataaatagctttaacttcattgaaagatacctagaaggatgcacctaaacgttacagcactggttagactaataaggagtgacctgtattgttcatgaggggcttttattttgataccttttgttgcatctgttgtgatgatgcattcagatattttatacattttaaaaatataaacatcacttttacagcagctgtgctccttcaggtttggagcatttaaacaatctaaagtttggcattcagaaagtcatctcgtctgtgtgtgtgtgtgtgtgtgtgtgtgtgtgtgtaaattttatttgtaagtgtttgcagaagaattgcaagaacagcagaaagaacccccagttagcttcactcaaatcactcaaattccctatttgctgacattttacacacttgctttctctttgtctcagccattatctttattctttttctgagccatttgagagagttagacttctcatcagtatgtatttccccaaagaagcaacactctcctaccaacactctaaattttccagtatgtatttccccaaaagaagtacactcctacttaaatatacataaaaaccagttttatgcattctaaacactcagttgtatatacggttctacaactcgctttccccaccctccacactcctctccaaaatgcagttattcacatgaagaaattaactttgataaaacatgatgctgtaatccataggacccattcagtttccccacctctctctttttcctttctggtccagggtttcatcaaggttcatggctccatttacttgtgtctcttcagttttcttcagcctggaatattatccaggctttgtctttcaagaccttgacagctttaaagaataaggcctttgtgtaggatgtccttcagtctaggtccatttgatgtttcctcatgtccagactcaggccaagcagtattggcaggaataccacagacatgatactgtgctcttctcgttgcatcagtcagaaggcacatgggggtgacctgccctactactgctcacgttaaccttgatcgcaggtcaagtttgtgtctgctaagtttctccactgcaaagttactatttttttctttgtaattgatatgtagtttatggggagatcctctgagactgccagttcctcatcagacctgcacgcataacccttagtgttcattcgtgattcctgcctgagtcagctaccactataatggttgtcaggtggtgatttttctatttccattatccttcttggttgttgtttggcactctaccatttaaaaaagagctttcccttctatttatttaatttgtgtggtctcatggcttcctattttagtaatagattacaacacattgaatatcactatttatttgatgttcacattgtcttatatttggccaatgggaacccattagggtggcttctgtgtcatttcgacttgctcccatcattctttttgcacttctttactgtggtaggctgaataatagtctcccaaagatgttcacattgtaatcccccaaaccacctgggttatccagatgggccaatgtaatcacaagggattttttataagggtcagatgtgcacatcttcatctctgctagctctgaccctactgcctaataacccgtggtaaggaagcaaagggtcagagagaaaaataatgaagatgccacactgctggccttgaagatggaagaacggccatgaacttcttaacatcataaatgttcttttctttttacttctttctttattttgtctattgttatgatgagatccaagcattttctcccttgtatgggtttttcataagctacgaactaagctacattttttagttactattttccccctaacttcttgaatttgaacatgatttcatttttagttagcctacagatggaagcacctggtttccacttttactggagccactttagtacaaaataatgtgctttttataaattttgtaataaaactttgctaggaagcttataaagactcaaattaaggcttacaaattaccttggtgattatagttacaggtcctgcagtctgacaatatcagtgtttaaggtagtttcagtaacaagggtaaaataggtaggtacccgggctatcacttgtatcaattgttattgtaattctgtactcccaggattacagcccatgttcattggtatcaaattgatcaagttggtatgttgatccataacttctttaaatgaaggtcccgagggttttttttaagagaggcatcttgaaagtgagaaattagttaatagtataaattttagattcagccaaaccaaggttcaaattctaggaatgacacttcttagctggcagctgtgagcaagtcacttaatttctctaaacttgagttactttatttttaaaatacagaaattttagttattttatttctaaaattgagatgatataaggttgtaaggattaaatgagagtatggaaataaaatgctatacatgtaataaatgttcagtaaatggcagctgttattaacaagaattttaattgcctagagtaacttattacagtgcaaatgaactctgatgataatctcaatagttaagcatttctctttttttgttttttgtgacggagtctttgtcacccaggctggagtgcagtggcgccacctcgggttgcttgcagattccactaggttcaagcaattctcctgcctcagcctcccgagtagctgggattacaggcacccaccaccatgcccagctaatttttgtattttagtagagaaggggtttcaccacgtcgaccaggttgggctctgactcctcaaatcaagtgttcctcctgcctccacctccacctcccaaagtgctgggattacaggcatgagccattgcacccggcccttaagcatcattttttactgatttctccgtcagtgggctgaagttattttccattctgtgcattctttgtttctttcaaggaattttaaagtacacatggggttaatcagattgtattttaattttacatatttatattacatttagtaaaatatccagcaaatagtgcatattaatgttgatactgaaatggtgtttttaaatgttccatgtcagtgttctttctgtattcaaaattatgtcaaagatgcagtgtttcttaaaacagtgatagggtttttgctgttagtaggcaatgtagtcaagccacaattagtttgacaccaaggtggttatcatatcattactttagattgtaatttaacttcagtgatgtagtaattacttctgccagttttagtagttgctattgtaataagagttttaaaaggagaaaagtatattcaaatgtatgcttttattattaaacatttatgtcaggtggatattctatagagatgtaatcttgactcagttgttagaaaacagataaaataggaaatataagatctctgtttcaataagactggccagattattattatttcaccataatggcaacatctgccagggaaattaaaacaaaatttcctccctaaggagattctgcctgctccagctaaagctgtgtatatacagggaatgccaggaaattctgacatattgttggagcaaacacttcaaaaatgtcttgtgttttttctgttttagcaacttcactgtgtggtggttggaagtgaaaatgccaaacgatattttgaagcagttcaaggatctaaagagcatcaaggagagctttttgggatccataacctcttcaaatttaggtcccaagggtcttgtcttacgaaggacatcctggaggtgtgaacttcttctctgaccttttcaataatattttaaatacagtttttcttcctcaggaaatctgaaatacaattgctgttgccttttcagagaaacttttggttttctttatcaaaaatgccttggaatttttacttttagagaataagaaatgaattattgtacctctaaactaagattttcccatgcataattacaaataatgcacacacacaaatgtatatgctgggtagtatgaactccaaggcaattttaaataggcagagagaagtttatagttttgaaaacagctgctgaagtcaggaactaaaaaaagaggttttcctaaataaacaaaaatataaaatgtgttttaattaaaagttaccaaatactccctgagatgtactctcatgtctcatggagatttttgttttctgttcccaataaaaattccacaccagtattttaaactctccctgttgtgttcatcctcagcatacagatgtttcttattcctcaaacaaaatattttatatccttttttaaaaaaatctttaagttcttttatataccggaatactaaggatattaacctattttctaattgatattcatataggtatcataaaatcctggagtatcatctttttcaacctcctcatggtatagatgaggaaactgagtcttagagaacttcaggatatttctcttgacttccaggactttgtagtaaaatcttaatgtacttcatttattcagtaagtaccataaaggcagttcaaggagcaattggttcctgtccttgaggaacttaaaccatcttgaccggaggtggaagagaacgtttacataataaccatgcaatgtcaggaatcgtatgctgaacaagttaaacagtagaccatggatggctgggggagaggaaggtatatattatttgaatcctataaatgttgttactattatacagtttctgatatatactgctgagtttctattttatagtaactatatttgattctgaattcagtggcccatttggagtcctactttttggggttttttccccttgctttttaaatacgctgtttctttcatgaatttgttctttccagtttcccttttcatatcaataactttgtttgccctccagctcccaaacccagctgctacctccatctcagagtactacttgacatgcctatattgatgttaaagtcaattgtctataaaaatattagcattttattatttatcctgttttctgtcatatatgacatagttacctgtttttatcagaataaccacctatttctttgttaaacaagtgttatataagacatatcaggatgacaggttattaagtagaaaaagttcccttgtttatcgtgccactgcactccagcctggggaacaaagcaagagacttgtctcaaaaacaaaaaacaaaaacaaaaaaaagttctcttgttcactggttattctaagaatatcttgtttcaccttcagaagtgtttattaatgacaggaccatccatgtcttacattttcttttttaaaaatatcttttaagttctttaatataccagaacactaagaatattaacctattttctaattgatattaataaggggtgacaaggccatccatgccctacatttgtcttgctaggcatatcattggcacttgattattaagttaaattttgaattaaaattactcatttgtcatcaatcagaatgtaaatttattcaggattggttagattcatgctgctttgggccaaaaggtgcttctaaatattattattagccccatataatgggagtacctatcataaagtaaaaggagtatttcacttcatgtgagacatttttaatttttaaaggttgtataaaatctcttttaaaatgttttaagatgtaaaaatttgaatatttacacttataatcttatgatttctgggcaatttcattctgttttgcattgactttccattatctatattatggtttctcttcaaagatagatattgagagttcattttacaagtatttgttgagcatctgctaaatgtcaggtactgttcatagagctttgcatacataaaagaacaaaataaacaaaacgatcctgtcta

SEQ ID NO: 1389 - DNA, 1586 bp, Homo sapiens
gtgatctctcagcagaatagatttattatttgtattgcttgcagaataaagcctatccttgaaagctctgaatcatgggcagtgagctcagtggtatctggaggacagggcactggccactgcagtcaccatcttctgccaggaagcctgcacctcaggggtgaattctttgccgaaatggattgccaaaacggtcaccagcacatttcccaggagctgttgagatgaaaggagacaataaagatgaacccatagtgagctgagagctccagcctggcctccagataactacacaccaagcttccacccagaatcaagcctatgttaacttccctcaaagcctgagattttgccttcccattaaatgcaggtagttgttccccttcaagcactagtcactggccataatttaaatcttgctatcttcttgccaccatgaaccctgtatgttgtaggctgaagacgttaaaagaaacacacgctgacacacacacacacacgcgcgcgcgcacacacacacacacacacagagctgactttcaaaatctactccagcccaaatgtttcaattgttcctcacccctggacatactttgcccccatctggaattaaaggatataagtttgtaatgaagcattagcagcattttatatgtgtccagctgatataggaatagccttagcaatgtatgtttggccaccaaagttccccactttgactgagccaatatatgccttctgcctgcatctttttaacgaccatacttgtcctgcctccagatagatgttttaaaacaacaaaaatgagggaaagatgaaagttctttctactggaatctaataaagaaaagtcattttcctcatttccacctctcttttctcaaagtcaaaattgtccatctagatttttagaggcactccttaggccctaaaacattaccactgggtctcagcccagttagtcctctgcagtttcttcacccccaaccccagtatcttcaaacagctcacaccctgctgtgctcagatcaatactccgttgtctaagttgcctcgagactaaaggcaacagggctgaaacatctcctggactcaccttgaagttctcaggatccacatgcagcttgtcacagtgcagttcactcagctgggcaaaggtgcccttgagatcatccaggtgctttgtggcatctcccaaggaagtcagcaccttcttgccatgtgccttgactttggggttgcccatgatggcagaggcagaggacaggttgccaaagctgtcaaagaacctctgggtccatgggtagacaaccaggagcctgtgagattgacaagaacagtttgacagtcagaaggtgccacaaatcctgagaagcgacctggacttttgccaggcacagggtccttccttccctcccttgtcctggtcaccagagcctaccttcccagggtttctcctccagcatcttccacattcaccttgccccacaggcttgtgatagtagccttgtcctcctctgtgaaatgacccatggcgtctggactaggagcttattgataacctcagacgttccagaagcgagtgt

SEQ ID NO: 1390 - DNA, 79999 bp, Homo sapiens
aaacgcccggcccgctaccctgcgcccagctccagccgccgggtcccgcctgggcctctcctcctgggaataccgggcaccggtggccccgcccctacctgcgcgccgcatctccgggaacaacagtctccctcccgagcatcacagccagacatggcccagaccagggacccgcgcggcctccaatctccgcacggctttgcgcgcggcgcttagcctgggatacggcagcgaggccgcaaatgcaatcaggcggcgctgagggcagcccgggggcggggcgaacggggcgggggccggggtctggtaaggccccgccggctgagatatccagcggcgcacctgacttcccgggaggcaaggccaacgtggttggaggcggggctgggttggggggcgggggttcaagtctgagagacctaaaggcaccgctagcgtctgggggcgtggccaaccatgcgggaggcggggccttgatgctggacatcaggctgtgctgcgggcagccagtgagaaggccgtcaagatggcggcctcctggaggctgggctgtgatccgcggctgctgcgttatcttgtgggcttccccggccgccgaagcgtagggctggtgaagggggctcttgggtggtctgtaagccgcggagctaattggagatggtttcacagcacgcagtggcttcggggtgagtggccggggctcgctcagcttctctgtgtagctgagtgatgggcctgggacaggggcagttatgattgagggcctgcttttgggtgtgaaggtgcgcgggctccttattccctttcctctttctccggttggggtccgccgacttggcctaatgcatgctgtgaagggctttcttggcagctgagagaactcgactctgccctaggccccctggtttgtatggctttgtgaccttgccttggaatttgggttatttgtgaggcgcagagagggttcccaaactctcctccctcagccccctttccaatcaaggctcaggtttctttagggttgtcaaacgtctcggacgagaaaaagctgcccaaggttgccgagattgaaaagccactgttgggagttcttacttattctctaggcctctctctgttaggaggtgttttcattgaggccagtcgagttttaccccacgccatgactcgtggaagacttaaatttgtaaattcctacggcatcacgatagacaaaggtccaggagaatgtttcaagcaaatattcgcttgaaagagcaaacatttaggagataaatcataccaaaaatttattatagaaaattgttgtttagtaatgatattgatgcagttaacacaattcttgcagtatttaacagtatgcaaaatggcaggccgggtattatttttccttattttgggagaaggttggagggaggcggggatggagaataggactgacgttttttagtgtgacgtattacctgccaatcatcgttcctggcactctacagaatgaattttaatttaaataggtctagtagacgttgccttcatattctgagctaccttaggctcagaaaaaaaaaatcacacaaagtcatatggtaagatgagtgtattggggttcctaaaggttccttaatgggaacaatttatttcatttttggtgtaatgtttcataacatattccttggagcagaggtgctttaacagtgtgtgcagaattccttctcttccctcctccaagtttgttgaaattaaacttttttccagctcctagagattcggtctggtctggtgtggggctcaggaatctgcattttacaaatgttggatgagttttgatgttttattttgacatttaatggaatgagctttgagactcactgccttagaaaatcatggaatattaaaagtttagtattggatataatctaggaagagtgctcttaatcttgtttatcaagcagatccttttgagaatctttgaaaatgttacagactctctgtacagaggaagtaccataaatggtcacacacaaaaatgtgcacgtagtggctcacgcctgtaatcccagcactttgggaggcgaagctggaagattgctagagcccaggagttggagaccagcccgggcaacaaagtgagacccccgtctctacttaaaaaaaaaaaaagaaagaaaaaaagccaggcgtgctggcatcccagctactccaggggctgaggcaggaggatccgttgaacccaggagttagacgtttcattgagctatgatcctgccgctgcactttagcctgggtgacagagtgagaccctgtctcaggagaaaaaaaaaaaaaagtatacataggcccagtttaatgcctttagaaactcagttaggcaagcaatccttatctgcatcctcatgatgcttttttacctattccctatcccctagacatataccatgaacaacttgtctaccccagtttgaataccatctgtcaggaagaaggcatggcatctcaaggaaagccaaattagttttctagtgctgctgcaacaaattaccagaaattagtggcttaaaacaacacaaattcacatctcatagttctagaggtccgaagtccaaaatggatctaactaggctaaaatcaagctattggtaggagctgcattcttttctggaggctcgagaccccattcccttaagttttccagattctagaggtttctaagattctttgactcatgggcttcaaagtcagcaatggctggttcagtctttatcacattacgtcactcttaatactcccctctgccttctgccacttacaaggacccttgtgattacattgggctcatctggatgatcctgaatattttccccatctcaaggttgagtagaaaccttaattccatctttaaccttaattccctcttgccatgtaacagcatattcataggttctgggtattaggacgtgaaccttttgaggcatggcattctgcatgtgaagctgtggaaagtatttggaaatactaagtatttggaagtgttggacttttttcctaataccgagccaaaatatatccgcttctgactttcacctacatacagatttttgttttgccatgccgaaaacacgtggcaatccttgaactatttgttttacaaactgtgaatttacggtggtgttttttctctgagcttggtagaaactgtagttttataaaactaaacaactatttggattactgtaaactatataaattaagtacatttattgaactgtttcgtctttcacacaaatatctttaaaaatttgtcagtcggaactacctttggagttttaatttccttaagaggtgctggcagcatttttatgagctatgacatatgccattttcttagcactttctagaatttctcattcacttctcacataacctagtaaagttggcatcatctgcatttagttggacaaaaacaccaaggcttagagaaattgagtctcctaaagacatgtaactgtgttgatgaactgaagtgcatgtatatatttatatacatatattaatttgtttaacaaatctttaatttgtatcattctctcaacagatttattgagaatgcagagactatcttttttaccacttacattattgaagaatgagtgaagaaattagcatctattaggtgccaggcacatggtaccctgcttgggaagtagtggccagctgaatcaaacagattctcagtatttgccacatggcacatttaatcatacttagctcctggacatgcaatccaaaattctatatagggctgatccttaaggtatttgtagtctctttggggacataaacaataaaggtatgatttcaatagtgtatacagtaagctcagagggggtaagtttgaaatgatcaggaaataatatataaggcagcttcttagaggaagaggtgacagcccttacaggctgaaggaacagcagaaacaaagacccagagaccagagtgatcattatataattgacacagcatctgtaaacagtttttcaacctactctagacagttaacttcagagagtttaaattgtggtcctttcagagtaggtagcatgatttggaatataattggtaagatgttaattaatagtattggttttaagttgtctctgaagaataacatgttgaatttaaaataacctgtgaatagaaaagtaactgaggttcaatcttggtggcgatttgcctagtatataattataggcaatacatattatagatgttcaataaacatatctaaggaagctagtaatctaggaagttataaaagaacactagagcctacagtaggattccaagttggcagccagggaactgacccacattgttttagcagaaaaacttatggcaaaattttaaaatcaggagactttacagagaaatctagatttttgttctctctttaaaattgatagttaaatcctatgtggtgacaattatctaacactgagtaatgattgttctttttaggtaggaaattgcttcctactttgtcactatgccgcctactctgtattacatcttagcaaggctgaatgtcccttggtatttgcatcacctctagttgtcatttttttttcttgtactcttatctctacggaaggcagaagacaaaagaccaagaaaaatgggagaaagcagatattgtgtatatgtgtaaaggaggaaaatgcttatccatttaatatgaaaataaaggatgtcagaatctaaagaaaaaacctgaagatgctagtcctcttctctcacctgcctgttttttgtaggcatctgagtttttgacagcagtgctataaccaggagagagggaacttctttgatagagttaatggtatggtatttctgccaaaacacggatactcttttaggcctggttcttattaagtgcttatacactgataagattgatattctcctttgaattctcatttaactgtggaaacagaaacatgtagaatagctctagtaaaagtaggatttattaaaaggatagaacatcacttataaaatgctgcagggccatggggaaaccataattattccatctatttcttctagggctcatattatttgtcttctttctcttatttactttgttttcctgtacagacttgcaattatcaatctgtttactcctggcttttctttctcagtgtcagcttgccttgcctcagtggtgattcaggcctttatgcacgatgcgctgtcagttttgtttaagtgctcaccatcatttctgtaatctcctttcaaattccttgaatagagaaactgacccaaagtagaccagttgtgctacagggcatgcaaggctgattctttcgaaggctacgatttggacattttctttaagaaagtagttgagaatcaatgattgacatttctgttgctatgaccatctgactaaaataggccagtaatgcagtattttattttattttatttattttaattgtttctgcgctaagtaatgaccaagcaaagtgtatcatctaagcaaagcacttgtaggctactcagctgagatgtttgcccatccaaagaaaataggacaggggtaaatgagatcttactacaggcagcaacaggagggactaagaagatttagatgatcaggaaatactttgtatatgtttaccttgttttaaaggattttattctgtctatgaaagcagggtattagaagtagccatcacatactgagctctcactatatttgcattacttctaaccatcataaaaaccctgcaaaggtttgccaggtttcacgggagaagaaatagactcagagaggttttagcattttacccaaggttagtggataagtggatgaccactttggaactgtgcacgtgatgacatccagaggaagaagagaggacctttcttcttggatgtcttttttgcagaacaagaaacatcttctgttaccacagcagaattttcttatattgtattgaccagaattgggtcgtatgccctttcttaagttaggcactggcttgacttcactgtgtgaaaaatgtatagactttggctaatcaaggggatgggtgtggaatcactaactctgagtacatatgcacaagaaaagtatattgctgaacaaagttgagctaccagcaagaaagaaatttggggataggtttgggaataataagtagcatttgttgagagcttactatatactatgcacccttgtaagcactttacatgaatcagctcatttaatactcacaactaatactatactctggtagatagttcaggtttcaacccagatctgacaccaatgcctgtttccttaaccatagtctacctcagtatcaagtgatagcttgattatagatttcagcagaacagtgtcagcatgctgacgttttaaagttcaccgtgtgtacatcctaaatgaacatttttgctttttttaaaaaaatgaaatcagacatagtaataaccgcattgtagactagcatttctgtgacagcctatcattttagaacaattaaggacaccaaaattcttgactacgtgtaagggtggcaggactatttaagagagttagagtatatattgacttctcctatctgtaaatttctaaggtgatgtactcttaaatataccttcttgttgttgtcttgagcttaatttgccttttacgacaaaatgtgtaaattcccaaagtatcgttgtgtgtgtgtgtgtgtgtgtgtgtgtgtgtgtgtatgtattcttttgctaggctgtaaatggaatggtaatttcttttggctcttctcccaagatggcaaagtaaagtgaacttcatgtagaattttaattttatagtttaataccaagaaggacagtattccaagctgaaatctcttctaaaatgtttggtttatttcattcaaaggaaatgcattctacaccatatgctatctaaaaattctggctaacctcttttctaatgtgccattggatactaagtagaagtataataatatagaatcagcagattctatgaacaagatggggtatatgggtgattcatttttttggtaggcagtacatttactatagctagtgatctgcttgatatctttctgttactgtataaatcaaggactttattatatgaaacattcctagggaaaaattaggatcagcaaatgtataattcaggagagatttcttgggaatatattagccctggtttttggaggggaacaaatctgttaaactataaaagctataccactaacttcttcaggaaagtgcatacatacacaattttatatataattctgagtccagaggactcagatctccctgtaatttgtctgtaaataccacctagtctagagactatttccataaacattttggtcatttcctagcttttttttggataatagccatcctaatagatattaagtaatactagtacagatttttttgttgttgttttccagtgttccatcaggtagaatctcagctctcataattctttgatggtctaatggcatttttatctactactgtctagtacttgtgtatttatcttctcatctaaattttaatccttttgaggtcgagaatctggtttggtctagggctaggataacaagtgttcagtaggcatttgttgaatgcctgatttggcttttagctttggaagtgaatagtatgagcactgaaggtaaaacatttgccagtgattttaatgagaggttggttttcaagtatgaaatgtagttagaatagagatcaagaattagtgtactttagtcatgagaacactgctgaataaggtaaaggagagagtaaaaagggaaccttcaagtttaggctgggaaggtgaaaggaacctgtgaatgcatctctcattactccaagaaggaactgtgatattctacaatattgtgacatcttacaatgtaataggatattgtgatacatctagccagctatctggatgcctccagaatataccctcttaattgtttctatgctgcccatcaaaaataaataactaacatttttgagacttattctttgccaagtcccatgtgttaccttctttctttctttctatttttttagatggagccttactctgtcgcccagactggagtgcagtggggcggtctcggctcactgcaacctctgcctcccggtttcaggcctcccaagtagctgggactataggcatgtgccaccaagcctaatttttgtatttttagtaaagacgggctttcaccatgttgtccaggctggtcttgaacttctgacctaatgtgatccacccgcctcagcctcccaaagtgctgggattacaggcatgagccactgctcccggcctaccttatttctttacaaaaatctatttatggcaccattttagagaagaggaaacagacatagatagaataaataacttgtaggtggtggatctgaaattagagcctaggcagtttgattccagtacctattctctaaatcactgtggtattctgcttctccttgagtttttttaaattaaatatttaaataataaaatatttcatttagcacaatagtacatgcatatagtttaaatagtactgaaaggcttgtaacagtacagtggatctctgccccatctcacccaactttcccagtcttccttagaagtaactagttttgtctcttaactttcttctggcatttgcccatctctctgtttctattttagccgttttctgtggatgactgccggtcagtgccgccctctgttttccctccccagtgaaattattttgtaattcttggtcaaatattcagtgtttacattaaacaaatattatgcacaattgaggattgtcccatattttgtttgttagctttctttttgctgcagttattgctgccctttaaatttttagttagttttttctgtgataatttctaatttatctcacggtatgtaatagcttctccacacagttttctgtaatgtcagccacatcagatactttctcacttaacttatttttgcagtttttatatatcctcagctatgtagattgaacttcaagctcttctttttgccctctgcagagaaaacaagcttcagtcttctgttgaatgagggtagggttgttacctaccactggattaagagaggggatccaggtatctagctacttttcaaacagcagccacccaaatcctccctggcttaggatacagctttctagggtctctttaattgattattacgtatctatttacttttctgcttccaaaattgtatgctgttattccttttctctgtgtccttgtgggtttctgcttaaaattaacaaaagcaaacagcacatttttaaacttagtgttagttaagtttgaaagaggaagtaagattggataaatttattgtagacatgtatgaaaatgtaggttatcagaaataaaagaaataaaaagcccttatagtaatatcactagctagaatgactactattgtcattttggagtatttcatttcaatctttgtatgtgtacaagctgggcaggtagtaattggatgatgccatatacaggtttgagcatctctaatctgaaaatctgacatccaaagctttttgagcactgacatgatgctcagaggtgatgctcaaaggaatgttcattgtagcatttgggattttggactttgagattagggatgctcaaccagtaagaataatgaatgcaaatattccaaaatctgaaaaaatctgaaattaagaactcttatagtcccaaacatttctgataaggcatactcaacctatatattgcttatgggttatcttttttatgtttgttagcatgccaagacctgtaaatgctgttttcacacaaactgttgtgcattcattttctgttgtggtccattgacattttcagtctatttttactccagtaccacaccaaaataactatttgaacaaagaagacttatatgacaaacgatcctttaaaacaaaaaatactataactgcctttattccaagtgttaatattactctgtgcctagtgctgatttttaaattacttttactttattctgccttatttcatccagcctgcagatggcagaattgtttcatttgaacagcaattttgaaggctccgttttatttagtgtgttctgacattggaatgagaagtgattaaatgaacagtctctctccctattagagaagaagcaaattaatgttagagacagggagccacactaagaaagtactggataatttactttttcatttggtctatcttcatttcatgatttttgcatgcttggattataaatgaactagagcctataaatgaactagagcatgatgtttaagctgtaccatatgtaaactgctgaattcccttaattactttagtcagagtaatggagcttaaatctgcttcatattaaccataaagcagtttgttctgcatttgtattttaagagtttgcttgtattaaattttttttttaatctagagaccttttagcattcatgaatcaatcatcaatttaaagctttgatataattgagtttgctgaagtatgagcattttgttcttaggataaaagaaatactttagggaagaagaaactagaattagattagtgtaccatatttgaaattgaagtcagaattatgctgtagaaaaattggaagagcccatttgaggaaatacaggaattgcttagagggattactgtaaaattcagtgattggtaaattgctcatgtagcagaaatggcagggaaaacagcaataagctaagcaaaaaattttaatgtattgtgtcattctgttgatgtaaaaaaagagtaaaatagttatgagtcatgagactttacttttaaaatcagcaagtttaaatataaagtactggaccacatacattacaatagtcatttaaaaatttttaaaaatgttttgtaactgctgtggaagggtagacttcacaagccaattagatataatttgctagctttataagaaggagcagaacactgaagtgactacaaaacgttaaattttaactaaattttgagaactttgtgaatactaattgaaaaacttgtgtaatgagtgcagcaaactacttacctgtagttgtgggaaactaatactaggaaacgtaattggtgcatatcttaaggccttcttaatttgacaagagaatggtagaatgtacagcttactggaataaggagggagtctgcatataagttcaaatgcaaattaattaatattaggtaaaggataaaattccattccaaggagtctagaaaagtctacactatcttagtagagttgacagcagccataaagggcagatattaattatgtgcaggcctgtcacttcaagtttatcttacgattgtgtaattactttcccatcagaaaaatacgtctggaaaagataccatatagtgttctaatcaaaagagggtatgctagaatgaaatatgtacttttattaacacattaatgcttatgaaatgatttttctagcatgaaagcctgaggatagattagttagaataactacaaaatatattgcacatttaactctccgtaataagcgagtgtaatctatcaagagatagtattgaataatggagatgtccaaaatatctttctttggtttttgtcaccttcatttcagagtaaagataatgatctactacagaatttttgtattatcataattcagataagcaatttcaattcatttcatgaagggtgactaaggaacgattatgttctttttatttttaaaatatgaaaatttttgaggttcttgatgtggtaacttgaaagataataataaatgcagaggtttcataatatagtccttaatgtcaagagtaatggaaatgtgaaggtctcttaggtgagagattatagcaggagatagaatcataaaataaatgtgaattgtgtcgtgacaactggaaccaaagcatacaaatattggagagagactttaagagaattaagttagtatttgtcgtaaattggaatctggctatagaagcattgaggtccatttagttgcttctttgaaatggaactctttgatatataaatgtaatatgtatatatttatgaaatattctgttcataatgcctggcttgaactttttgatagaaagaacacattgggacttttttttttttaagcctttgttttcgaaaagaggctggcctcttaccgtggtgctatttaaaagataagagtttttttttgcccacccccctccttttttttttttttccccagaacaagtgagtttgttattctgagcttaacaaaataaatgctgaggctcaggctgacagtacattctttaagcaactgtttttgattttttcatcaagccatgtaaaaaagaaaaaggcagtagacacaccacatagtgtagaggattagaaagctcattctgttatctccaaatgcattcagtgtgttaagctttatgcacgttttaagaattcttgcaattaagtgtaggattgttatggtttggatttggagatgcatcactaatgttataagttttcctgtgtgtaagagagtatgtgtgtatgtgtgttttccaagtgcacttccctaattttagttcactcaagaatttagttctccagcattttatagacaaaacattatggttgtatttagtagtttgcattattttttacctatttaatattttaatcacaaggacttattttactaagtaaaaaatgcaaagattttgaaagctatcttctagttataatttagcatttcaactagaggtagcttgggaattcagtgaaactgtttcagctacagttattgagagtcatggtggactggagttggatggctttgttcttcagtgtcttccaaaataacggtgtttcgtaattaggagttaggaaactcattgtggctatttttcctcctgtttttcatatataatgcacttagagataacctgttctcttatgcatttgaaatattcattgtcagtagtaaaagtggtatttttgttttgtttttctcaggcagagtcttggtctgttgcccatgctggagtgcagtgatcttggctcactgcaaccatctcctcccagattcgagtgattctcatgcctcagccccccaaatagctgggattacaggcgtgtgccatcacgcctggctaatttttaaattttaatagagtggggtttcgccatgttggccaggctggtctcaaactcctggcctcaaatctgcccacctcggcaaaagtggtgttttaatacaagaattctgcatgttcaaggtggggaaaaggcttataaggatatttgattagacatatgaagaatgctcacatggatctgatatgtctggtttgctatatttggatttctgagtgaatataagctatcaataaccattaattaattgatgatccatatttgtaaggaacattgagatgtaaagttagcacagctttgagagtttagcatgaagattcgcatcctgtaatcagtctggattgtggttttctcattgatgaaatgggcgtgtttgacttggactttggtttgggctgtgtcatttttggggcattaggagtgataattctacttttccagccttcttagaatttggtgccagttgagagagagaaagggtaagacagatagagatcaaatgctgatagttacattggattggagaatgtgacttagatctgtggccttctaagactgggcttcttagtacaaccccactttagactttgaactttctgttttagagggagactgtgtgtgtacaaagcaaacacgcatatccgaattgctgcctcatacctggtgggccctgatggcaagaacacagagaggtggggcctgtggagctgcttttgaaaggcagcgccgtgtgtgtctagcacgtggatggaggagctgataggaaactgcaggttgtctatgatcaggaagttcttaaaataaggaagagagtgaggcaggtatgcatgcttgcattctttctccagaccttcagagtgaaggaaaagtggagaggtacagaaactttctcttaaatacttcaaagaggtggaagcgcctttatcacgaagccataggaaatctccatttgaaaatgcagtacaagttattcagcttcccaagagaaatatttattctcatttaacattagtgctcaatttccttgcttttaaccctaaaacatcaggggagacaaaagaagccctgttcttccacatttgaaatatgttagctatgctacagtgttttgcttgtttgggtctggaaagttgagtaatctgaagagagaatagggtctatggaaagctataggggatggacgtatttgttaccatggtattttattagtaaattgtaatctaaaagccatggtgctcttgaatgtaaccctggacggtggattgggaagtgcagccggacaaatacatagtgtttgctttttcgatacctaaggaaaatgtagttatgtttcattgggagatcattctggtttgaggtctacttctctggatccccagttgaattgtggtatgcaacaaaatgtgaggttaatttaaccatttaaattctgatcatccttgacaaggcaaacgtttcctttcatacttattagtaggaacctttgaatcttgaatactataatattagatgaaaataaaaacagccagtttcttaaagtctgatcttgattattctgttgtcgatcatcagaaccgtgtttttgttgttgttgctgttttgttgttgttgttttatttggctttttctttggtcattttacctgtaaatctattttgcagaaacaaaagggaaaggaggaggtgaaacctaaatcaatcctaaatcaatttttctcctttttttttgacttataagcacctggcttgagaagatgcatagaacactggggaattatgaaaacagagtttaaaatatcccaaaaaacacttttgtggttataaaaaattgaattttatgtttccatacaatttactggagacttagtttaccagttgggaatcttttagactttggaataccttctttttcaaattgaatttgacgttaatttacttgaacttatattgatgcctcatgaggtgcattatttgttgtggctcatctttcctttttttcaatttcaggtgatcccattaagatactaatgccatcactgtctcctacaatggaagaaggaaacattgtgaaatggctgaaaaaggaaggtgaggaggtaccttcctaatgtcctgtgtgctttgttatttggttattttgttttgtttttttttttcctaatctgtcctgttatacagtatgtgatataaattaaataaattgtgttcctttggtagttaatgtaagtttggttgaataaaattttcccatgataaagcagcaaaggttttctgggttcagcatatatccttacacaagcacagaatggtaaaaaatattttaaggctttttccccaacttttagtccttatgcctagcttttagtttcaacatcatagttttgacattctccttaatttataactttatcatgattgtgtgtgtgtgtgtgtgtgtgtgtgtgtgtgtgtgtgttctgggaggtaggcaagttcatcataaattttattgaaaagaacaaataagtagaatataaggaaaaccctcaaaagcagatcagcggaggagggttgtagccctgctaattattgaaatatagtattaagcatttctaattaaaactctgggattggtgcttaaaagacagaccagtgcagctgagtagagaataaagaaatagatgcagttgcacatggaatttaagtatataataaaggaagacaatattagatttattctttatgttatgtgaaggataaattacaaatgaattatacacttaatgtataaaaatgaaactatgcaagtcttgaattcctctgaacccggaagtggaataaacaccctaactataactcaaaatccagattataatatgggaaataaaatttgatggtaaaagtactaacttttatatggctaaaaatacaagttaagtaaaaaaagaagtgacaaattggacaagagtatttgcgatttctatcacaaagggttaatatccctaaaaaatcgataagactgtcaactcaacaagaaagtgggcgatacatgaacagatagtttacagaaaaataattgcaaatgactcttacacgtagaaaaagacgcctaacctttcaactggtaagaaatacgcagacactttactgaaatgtcatttcttactgattatattgacagtacttaaaaagttcgacaagctgttctcttgatgatgctgtggagggaagggaagaagcaggactctcagacattgctggaggaaatgctaaatggtgtaaatactagggaagagaatttggcactatttagaaaaattacatttatgtttaccctttggcccagcagctctacttcgagggatttgtctcagtgttacaccagcaaaaataagaatagacacaaacacacactaggctgtttatcacagcactgtttgaaatagcaaaaggtagaaacaatccaaatgttggttagtacaggatttgttgaataacttttactgtatctacacctgtaaaaaggaatgaggaatatctctttatactgctatggggtgatcttcattgaaaaaaagcaaggtacagacaagtgagtatagtatatatcatttatcaaagaaagaggtggcagtgctaatatttaagaaattagaaaggataaaataaaactttaaaaacaacaatagttggttatctacagagtaatggagggaaccgtgtgggggagaaactggaagctggacttctgaatatatcttgttttgtctctttgactttgggacaatatacatatcttgcacaattttaaaacaaaattaaagtgtaaaagagccctaaagattgaaacgagacaggtgattctaattcatttttttctctctctttttctctctctcaatttgcttacataaccatacagagaggcactatttcaaatgtcagatgtttgattatatggccctaatagattataactgaaggataaagcgtctccaaaagtataatcctcaactgttagagtaatcgtattatgcttgttatgttggtattgttattctaaggcttttgtgtgtattttatgggataaagcaaatgactggttaagataatatcattggaaacttggacttttagtgtagtttaaaggagaaacaggtaaaagtttctaaggttaggaacgaccctgtgatggtaaattttctagctctttcccctggcaatgcctggaaacaaggaccaatccagtcgcagtaagcacccctagaacccagactgtctctaaatatcagttcccactaaagtaaatgaaggctccttggagagtagctacttgcaggcctagggcaggagatgtgcagatgagcttttaatatcttgtcagttcagaaagcaaggaagctgtcagaaactcctgagggcatcttaaaggactcaggagccagagatgagatagtttgaggatcactaaggataataaggataatatatttaatatatttcaatacattaaatatatttgaatcctaagttcacagtaatactaaagaaaaaaaattaataataattggttagctttagagggtgctaagaaattaactcattttgaaaacgtaataaatggaaagactcaagcatttttctctacctcttctgctatatgaaccgtagctctgagtaaccaagtaattgatgagaagtttctcattattagcatatcacagttgttaaaagatagaagaatcatagaacatcactgtattgccattttgcaatctctggtaaaatagtatagccagtgatcattaatagctgctaacatcacaaaaagagagataaccagatattacatgtttcccactgtgaagtagtcttgccagaaaattgaaccaaatatgttcaagcctgtagctctatcattttccaggaaatacaggggaaaatataacgtgttcaatgacaccatgagaagtatatcagcaaaagctagactgaggaattctgtatgccagtttcttcaaccaataaatttcagggtggtagggaagagcccgggggaggaaggtgggggaacctatagcatacaagagatttgagaccagtgccaatgtatggacctaattttaattatgattcaagcaaacaaaacacatgcggacatttgaaaactggctggatatttaatgatattatggattttttttttttttttttttttttgagacatggtctcactctgttgcccagcctggagtataatggcgcgatctctgctcactacagcctcagcctcctgggctcagggtgattctcccacctaagcctcttgagtagctgggaccacaggcatgcgccaccatgcctggttagttttttgtatttttttagagacagggtctccctgtgttgcccacgctggttttgaactcctgggctcaagtgattctcctgcctcgacctcccaaagtgctaggattacaggcataagccaccgcacccagcataggaattattaattttaaaggtttaataatattttggttatattttgattattaaaaaaaaaaaatctcacctataagagatgtgagatgaaatacttacgaataaaatgacagtatctctgggattagcttcagaataaccctggttgaggttgagagggtagggaggggtataactgaaacaagatcggtcatgaatcacttggcagttgtataagtgaggtaaaaggtatatgtggcttcattgcctttccttaccacttttgtataattcaaaatttattttttatatataaatttttttaatatattttttaaaggttgtgcatagtgctttcaggatataatttgagatgagaaactagtaccagatgaattggaatgttgatattattaagagaatatttgatacaataccatctataaagctgtattatgtcactgtttctggcaaccattttgccagattttaagtacctaatatggtgcttagaaaataaagactatgaataaaagaggtgagtatgttacagtgcttatacagaaggatagaggaacagttaatgtgaaggaagctgggctttttgtttttctggcagctactttcttttccttttcttttcccctttttcctttgccatgtgtggtggtagagtctcccctccaggtattggccactggataacctcttttagcaccctatgtagctgtctttctctgtgcttgattcattctgtatcaggttaaactattgtggaggaaagaggatgagtctacagtacctattagggattgttagacagaaaaatagagaaattagaggtgactgaatgagtcccccacagccattattatgcgtcatctggagcaatggtgaatcaagtgttaaaaagggaaagaaagaagggaagtgcaagtagagaatgaataacatggtctggggaggacttgtctaattccagagactagccctggcaaggacttccagggtatcctaatgtgatttagtaggcacagatgtcactcatacaaatgttggtattgagtggtccagtctagtgcttgtaaaatagtatcaaaagagtttaggcagtgggcaggacaccagagtctggaagagctgtgttgtgattctagaaggtctagcctttcatagcatcacttttgccactaatgacagatgtggggatcaggaagagggctaacaagtatttacttgagaacactagccaaatgagctggggagtttgggacaagcaaggcctcacttctttgagggagtctggggtgtaaggaaaggcaagaaaaattgctgtgggttgagccactatggaggttaggaggtatggtgcagtgaggttatccaaatgaacattactggtccttgatagacccaaccaagtctgtttgggcatattacttaattctgttcctcagtggggaatatgtctgagtttgttcatgtttgtgcttcccataatgactaacatcgtaattggaatagaactgcagtgctgtaagtggtcagttagtaaaggtaatggcagaggggaaagtaagccaaaagcagggtacatgacagggatccaagaaggctttgcagatgaggtagtatttgaactggtccttgtagaataaatgggctttttaaaaataatgagaaggacattccagctagaaaaacatgggtaaactcttggaagaaagatgtcactgagacatacttttgcaacagcaggtaggtctggctgcattggggacataatggctgtaagatcagatagattattggaaggatcttgaatgccaatctgcagtttatcagtctgtgagggtccttatcctaaagccaaaatagatccacattcatggtttcttaataggaagtggtttcttttcttttcttttttttttttttttttttttctgagacagagtctcactctgtcacccaggctgtagtgcagtggcccgatcttgctcactgcaacctccacctcccaggttcacgtgagtcttgtgcctcagcctcccaagtagctgggactacaggcgagcaccaccatgcccagctaatttttatgtttttagtagagacaaggtttcaccatgttggctggtctcgaatttctgacctcaagtgatctgcccaccttggcctcccaaagtgccgggattataggcgtgagccactgtgcctgggcaggaagtggtttctacatacttttctgagccctattagtagcattgcgttgaaaggaacagaccctaagagtaacctggtatgaggagataactgtaggcaatttaaagtagcctccttttcctgctctcatttgaaaagccaacactgagaactcctaatcaatgtgataatctaaacagatggggtaaagcatctgctctctatcggatataatattataagtaaatcttttcaatgttaagtggtgctggaatgcagagaaaggaaatcaccaagtgtccccacatctggagtggtgaatgggagttgaggccatgtgcaccactagggctgagctggaaggctggagttgctgacttttttttttttttttggtggcggggtgggtggaaggagcaaggaagggaaatcaagaatcagattaaaatttgaatatggtaagatttgaaatgcatatgaggcattcaagggaaggtgttcaatagataactgattataggagttgaagttcaggagtgaagtctgacttggagacagaaatttgagagtcatcagcatgtggatggaatttaatgccatgtgataacaggcaaaatgattttgaatctatatggaataagaatgcctactcccctaaagagtcctcctgagggtcaaatttatagaacttgcattttctgggaacccacagatagaagtgaagttgtcctgggctgatcgcctccctgggttacctggtagaagccattattctggaagaatacagcttctaatccaaaccatacagaatttgcagataaagtctcaccaaaagtcacaatcccacatttaataacgtatgtggaagaagtcttttaggagtgaagtcagtaggcataacaagcagcaggactggatcccaagaacttcagttaattggaattacaaaagtccaggcagatttgaaaaggataaacagaacttctagtaatgaaaaatatagtctctcaaattaaaaccccccaaacctcaagggtgggctgaagtgtgattagacaggactgaatgaagaatttgtgaacagaaggacgactagaggaagttaggttgcatgtagcacatagagacagcactggaaaatatgaaagagaagttgacatatgaagggtaaaatgaaaattattcaataacccaataggaatttcagaagaagaaaaaaagagggaaatgggaagaggtaattttcaaagaaaaacatggcagagaattttctagaatttaagaaagatatgtgtaatgtaaatgaaagagccagtaccccattggaaagcatttagagcaattggctctgcatggctgctgctatcttttaaaataattgtcagtatctaagaaagttttacctttataaataatgtaatcagttggaatgtgtttttaggtttcttttctctgatgaattacagagctttggctatttccatattcgatatgacagggtgttggtgtcattaaataatgattcagacacagaacagtcttttagggattattttaaaaagattaactttcttcacactttgagaatttataggtaagcagatgaggggattcttgggccacatttatctttcagacttccagctcactggcaatctaataagttattcacacccgttagaatatgagcagtaagataaagagccagcagacatatggtctcattattctgttcttttttccttttgattacaatatgctattttcatgtaggacaggccaggatgtattttaagtccctggagcatgtttccctgaaggttgctcttaaaattctgtgttctgccaactgaagggaaatttgtttttgccaaaacacagtaaataattgagagcaatcttaatccttggttcttagtggttcactggcttctttttgaagctcatcacctttgtgatttgtgatcttttgagtataattggctgcttttcattaacacttatttactgtatacatgggtgtcaatatatgtttaagtatgcctggttcttggtacatttatgataacttgctccattcattttatattaaaaacaaatttatattctgacagcatacttttcatatattttttctcttattaactgttttttgtttgtttgatttttgagatctttttaaatgtatggtcaccataaaacaatgagtttaaacctttatgcattaagaaaattgatatttttcatgaaaaatgatagtgttgcatcgaattatgaatctagtttacttctaagcgaagactagataagtatttgagaacattcaatggacagcagttcagtcttaaaaaccattaagttttttcaaagatctgagactgattcacagcttcttttactaatggtgtgtgtgtgtgtgtgtgtgtgtgtgtgtgtgtgtgcacttgcatgcgcgcagcgttttacaccaaggaggtaagggtgcaaagaaaaaactctggcccaggaatcatggtttttcctttggggttcctcctctgccatgaactacctgggagtgagttgaactagctgaaatctaaggtacggaatatcctggatttataattctatgataactcatttttattttctttttttaagtaactgaaatatgcagtattatagcatataaattatttccgtctttgttgaactcatgattctaagaaaataagttttataatgactattagagtacttcatttcagtctgaggattgactaaaaccttatatatcataaaattagtacagaaaatgctctgaaagtgctaggtaacacccacaatttcaaaatcttttgaaaggtcaattgagctatcatttggcatttttattacaagttttttatttggagggggcatgtgcttcagatattttcagtttaaactgcacctagtttattttttcatcaattgaactgtcaaatctgttaaaataacagaaaggaaaaaaaattcttgttctccttttgtaagagaatatttgaggttatgaaaaaccttgttttttttcctcagaatatttgagatttttctgctctgccgtgaagcactatggaacaaaaccaggctaagataattccatcaagcacttagccacacccacagtgcctagaatgtacgtagtaagcatgcttaacagtggtgcttgttgctgcggtattccttatgtcatgagacaagggatttttttgtatttcaaatagtttttgtctaatatactgttactgtataaaattcagaaataaaaccattttgaagaaagccttatcctatatcactagatgccactagagagttatatgggtctctggattctactatagaagacactttggttccgttatttctggcaatatgtatatgtttgtggtgctaaaatggaaaattttgaaaagtccatttcacaaatagcttcctttttttggtgtactatggttttcacagctttattgaggtataatttacataccataacatttacctattttaagtattcaatgatttttaataaatatatggagttgtgcagccatcaccacaatccagttttagaacacatttctgtcaccccaaaaaagatccctgctgcctgattgcagtcatttttttcctcccatctctatccctagacaatccggatctgttttttgtctctaaagttttgccttttgtctatgtttcatataaatagaagcatgtaatgtttggtcttttgtgactagattttttcagatttagcatgattaaggttcatccatgttgtagcatttatcagctgttcattccttttgttactaaattatattccatcattatgcgtttttacatttattgctaaatctttgtattatatcagaatttttaaattagtgaatggaattatagattatagttttattcaatagaagtttctgtggtgatggaaatgttctgtgttaaactgtcgaatacagtagctactagactttaagaagccagagggatgtgtgggtggttgaccttgtctaactgggcccttctcaaactctcctactcatgccttcaccccatagggcaggacctcaactggcctagcaaccaggttgcctcaggtctttggccatgcaaatattatccttctttgtgtgtgtgtgaagtgaaaagggatgacaaacactgactaggggtccctcctctacattcccattctgctgtaggtactaattggatgggattgtcattgcctgcttgttgtactgttcttcaatcagattaggaacttcttgaagcagttctgtcttattttattactatttttatcatagtgtcgcacacagtgtcattcacatgggcagctagtaaatacttgtagagtcaacaattgaattatttttgtttctgattattgttatcattatggttcaacatagcactaagaagaggaatttttctttaatgttcatgttaatctgataacttggtcttacagataaaaactagctctcttccaccaccaccaccacacacatcttttacgtaaagacttttattcttaatttttggcagaacaaaattattttgtgaaagcctcaggacttattctattaataaaataaacatcaccattaactgtgtttgaccaaggctatgcttaatatctagaatttaaaaagagaaagggaagcctccgtatacttcagtcctcagctctggcagctgcccatcggacaaaggaacaggacgatgatgctggcgtcggtgctggggagcggcccccgggtgggcctctgctctggcccctcctggggcccgcactctcgctctgggcccgctcctcttccgccactgccatggaccacgagaagatggtgcaggaacactccagggctgccatctctttcttcaatcagtcagctatgaacctgacagctgagaagccatctgtcatctcacgctgtccaggaccctctatcctagctgctgagtcttttccactcttctccactttaaactctttgtggacagaaccttctctttttgttgttttcatacccagtgcttagtacagtgccttatacattaatgtttgttggatgatctggtagaaatgacagaatatggaataaatgtgtcctgattctggtagaaatgacagaatatggaaaaaaaccgtatcttgattcaggtagacatgacagaatatggaataaatgtgtcttgattcaaaatggttgtatagctaacattttatttttacctagagatgttgtaaagtgttacataaagatgtatgtgaagcattaacacttccagccccatgacttaaaaaatatatatctatacatttaaaattttcctgagagtcagagagattaagtaacttggtcaagatcactagtaactgtcagagcttggaatcaaactcatatttgaattaggagaggttccttgtaactactctgccaaggagtctttctaagttatagcactaaatttttgatcacagctgaaactcagtagatttgaaatattcatggctcattatttgctctcagagttttcttttggcatttacatgatgtttgattattgaaagatagaactttggttttgtgatgagttaggggtaatgcttccatacgtaatattactatgtttttaaaacttccctgtgatttattggtaaagtgttctgtgtttcttttccctacctccctctcttttgtcctctccttttttccttctctctcctcctgcttttctcttctaccctctcccttggcattctcatctagctaacatatatgtctgtgttatgtgaatagatatagttttttaaaaaagaaaaaaaggctatctttttaaatatcagaagcatgctacaaatcaaatgttagaagcaaaagaaatgtaaaagataatttgatgtataccttatgaggaaataaggattcgtgaagttatcatgtttttttctaaagcattttaatctaaaattcattgggtatggtgcattggccatgaaacctgaggaatggggatgggaatataaaacatttaagtgtcctgtccgtattgtgaagaagctcatagtctagtaaatagaggaaatcacaatttaaaaaagtaattagcagtaatataacattttatatgcaatttgtgatttttaaataaattagacctactataggaatctggaatatgaacaaaattatgtaggtcaagttactcagagaaagttatatagctgaagtcgaatctgtagttcttaaagtgtggttggaatttgaatactgatgaacacaaatgatgatatagcatcattttgtttttctgtggctagagtctgttttctaggcatctaagaggtatttaattgctgggtttactagttctatagtttttcccgtgattatagcagaaatctttgagggtgtgctttttttcccttttgaagtgcaatctgttttaaccactaaaacatttaaagaagtatgtaagatgatataatctgacactgtagctttctctatgacatacaaaggtcatttttggtctcttcctgcatatcttaccagcctaatctctcgtcacttctctcgcatactatttgccagtttctctgaagtttcctgttctctctgcctccagggctataagtgtattaccttctacctggatcactgcctgtttacagattgtctcctcctcacctcttcaggctcagaataggtggtcattgtattctaggaagccttttctcaccttacaaaaactgaattagatgcccctcctgaacattcccaaagcatcctgacctcaccttatcctgctgtattttccagtttacttgtcaatggatattaagcaagcttcttgaggtcaggaatcttaaatctttgctgttattactgtccactgctgtatcctcagtgcctacatatgtatatatattttatatgtaatatataaatatataatacaaatatgtgtgtgtgtgtgtatatatatataaaatatatttatataattattattattttttagacagagtttttgctcttgttgcccaggctggagtgaaatggcatgatcttgactcactgcaacccccttctcccaggttcaagtgattcttctgcctcaacctcccgagtagctgggaccacaggtgcctgccacctctcctggctaatttttgtatttttagtagggacggggtttcacaatgttggccaggctggtcttgaacccctggcctcaggtgatccacccacctcggcctcccaaagtgatgggattacaggtgtgagcctacacgcctggccaccccaatacatttttaataaatgtttgttgactagggacatctctttggagttagacaaaggaccttttaggtggtaaataaatatcatctaacatatcaatttatttttaaaaataacttatattagtgtctctgaactatttaacctgaagatataactatcaatttgatcatcttggtacacaatgaagtactttctgtactgtgaacgttcagagcatatttgttaatttagtgttttagattttctttcatattctcttatgatgcttgcctgttaatattgctattccagctatttttggtgtgtgaggaggtgtatttatatgttacatattttttatccccttgttttttattctgtttttgtgttagggctatctcttgtaagctacatttacctagattttattttcatatccattttgataatctctacttttaatgggtgattttaatccatttatatttattgtgattacggatacatggggacttatttctaccattttttgtgcatttttgtttttatcctttgccttttctttccatgtgcctgccctcagttagataatcaacttcttatttttcctctgtttttctaatgctgtagattatatttctgtttttaaattttaaattaaattttgccaataaagtttagtattattcagtatttttctcctattataagttgatgcaaaagtaattggggtttttgaaagtaaggtggtaaaaataaaattacttttgcaccagctgaatatatcaaagttgttagcatgccttaccatctaaacatttccttacctatcttattattttttagagtttgagttttacactttttaaaccctcaaacattactttaaaaatactagtagttaacattttagtaattttcacaataacttgtttcttatagcccatgggttccatctgcttccacttttcttcttgatgaactgcatcttgtaagagctttttaaagagatctttaataggtggtaaaatttcctagcctttatatatctaaagaatacttctctttcattctcaaatgatggtttggcagcatacaaaattctagacagttatttttcctcagttttttgaagatattacttcattgttttctgacctctgttgcagctgctgagaagtgtactctcagtctttccattgaggtaatctgttttttttcccctttgatagatttttaaaagattatgtttttatcgttgatagaatgcggtttctttacattgtatctaatatggattcatgtttatatagtctaatactcttttttctgtttaagtttttatcaaggtataacttgcataaactttaggctcaattaaattttgtatacatgtatacccatgttaccaccacctagatcaagatttagaacattcttagcaagctacacagatccgtatgccccctgctagtcagtacacctatcctaaattcattcaaaactctttgatgatgagagtatacatctccagttctgggaaattctcagccactaattcttcaggtattgcttctccaccagtgcctccagtgtcttccctcagaactccattagcaaacattgcagcctcagtctttgtcacttaactgctcttttctgttttttcgttttgttttgttttttgtttttaatgtttgtatctttttgtctgcctgtatgaaattctgcgtagttcattagtgctacctttcaatttactaattcataccttcactattccctgtctagaatatattctgttgtttctttttatttcaattacttaatttttcatttttaagatttctaattcgtttttttatttctacctgataccatttttttttaatttcttgttcttgtgatggctcttttactttcatttatgtttttggatgtcctcaagtacttattttacaatctttgacagattgcactaaataaattgcttctgaaaagaatttttgttacaattactgattttgtggcttgctttcttagcttttgatttcttcgtgtgtctcagaactttcttgtgcaatttacttttaagtggaaagtttatgttttaatgtcttccctcctacgcagtcccccctcgatccttgccaccatccaaggaattttgcaattgatattggggatattggcagatacagccccggagccagagggtggcttgactttgttcctggtactgaggcagtattctggtccccaccttcctagacccatggttgctgattaaaatcatagtctcagtcaacaggttttgattgtgcattttatcagcctcacattatgagtagaagaaccctgacttagccctagctccaaatagtgaatctgatttgagtcccctatatccaacagactacttttagttccctttaatccccaaaggaaactgttgtacctcttttcccctgtttgctccaaacctgctcctaaatccagaagctagtaagcctggaacttcaggtcttcctccatatttttgagtttccagatattttctgttgcagagaaatgatctgtatttgacttcagttgtgtctttgattttctctttttatgctttatatgctttattcatttatactgtgtgctgccaacaggttttttgaacttgccctaagatgtgaacccagaagtactgttaattgtaaaacttttcttcagggaatatagtcaaaatgtttgaaaaagtaagggggatatggagtctggaattgatttgttcagaggtggatacacatttgttgctgatgtctttaaggttgatttcatttttacatgctcagtaatctttgtaatagcttttttattatcacaagtataatttatgtccattatagagcttttggaaattacagcaaagcatacacatacacacacacacacaaacacccacacataatgagaattacttgtatttccacaacccagaaatagctacggaatattttggtatttatttatgttttattcatacgtacatatatacatagtaatatttatattttaaaaaacaaaacaaacccagtcttgttttgtaggtgaagcggtgagtgctggagatgcattatgtgaaattgagactgacaaagctgtggttaccttagatgcaagtgatgatggaatcttggccaaaatcgtggtaagtttttattttaattttcttcaacaggatgaagatttcttgagtggaaagttcattgtagtaaaattaccttttatttttgcctccttatttttaatgtgtattgtctactacataatacatttttagttcaagtgtttaaaatgttttagagttaaggtctaatagcctatttttctgtattttctaaattttctgtaatgtgcgttatttttataatggaatattagagcttatgtgaaaagtaagtgaaataaaatgcgtagagctacatatggtagaaacatgactatttagcattgtgtggtatattccctgattgagccaaccagcgtgtttgtttcttaacttccagaacctttactaggtagtatggtggagcatctaagactgtggactctggaatcaccccgctgactgattcatgttatatctaaaaagttctgccagttattagttacgtaatgataagcaaattcttcatcccctgtgcctttttcttcatgttaaagtagagatgataataatacctacttcataggacagtagggaagattgagagagtacatatatgctcatctcaagacctgttacccaattgctcaataaatgttacttttcccattattagaactgtttcctcagctcttggtgaccattagtccccaagtcagtctgtatgtttgcctaataatttgtattggttggttgcaactggataataagtatccatttgtgcctctggagttcaatttgtacagatgagctgcatgtctattagcagtcccttgtggatgtgtttttatttctgagccaccagcttacctctgctttgagcatagatgtaacaccttcctttgtatattctattcaaagactacacttcagaatgctatactctaactaggtgcaaatctagagacaattttttatttgtttttctttctagaaaatcctcttttccttttttttttttttttagccacttatgttgtatttttaacttcgaatatgtcaaactcctttacttgtcatctctcatattagatactagatataacattccaggttgaaacatgttgataatacagttaacttccttgtaggaatatgaatcaaagcctaaaatttctgtacatttgtaactaggaaaatataaatattcataccaaaaatagttttcttgactaatttatgcagcatattgaaacagattgcttgaattaccatgtaataaacccagctacattttattatgtgtgcttttggcaaactgtgttcttggccccaattctggattgtttggctgtggaaatcttccagaattgatagcatttttccacttagctgcttagtaatacatttcaaattgctaaccatgtcagtgggtcagcagtgccaattcatctggcccctatgctctgaaaaaggttgggagtgggagtgcatatagttgatagtggctttggtggcacagctattttcttgccaaagaaaagactgtatattttaggcctttgtggctttattattattccacatgctttttggataatatttgggagtctcttcacaacaagatgttgcaattttatcagggacaaactagtaaatctttttttcttctgttttttgtttttgtttttgtttttgtttgagatggagttttgctcttgttgcccaggctggacacgatcttggctcatcacaacctccgcctcctgggttgaaatgattttcctgcctcagcctcccaagtagctgagattacaggcatgtgccaccacactcagctaattttgtatttttagtagagacgggtttctccaatttggtcaggctggttttgaactcctgactcaagtaatctgcccaccttggcctcccaaagtgctaggattataggcgtgaaccaccatgccctgtcaaaactagtaaattttgatacaaaaatacttcagttattatacatttaaagatcagttcatcagcttattcttaaagttagtatttagcaaattgaacagcagctgttttaaatgataaattaataaagtagaatcttaggatgacatatttggagggtttattagaggttctctaatttggcttccagtgtatttggggttgctatataatttggcacaccaattaggatatttgtgaggatgaaaagggtataagatgtcaaaattatttacatttatgtaatgtttgcaatgtatttattgactagcaatatatttattgatagatttttattgatagaccattattcaaaacaattttcaaaagtagaattttttctaaaaaatagcatccatggatattaaaacaaattttttttaaaaaaatggttttttaattgatcatctgaatactaaaaatagcagaataattattctcggtactattcaccttcttcagttggtttcttcactttatctcactcaaatactgtcattggtatttttctaaagaatacatttttaaatattactgtattcgttagataccccttccccacccttattttttcattaagttgcccacaatcccattcaaagttgccttttaatggtttgaaagtttatggttgaaatttgaagttgtagaggcttcaaatgattcttctgtctagaccgtgatatttttaattgagaaaatagcctctcagagctcagagcagttctattaaatggaagatattctcaactctaattttttctttttttaatgtttgtttatttatttatttattttattattattattattattatactttaagttttatggtacatgtgcacaatgtgcaggttagttacatatgtatacatgtgccatgctggtgtgctgcacccattaactcgtcatttagcattaggtatatctcctaatgctatccctcccccttccccccaccccacaacagtccccagagtgtgatgttccctttcctgtgtccatgtgttctcattgttcaattcccatctacgagtgagaacattcggtgtttggttttttgtccttgtgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcagtaaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccagcagtgtaaaagtattcctatttctccacatcctctccagcaccttttgtttcctgactttttttttttttttttttttttttgagacgcagtcttgctctttggcccaggtgggagtgcagtggcgcaatctcggctcactgcaagctccgcctcccgggttcacgccattctcctgcctcagcctcccgagtagctgggactacaggcgcccgccatcacgcccggctaatttttctgtatttttttagtagagacggggtttcaccgtgttagccaggatggtctcgatctcctgacctcatgatccacccgcctcggcctcccaaagtgctgggattacaagcgtgagccaccgcgcccggcctgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcataccctttgcccactttttgatggggttgtttgtttttttcttgtaaatttgtttgagttcattgtagattctggatattagccctttgtcagatgagtacgttgcggaaattttctcccattttataggttgcctgttcactctgatggtagtttcttttgctgtgcagaagctctttggtttaattagatcccatttgtcaatttttggcttttgttgccattgcttttggtgttttagacatgaagtccttgcccatgcctgtgtcctgaatggtaatgcctaggttttcttctagggtttttatggttttaggtctaacgtttaagtctttaatccaccttgaattaatttttgtatacagtgtaaggaagggatccagtttcagctttctacatatggctagccagttttcctagcaccatttattaaatagggaatcctttccctattgcttgtttttctcaggtttgtcaaagatcaaatagttgtagatatgcggcgttatttctgagggtcaaactaccatcagagaatactacaaacacctctacacaaataaactagaaaatctagaagaaatggataaattcctcgacacatacactctcccaaggctaaaccaggaagaagttgaatctgaatagaccaataacagtatctgaaattgtagcaataatcaatagcttaccaaccaaaaagagtccaggaccagatggattcacagccaaattctaccagaggtacaaggaggaactggtaccattccttctgaaactattccaatcaatagaaaaagagggaatcctccctaactcattttatgaggccagcatcatcctgataccaaagccgggcagagacacaacaaaaaaagagaattttagaccagtatccttggtgaacattgatgcaaaaatcctcaataaaatactggcaaaccgaatccagcagcacatcaaaaagcttatccaccatgaccaagtgggcttcatccctgggatgcaaggctggttcaagatacgcaaatcaataaatgtaatccaacatatacacagaaccaaagacaaaaaccacatgattatctcaatagatgccgaaaaggcctttgacaaaattcaacaacccttcatgctaaaaactctcaataaattaggtattgatgggatgtatctcaaaataataagagctatctatgacaaacccacagccaatatcatactgaatgggcaaaaactggaagcattccctttgaaaacgggcacaagacagggatgccctctctcaccactcctattcaacatagtgttggaagttctggccagggcaattaggcaggagaagtaaataaagggtattcaattaggaaaagaggaagtcaaattgtccctgtttgcagccgacatgattgtatatctagaaaaccccattgtctcagcccaaaatctccttaagctaataagcaacttcagcaaagtctcaggatacaaaatcaatgtacaaaaatcacaggcattcttatacaccaataacagacaaacagagagccaaatcatgagtgaactcccattcacaattgcttcaaagagaataaaatacttaggaatccaacttacgagggacgtgaaggacctcttcaagtagaactacaaaccactgctcaatgaaataaaagaggatacaaacaaatggaaaaatattccatgctcgtgggtaggaagaatcaatattgtgaaaatggccatactgcccaaggtaatttatagattcaatgccatccccatcaagctaccaatgcctttcttcacagaattggaaaaaactactttaaagttcatatggaaccaaaaaagagcctgcatcgccaagtcaatcctaagccaaaagaacaaagctggaggcatcatgctacgtgacttcaaagtatactacaaggctacagtaaccaaaacagcatgctactgctatcaactctaattttttcatattgaaatagttatgacagattgtgaggaaagatagtttatattccccatgaatcaaaagctaaattgttacatccactttataccttttaaacttgtttttttaaaatacagacaccatcttgaggtgctgcatgataattttgatcagttggatataatttacagatttgataaattattgatttggtagcgattatattggataccatctctgatgttagactacatttaaatcctgcctctgctacatacttgtcttgtgatcttgagcaagttacataacctcttcgtgccttaattttctcatctataaatgggaataatgatagtatttacctcagaaggttgttaggattaaatgagttaatgctgtgctggaacagtgcttggcacttgaaagccagacaactgttattcaagggcttaatgaatgtttcttcttcccctctgtattttagcttatcattggtttgttctcattttcagtatttcttatgtacttccttataaaccaaagttcattgttcatataagataaacagtatacattgaagaatcaaaacagttcaaaattgtataatgattcacaccatgatggaaaatcatagtgatgaaccagataagtcagtcacgtgactcaggtcatctccactcactgctgcacatgctctgtcagtagtcactaggtagctttcaaactgctctattttaaagaataaaagtacttaaataattacttaatatattgattttaatatcagaattaaaacagacaatatttacttgtgcctttaatggaatgagccctctcaatttctctgttggacatactgctgtaaatgttttgcatctcatatccctgtgtacacagatgagattaggtgagctgtttgtagcacatttgcaggtgattgattggttaagatgtgagaatgtctctggtacagaagcctcacactagtgacctgggcttgagggatagaattcagcctctgtctgagaattatgaagaaatagtttgtcacagaccttactacccattatcgtatatgttgatgtttgccctttagtgctgccagccacatgctaagcctttaagcatgaatttctaacccataccaaggggtcagtcccctgtagtctaatcttgatccatgttgaatgtattgttttaaaaaatccataatttgaaggaaaacaccacagcaataacaacagcaataataatgcctttaacaatgaaaatgaaaacaagttactagctatcagacactattctaagggccttacatataactcatttattcctcataacaacaatgtgaagtagctactgttatttgcatcttacagctcagaaaacaagcatggtgagataaggaaactttactaaggtcacataactagtaagtggtggagccagcgttgaaactcaggaagtctgtacacaactgggagggaaggctaatatttgaaatgatagactcaacattcaatatttcagtatcgatgagctctaagttgatagagctatgtgtaaaaaccctgcatttaatattaagaaatcattggcagaagagtaagagagggctttggtcaagtaagctgagtgcataagaaaactctggcatttgaggtgtccttagctccagatgctttggtagggcagagtgtatccatggaggtaccatgagctaccatggaggtagctcagagaggaaagggaacagtaacagaggcctgcttggtttttaaacagttttgcaaagagtattatttacgtatttatactaagtctacaccagttttgagtatttgcctactacagtgtaagcaaatgcttacaggaaattagcacacctctgaaagatctctgcaccaaaggaatagaaaaggttgaagaaattatcttaaattcatatagagattttaatgactttaaatggaattataatcaactgtattttatcttctgttatatattcaagttgtatggttgtatatcacttgtccttgtccattgtatttgggtttcatgcttcatggtgtcacttttttaaatagaaaaaaatgtgaatagttaaaaataaattttatttgatatttagataatggtaaaaattgaaatgatgataaatgctgtttattgcctacttgtgaaggtgtcaatgttacgttggtagagtatatatggaatcatttatatgatttacagtaaatgaaacagaaggtgaggtaccactttcagatgtagtacagttgtctgactcagattttagaaatctattgatatttttaaagcaaaactttttttaatgctttacatttgaatgatgttctttgtacttggatattgatcctatttctgattcagttttgaaaggaattaacatcaagtggacttcatgtcacttaacagtgcttttttgtatacatttttaaagaaaattagtcattttactttgatttttgagttagcaattcacaagcaggtaattaaacacttttagaagaaaaatattggtctaataataatcttaactcatctttttgacatagtaaagaaaaaggaactctgcagaagcaaaattttttagtatgtggcaaacaactaagcaactagatttttcttggctttcttagtattcttccatagcttgtaattcattaaacattcctattcagctttctatactaatttcatatatatatatatgtattttgcttcatgaaagcattgctgcttttcttcttcatcagtaattagtaaacttagcttcctaaccccttataacttatgccttattaacgatagtgaacataccagtaagcattgaaattagtgttactctgatatgtcaaactcattctagaagttatgcttttccttaccattactgtattagtggacgtcctgcagcctatcattctattgttcattaaatacagctaatgaaccttatttagagtaattgaaagggaataatagaagattttaagggaatgacattttcttccaggagtgaacttataaaatattgttatttgaaggttttctagggacttctttttagtaagtaaattagaattagccctttctttataaattaatgctgctgaaatgcttaaaatatacttaacttttaaaaacattatctttgattttatttaagtgtttaattggcattatctgtggaagaaatgctttattaactgagacaccactgtgtttctgatatacttataaaaaaactcatgaggttttattttatttttcaggttttgtaaatagatatacagggaaataattaaatataaagaagtagactatatttaacattaactggaatagttaaccagttctatctatacattagaatgttcatcttttcagactaagtttactgaaaagattcttgcattaggtaaattttagtagattggactaagttgagggagttaatcccttctgagcttttagaattctaaagccattgcatagaaactctctgggaaagacaaatggttaagatatgtagccacaggctcctgtttggatttgtattgacatcaaaaagaagatgataatgatggatcttacatgtttatttgaaggctctcagaaagaggatacattctagatttatcctttatttcagaaggtagcattagcaagtgggaagaggagaatggtgaaggaaggcataagtgggagaaagtggagaaggtgacaggtggaaggcagaggcaaactgtcttggaagcagcttttagctcaaattaagatatcttaaggggagaattacccaacaaaagaacaaactacttaatgcagtcatggggttttacttctctacagttacttcttttttaaatataggttgaagaaggaagtaaaaatatacggctaggttcactaattggtttgatagtagaagaaggagaagattggaaacatgttgaaattcccaaagacgtaggtcctccaccaccagtttcaaaaccttcagagcctcgcccctcaccagaaccacagatttccatccctgtcaagaaggaacacatacccgggacactacggtgagtatatatttattcaaaggatgatgtaaaaaaaaaaagttatggcagttcttatggaattgtaatcattatcatattcgcacatcgttgtacatcacgtaggaagttgctgttctcagcacactcagaccttagagtgtgtgtttttttttttaaccatcattgttcattcagtaaataaatagttactgaatatctgctatgttccaggtactctaaaagccctgcttgcacaatggaaaaccaaacagtatgtgtccatgttgaggttgaattaggttttagaagtctaaaatggtattcaatataccaaacttgatactctgttcccatttatggagttctaattactgttacaggaattccaagctcaaatgtctatctgatataaaatagaattcatgttttaacatgcattcgttttcaaactagtctgcattatgactttccggcacagactagagctcaattttgtctgttctgtaacaaaacagataacttaatacacatcatttcactttagttttacattgctttaatagaagaactctgtaaattctaacatttcatttatttagtattctatataattatacaacattactttttctttacgagaaaaagatcttcataaagtagacctcttcattcttaaacattttttcctttagtttatcattgtcagaaaagaatccacagtgctttttttaggggggggcgtgcggaggtgggtgacggagttttgatctcattgtccaggctggagtgcaatggtgcaatctcagcttaccgcaacctcggtcttctgggttcaagcgattctcctgcctcagcctcctgagtagctggaattacaggcatgtgccaccatgcctggctaatttttttgtatttttggtagagatggagtttctccatgttggccaggctggtctcgaactcctgacttcatgatccgcctgcctcggcctcccaaagtgctgggattacaggcgtgagccactgcgcctggcctgctttttgaagtactgattttaaattcctagtgcagtgtttctgactctgttgccttgactcccatttactgtctcctctttcatttaccctaaaaattggaagacagtctcactgatgctttctaactaatggtcttctgcccttgcaaagataataatagtatgtaccctaattaagatcagtcatcatcagagactcgcatgaatcaggccccactgtgtaggttaaaaacctactgacctgtgaactctgcatactgttgggcacacagtgaatgaaaaaaaaatttttttttggttggttggttactaatcctatataaaaatctaaaatttcagattctcttgaaaaatctaaagatttagtaacattgggcccatatcagagttatttaatacttccctgaaatgcagcaagttccacagttgtttctgtctcttagctttaatttctagatccagcctgttttaatctgtactaatcaggcttattttctttatctgaccatgtagtaatttgtttactactttgcatacaagagatataccattagtcatgtaatctgaggtatcctatatatataataaatatatataattgtgtatacatacaattcaacctcagcaaaacaacccaattaaaaaacaggtgaagaactttaatagcatttctcccaagaagatacatagatggccagcaggcacatgaaaaatatgttcaccgtcactaaccattagggaaatgaaaatcaaaaccacaatgagacaccccttcatacccttcaggatggctagtatcaaaacaaacaaacaaacaaaaaccaaaccagacccagattataacaagtgttggcaaggacatggataatttggaacccttgttgttgcctagtggaagtgtaaaatgctgcagctactgtggaaaacagtatggcagtttcttagaaaattaaaattaccatatcatctagtaggtccacttccagatatatatgcaaaataactgaaagcaaagactggaaagagatatttgtacatctatgttcatagcaacattattcacagtagcaaaatggtagaaacaactcataagtccaaaatgctatgaaatgtgattcagctttttaggaaggaaattctgataaatgctgcatggataaaccttgagaatattatgctcagtaaaataagccagtcacaaaacaaataactgtatgattctacttatgtgagttacctagagtagtcaaattgacagagacaaagagaatggttaccaggggttgggaggaaggaggaatggagagttactgtttaatagatacagagtttcaatttggaaagatgaacatttctggagatagatggtggtgatggttgcacaatagtgtgattgtactaaatgccactcagttgtacacctaaaaatgcttaaaatgataaattttaggtatcatttgccacaatacaaaatatatgaagaaatgatagaacaaaatatacgaaggaaacaattggtagttgtgatgagcacccatgtgaaagtaattagttgaaatagcagctctttcccctaattaatatttattcttattaaaatcatatttagaaatagtaactaaatttttacgaaagtgtttaaagaataaaataaaccaaattggtacagattatttgactgtgaccatctgtgggagtcattttagctttattataagatttttttttaattatttgcgaaactgttgacatttagatctatttgaatcaaatgtaagtgttaattggttctattaaccttcatatttttttcttaggttccgtttaagtccagctgcccgcaatattctggaaaaacactcactggatgctagccagggcacagccactggccctcgggggatattcactaaagagtatgtgtttgctttttgtaataaccagttccattatttattatgatcatgtttttttgaaagaaaataaaaagagcttattcagtcttaagatttaaaaggaggtacactgttcttcttttgtacttttaattgcttttatcattgtaaattgtattctatgcaagagttgttttctgaataattatagcattactgaagaacagctctaatttggtaactaagcaagatccttagaagtggtaataaatgcagaaaattagagcgtagaacagtgaaactttatacagtattaaatatgtgaaatcatgcaataacatttacatttctaaaacaaggaaatatatttttaaaaaattattttcattatccctttgaattttattcacttgtgctgttataaagcaatttccatatacagtttggtctctttttagattttcttttctatttcactgatccatctgtccatgagttagtaccatacttttttagtaccacacttttaattagaaatgttttattgtatgctttaaaatctgataacaatagctttgctctttttttaaatcagttttcttagttcattcttattttattattcttccaaatgaattttaagcagttcgtctagctccatgggtaggagtgaggggtatttttatgggattgtatcacattttaaattaactttgtgagaactgacatctttatcatgatgggtctttctgttctgcaacactggtttaaatgtttgtgtctttccattagtttaaatgtttgtgtctttcaaaacagatggcccctgttctgttgaaacttagtctagtagggtagacaaagattaatcaaataggcttatgaactaatgtaagatttcagtagtgttatgtgctacatttttattggcagtaatagtaaatgtttcaaattgagtttatgttttaaagcaatgtactcattccatatttatctaatattgataggaaataaaaaataatattggccagaatttttgtaagtcgagagagagcaatggttgttaaattataagtggcagtgttgggccaggcaatgttttcttttttccactgggttattttactcttcatgaaagctttggcttactgttgggtgtttattttattgaaagcagtatatagatttaattcttagatatcctcatttatgtgtattacactcttactaatttgttaactgaatgtatgtggttctatcacacacatactgtgaagttcgtgccacactgcatgagttggaaatcagctgtcctgagagctgactgaaaggcaacatcccagaccatgggatttttagttaaaggatttaaaagttacacttagctgtaaaaaattaaaattaagaaccttggttgccagttaatcccagttttttccccacaccaatcctgatttgtgtctactgttggtatcttaatcttgttagtctctaccagtctgtgccttagtagcactctctgtaaaaatgggagaaagcaactatttttataacaaagtagatttgccttgctcataattctgaggattaggaataagagtctgtatttaattcattaatctttgaggatttggtgaaatgtaaaataatgattgctgcaccttagggggatcagttctgcaaatttgtgtaagataaactggagcagaaaaagatgagataaggagataaattaataggctcctaaagtaatccatgtaagaggtaatgaatacttgaatgtggttagaagaactaaaagggagatccctgatacagacaacattgtaaggataaagtccagaagcctttgcagattaaatgtggagtgtaggccagagtagcaacaagtaagggaatgaatttggatctggtctaggtgatgatagtttggtctccataaatagaaataatggatttgggaagcatttgttttggtggagttagtaatgtttgaagcttattgtcaggacttagaagccatgtaggtattgggatcaatgagatgaagatgtatctcaggagatagttggggattagagaggtagatttggtagataataaagcaatagttataattgagatcatcaatagggaaactagaggttaaaatccttgagttggaggatacctgggaaatgtgggaaaagtcaaggatggtaggatctaagaaaagcctcttaaatttggtaatatggtgttcagtagtgtgacagcagtaaaataaagaaataaaggtttcttccttccttttctttccatgtgtgcttaatacatatatgatgcgcaaatatctttttttaaacctgagttgaaagttataatattaatgaaacatttcttaagaacaaaatggtattatctcctgaataccataaggaagcagtattaaagagttaggcttttagtattattgccatcttttctaccctgttacccttttctcttccctgcctttattccttaactctccacgagaaaggcatcagcctttggtcttcaaaataagaactagtacaaaagatttcatgagaaaaatggatcctgaaagcatatattattgaggatttttgcttttctatactgctaaaaatgcctgcattttaagtttatcattaaggtgagctttggaaaaaattttagcctaatgtcgtcttctgctatggttgaaaaattgcaggctttggcatagctgtccccaaaatatcttagcacacttttttattttttaacgttttgaatttttttttctttaagagagagacaggctctcactctgtcacccaggttggggtgctgtggtgtattcatagctcactgcagctttgaactcctaggctgaagtggtcctatcacctcaacctcccaaatagttgggactacaggtgtgccaccatgcctggctaaatttttaaaacagttttgtagagacggtttctcactaggttgcccaggctggtctcaagctcttggcctcaggtgaccctcccacctcagcctctcgaagtgctgggaatgcagacgtgagccactgtgcccagccaacacacgttcttgacacggtgaggacatgctccataccatgtccactaaaagtctgggtagaaaaatcagttccaaatgctgaaggaaatgcctccagcccactgtatttgtgaagaaaatcttgggtatcagggctgctattttaattttgccttaaaacaagcattgctcagaatacatgttgtaccaaagaatatagacttgactttgcttgtacatgtgactgttttaagaaagcagtgtcgaggccacaattagaagcagaacacatttagtttctttgcctgcagccccaatgtctttggtacatctgtgtcctaaatcatagttgtagtaatgtttgtattcatcacacagcatcaaaaattaggtaagtatgacaggcaagtgcctagtgtgttttagtggtattttcaaaatgaattcatgtcacacccaaatgaattgctctctcagggaacccagtagagaaggttgtacctgagttaacttccagagcatcctctgcctatctgcctatttctgccagtggccagaatgaatttgtgtggtatatttttctcctaatttttatagcttttaatgtctacctaatgctccaagtttagtctgattatttaatgtgcagaaatcattaaaaccattttctgcctcacaaaaaactaaatcattggctgttactaaacaataattaagatttatacttcataggtatgtaagtataaaatcagcaataaaaagaccaggtgcagtgactcacacctgtaatcccagtgctttgggagaccaaggctggcgaatcacttgaggccaggagtttgagaccagtctggccaacatggtaaaaccccatctctactaaaaatataaaaattagccaggcgtggtgatgcacacctgtaatctcagctactaaagaggctgaggcatgagaatctcttgaaccctggaggcggtggttgcagtgagctgagatcgcgccactgcactccagcctgggtgacagagtgagactctttaaaaaataaaaaaaaaataaaatcagcaatacaagtttttgtgagcaagaagaagcaattttgttcttgcttctttatgattaacctacccaagaaccttaattactacagagataaaactaaactgctttttaaaaaataaagtagcagtaatagttatgctaaatatgtaatattagcataactaatattagctattagcataactaatattagctattagcataactaatattagctagctattagcatattattagcataactaaatattacatattactaaatatgctaataagtaatagttatgctaaaaatgtgtcaatttagtgtcagcaaccttttttttaaatagatgtattcgggcattaacgatacagatttttgcaccccagttagactgttcctgcttgtgttgatattctattattgcataacaagttacagtaaacttaccagcttaaaataatacctgtttgttttctaacagttcaataggttagaagtcctggcatagcatggccaggttctgaactcatggtctcacaaggctgaaatcaaagtgttggccaaggctggggactcatgtgaagcttggggtcctcttccaagctcatgtggttgttgacagaatgcagttccttgggactgtaggactgtggcccttgttttctttctagctctcagccaagaaccactgacagctcccagaggccacgtgcagggccttgccatgcgtggtctccataggcggttcacaacatgcatgtttgcttctcccgggccagcagttttatctctttacttcaagtctcttcttccaggaaggcctaatttcttttaagagattacctgatatatctgccctctccagggtagtttgccttttggttaactcaaatgcaactgatttggagcctcatatatctataaaatgccaccaattttgtcacataataggacctaataatgggagtgacatccatcatattcacaggccagatacagtcaagagggatgatatggggcatgtacaccaggggcaggaatattggggccatctcagaattcttcctaccatgttgccataagtaaaggggtcttctcaaatatgctcaacaggtgctagcttttatctttcatcaaatttttggaaaaataataccaaaatattaactgagaaataatttttccttagattttgtgtcatcctgaagttctttttagattatataaaacaattttttttcttaaattggaaaaaatactttccaaaatacttattggatattaaaatgttccaaaaattattttaagaaaatatattgcctaataccactgtaacttagcatagtgagttgagggcttagcatatttagtaatctaattatatcctcttacaagacaaaaatacctttgttttacagagtaatacaaaggcaagtctgtaactagttatttttcattctaaaagatatcataggttagatttgttatattagattgtactgatggcatattagcaaaattaaaaatggtttgatttcctggtcataaataagctgatttgcactataataaacaatgaataaacaataagtgaacaatgatgtaggaagtatcctggtgaaagccatatttacaataaacttgacactttttgaatgccatgtgaatattatttcatgagtataaaggatgagagtggtttaattaattgttcatctaccaaataacgtccactgcacagaaaaaaagactaatttcctttttaaaaatcactacttatgcccaattttaataacattttaattgtttggcttttgaaaatatgcaaatattagaacgtgacaaataatggtcagcagaccaggtaagagacaggatttaattttctagctcaaattactggtttttaattataaccttgacatctgtatatttctgtatcttttctccacatctcacctgcgttttctgaaagttctgttatattccttattgctaattatggttatctactttgctcttatttccagggatgctctcaaacttgtccagttgaaacaaacgggcaagattaccgagtccagaccaactccagcccccacagccactcccacagcaccttcgcccctacaggccacagctggaccatcttatccccggcctgtgatcccaccagtatcaactcctggacaacccaatgcagtggtagtgttctctaagtggatttttatttctttttcttgtttttctttttttttttgagacagagtcttgcactgtcacccaggctggagtgcaatggcacaatcttggctcactgcagcctctgcctcccaagttcaagtgattctcctgccttagcttcctgagtagctgggattataggcacgcaccaccacacccacctaatttttgtatttttagtagagacggggtttcaccatgttggctaggctggtctcaaactcctgacttcaggtgatccacccgccttggcctcccaaagtgctgggattacaggtgtgaatcaccgcacctggcctagatttttatttttcagattcaagtgtgagagagaaaataagaacaattactatgtgttttaagagtagatttaaaacagattagttttattaatccgtttcaatagtagctaagtgataaggataaaacactccaaatgctttgttttacagatttcctatcagaaaccaaaatttgtttgtgtgttaacttccaaataaacattagaactataattcaatttaaagttaccacaagttccacaacttcagtaacatatatattctctacaatctcatgtttcatgtcttaagtgtgatactaataattagtagctgacactagctcccttttgtggatatgttctactttttaactagggaattgataatctcactatgaagaactatgtagctagtcattctttccttctcagatgcatgcagtataacagcccctttttgttttcaaattactccattttgcctctctgtgcctttcctattcaggttattttcttcctatcagaagaaatgtaggatagcccagtttatttaaaatcgaatgggcacttaaaaaaataaatagataaatgtgtactcctagtggagaactatataccatatgatattttaaaagagttgaaaacagtacaactttcatgggaaacagatttttaaatatccattaatgattaatatactgcatacttgaataacctgctctttaaggacatgcagttggataagatactatgtatattgagtgtatagtccactctttgactatataatgtatatggactatgaaatatgtataattcaatcatatgtcttttaaaagtaggttattcaaggctgggtgtggtggcttacacctgtaatcctagcactttgggaggctgaggtgggaggattgcctgcacctaggcattcaaagaccagcctgggcaacatagtgagacctcatctctacaaaaaaattttaaaatcagctggatgtggtagtgtgtgcctgtagtccaactactcaggcggtggagattggggaatcacttgagactgggaggttgaggctgtagtgagctatgtgcactccagcctgggtaatagaggaagaccctatctcaaaaaaaaaaaaaaaaagttattcaaattaaggaggtaaaccttactttcaaattcttatggtatgtagagagcatttattctacttgaccaagtactttgctaacataaaatgtttaatttcttaatgatatttgtaaaaatgaaatcagccgcactttcatttgctttgtattatcttgaagtgattgtaatgaaatcccaaaatagagtgaaggacaagaaaggaattagatataatttaaaatctgtcatgcttttttgagagatccaaggaacagaatggaaaaactacagtgaagttataggaatattttattatctcattcatactttctattatgaatctgtaagaaataagatactcatgttatttttaaaaattacaaatccaaatagaaataattgaattgcctgtatagaaggtccctaatcttctaatgtcccttgtgatttctttgatccatgagttgtttataagtgtgaatttaatttcaaaatattggaagacccttcagttacctttcatgatttctagtttaactccactgtgtttagagaatacactttgagacacacttcattttaaaacaatcttctcaaatttattgagatttattttatatttataacatggcctgtcttggtggatgttccatgtgtacttgaaaagatggttcgacttataattttttgacttcacgatggtgtaaaagtgatacacattcagtagaaagcagtgcagtatttccttgcaatgctgggcagtagcggctagccacagctccaagttagccatgtgatcatcagggcaaacaaccactgctctgcagtgtactgtgtagccaggtgattttgcccaactataggctaatgtaaatgttttgagcacatttatggtaggctatgctaaggcttacctgtgatgttcagtatgttaggtgtattaaatgcactttgacttatgatattttaaacttacgatgggttcatcagagtgtcacttcatcataagtcaaagggcaactatatattaatagttggtttgttgatttattggctgttttatttcaggtggttttttttcttttttttttttttcccgaaacaatcttgctctgtcgcccaggctggagtgcagtggcgcgatcttggctcagtgcaacctctgtctccccggttcaagtgattctgctgcctcagcctcctgagtagctgggattacaggcacgcgccaccacactcagctaatttttgtattcttagtagagatggggtttcaccatgttggccaagctggtcttgaactcttgacctcatgatccacctgcctcagcctcccaaagtaatcctgagattacaggtgtgagccaccgtgcccagcccatttcagttttattaagtgatatttgtaacaaaagctgcttacagatggtgtatgtctatgtctgtcttctctctcctctctctctctgtgtatgtatgtacacacacatatattgctccttgtgtgtgtgtggtatgtgtgtgtgtacgtatatatacacacacaaacacacctgtgaaggaattgttcattatttggtaggtttctttcttatcatcttaaatatagtaacataagatatcccattcacaattgaaacatgaattttattacttttttctgtagttatatgctataaaaccaaagcgtctcagattttttatattcttcccttatactaagaattttaatagtgcttttcttgtgttaatctttaattaataagttaggtcattgagaatgaatttcttttcatttataaagttgcttgttttttgttttatttttctattccacttgtggtttaacggacaggttgctgtctttttgcagggcacattcactgaaatccccgccagcaatattcgaagagttattgccaagagattaactgaatctaaaagtactgtacctcatgcatatgctactgctgactgtgaccttggagctgttttaaaagttaggcaagatctggtcaaaggttagtaaaattgaatttacttaatacaaaacacatgctaacttaactttcatgaaatcctttataaaattataaaattaaaagctacattgtgtagcttttaatttcaatttcataatgtacttgcactctactctgggtatatttgtgctagaggaaaaaaattagcaatggtttccttgaaaaagtgaattggttccacagtattaaataaatcacagatgcctttatgcagaaaaaagcattctgttctaccttgcttttatttcctctttgtcatatttgaataatgtacagttagttaacatttatttagcaggcaattactgagttcaattctctgttacatactgagctttaaaaatacaggttgagcaacccaaaaccaaaacttcaaagtgcttcaagatgtgaaactttttgagtgccaacatgaagctcaaaggaagtcctcattggagcttttcagattttggatttttggactagagatgccaaaacagtaaatgtaatattacaaaatctgaataaattttgaaatctgaaacacttctggttccaagtattttggataagggatactgaaatctgaagtactataatttggttggttagtttttttaaaagcaaaagtgggcttaatgttttggtgtgctttagcatttacataggtcaatttttttgtaagaacacatgaatgagttgtgtagaccaaatggttattttttgttttgaatattttttggtatggtatttaaacaaagcagtcaatatttcattaagtttaaaatccaaaacttttaaggatgttttagattataaatatcttatatattcttctttatacaaattttgattttatatttcttgttcagaatgcatttacagattattaaatttgtaatatttcttccaaaaatcaattataaataaggttgctgagagacatacagattttttagcatgaactgatagttttatttctttatttttgacctatatggcctttatattattttcttgtcttattgcactgactaggacctctgtctggtataatgaatatagatggtaaaagcagatatttttgccttgttcttgattttgggggaaaagcattcagtcttttatgttagctataggttttttgtagaatattattttcaggttgaaagaatttccattcctaacttgcagagagttttaaacatgaatagatgttgaattttctcaaatactttttgtgcatcttttcagataacttttcctttttctgtctgttaataaggtgaattacattggttgattttcaaatgttgaatcaactttgtattcctcatataaaatccacttaatgattaaccttctcatatattgtttgattctgtatcctaaaattttgtttagaatctttacacctatgcccatgagaaatgctaacctgtagttttcttttctggagacattttttcagatttgttatcttatctagtggaatgggttggaaaacatgtcctcctcctttattttctggaagagtttggatacaattggtattatttcttttttaattgtttagtagaattcactagtgaatttctttatgggaaggtttttaactatgaattttattttaaaaatgggtgcagctttttttttcttgaatgaattttggtagtttgtgtctttcaagaaatttgtgtcatctaagtcaccagatttattggcataaagttattcaccacattaccttattatactgtcattttatctgaagtaatgtttctgtttttgacattagtaatttgtgtgttttactctctagatcactctgactaaagggttatcagttctgttgatctcgatctcttcaaagaaccagcatttggttttattaacttatctagtatttctgtgatactgatctcattgatttctgttctttattttttttttctctttgctttcagtttactttgctcttttatttctagtttcttaaggtgaaaagttggatcatttatttgagacctttattttttaatataagcatatagtactcttgaattatctttaagcactgctttagctgtatcccacaaatgttgattttttttttttttcttcttgagacagggtcttgctgtgtcacccaggctggagtgcagtggtgcgatctcggttcacttcaaccaccgcctcctgggttcaaatgattctcacgcctcagtgccctgagtagctaggattacaggcacaaaccaccatgcctggctaattgtttgtatttttactagagacggtgttttagcatgttggccacgctggtctcaaactcctggcctcaagtgatccacccacctaggcctcccaaagtgctgaaattacaagtgtgagccaccacgcctggcattatttttccttttattcaattaaaaatgttttctcatttatttattttgtgatttctttgatcgatgagttatttgtaagtgtgcacttaatttcaaaatatttgagaactattcatttctcttttatgatttctagcttaactacattgtgtttagagaacacactttatatgatttcagttttcttaaatttgttgatatttattttatgtttgtagtatggtctgtcttggtatgtgttcttgaaaagaatttttttatttttgcaaaggaatgttctataaatgtcaggccaagctggttaatagtgttgtttatgtcttttgagagcagtgttgatattcctcattataattgtttatttgtggtttctcctttcagctctgtcggtttttgcttcatgtatcctgaagatctattattggccacatacacagttaggaattttgttttcttgaacagaccagttattatgtcatgtccttatctattccttgtaatattccttatcctcaagccttctttatcacatctgtagccactgcagatttctttgactcgtgtttctatagtatatctttttgcatctttttactttttaaatgtaaatatgtttatttaagtaggtttcttgaaggcagcgtgtagttggttcttgctattttatccaattctttagtctcttaagatgtttagaccgctcacatttaatgggatagttggatttaaatctaccattttgttctttctttgcattctctttgtcccacctcttttattcttctttccttatctttttggttacttattttgttatcattctattgtatttattcattttatcttcttttttctcttcttacctgctttgcaatggttttcttagggtttacaatgtaattctttaatttatcacggcctggcttcaaattgtattacaccccactccatgtttaatataagaacctcataactatatacttgcacttcctccctctcatattttgtactgctgttgtcatgttttacttctatatatgatgtaagccccagaatacatgtttaatgttttttgctttagcaaataaactcttttggagttttaaaatgagggaaaaaatgtcttttatatttatctgtactttttttcatttctttgtatagaattaaagtgctgtctgctattatacttctacccaaagaacttcctttaatgcttcttatagtacagattgactgacaataaattttctcagtttttgtctgaaaaagtctattttgtctttcacattgttcctttttaaaacaattttttaaagtgtagttgaatatataacatgagtcttaccattttccgtgtacagttagttcgttgacattaagtacatttacattgtttgcaaccattgccaccattcatctgcagaacgtttttcatcctgcaaaatggaaactctgtatactcttcattcctctttcccaccacccctgacaatcaccattcttctttctgttcctataaatttgatgattctaagtacatcatattagtgggatcatatagtacttgtccttttgtgactggcttattccacttggcattatgtcttcagggttcatgcatgttgcagaatgtataaaaatttcctttttaaggctgaacagtgttccattgtatgtatctaccctactttgttaattcatgtgttaatggataaatacattaggttgtttttaccttttggctattgtgaataatactgctgtgaacgtggctgtacaaatatctctttgtgtctctgttttcaaatattttaggtatatccccagaagtggaattactggattatatgataattctatttttaattttttaaggagctaccatactgttttccttagtggctgtgccattttgcattcccactaatggcgcaccaatgggtcaggcatgatggctcatccctgtaatcctatcactttgggaggctgaggacaggggttcgagacctgcctgggaaacagaacgagaccctatctctacaaaaaaattgaaaaactagtcgggcagatggcatatgcctgtagtcccagctacttgggagactgaggtgggaggattgcttgagcccaggagttggaggttacagtgagctataattgcaccacttaattccagcctggctcatagagcaagacctgtctccaaaaacaaaaatgaagtgcacaaaggttgaaatttctccacatttttgccaatacttgttattttctggtttttgatagtagtcaccctaatggatatatctttatcatttttaagaattatttttgctggatatagatttttcagttaataggggttttgtttcagttctttaaataaagatactatttctttattttctgtcttagaatgtctgctgccgttcttaatatttgttccattgtatatgatgttttccacctgtctggttgctttcaagatttttgcattaccaatttggctattgtatgcctagatttttttttctattgtatttactgtttgggtttctctcagcttcttagatgtatggtttgttgtcttcctttaattgtgaaaaatttccagttatttttaatgatatcttctgttccatgtggtttctctttggggctccaattttaaatgttagactttttgaattgcccaaagctcttaaatgctctattttttttgttcattcttttttctctttatgtttcatattggataatttttgtttacctagcttcaagttcactgatttcttagctgtgtctgcaaagcttagcaaaatatatattttttatcttggttagcatggattttcccctctggatttccaattgaatgtttttttagtttccatttctctgctgctagtcgccatctgtttatgcatgttgtaccatactctgccctctttactcctgtactctgacagtgggtatttacttcctgtgtttgtctctcctctgagtggattatcactctttggcattcagttcacctgtttgctttgtaacctccgctccctaatgagctcaagaaaagttacgattttgtaatttatcctgctttttctttcaccctgtcaggatgggaacagctttcttttgcaactttctacatcccaggtgaaagcaggacttttatcagtttatatacagagtttcaagatttcatataaagacaacttgagagcttttaaaagttcaaggaactaaatggaaagctattttaaagaaagtgagaagtttctaaaaaatgaaccctggaaacactcctgtagttctcagatcatacttgcttagtcatgatatagaggttaatatgggaatcactttcctgttttcttactctaataaggcagaaaacagtaatatttcagaggagatatggattagtttattatctttgcatggtccagttttggtacaccttggtaattaggaattttcttaaaaatctttacaccccacattatctatcttcactcctctttctcatataaagttacaatacataacattctgtatgcatgcttcacactttgcttttctgtcttgacaatgtgtaaatgagaatgtttgatattaccttacaaactgttttctactcagtaaatgtaacagcatctcctttcaatatgtttggaaaatctccattataaagagttaaaaataaaggaattcaaagagaaacctactttacacatgttagatttgagatgcttgtaagcgatgcaagtagaaatttcatgtgagaagttggatatacaagtctgaagcctcagtatctcagaattagaggtagaatttggaagagtcatcattatataaatggtatcaaaaccttggaattggaactggaacttctagcctggggagatgccaacattgagaggaaaggaataaaaatgagtgagtgggcagaaagtggaagaaaaccaggagagtatagtgacataggagccagtaaaagaatatatttcattcaactcaagaatgttcctaaatgtgggagtatgctgaatacagaattttaagtgaggactgtggacttaggtggtaggtttgggggtcattagctggcagatggttttagaagtcttcactgtgaatacctgtgggtaagtagataaagtgaagagaaagctgagagagccatgaaaggtaagcagagtaagttcatgaactgttacatttgaatttgtacaaaccaaatctttctatgtggttatcattaaaagcttgtaagcactgtaagtccatttatatttctattcctaaaggggttttaagcaaaaatgtttatatatttctggaattctgaattagaggagctttgatactttgcagctgacagttatcgtgacagtttgacagtatttaggtttatggtaattcatctaatccctttctgtagtctccaggatgcctttggaatgagctgttattcacctaaaattccgtgatactttagtaataggataggttttttgccacataccactgactagatctagatcttagagtctttttctataagctcttgcaagaaagaatcaagtgttgtttacattttctaacactgttatacccagtggcaaatgcaaagacataaacaaatactttagttatgatcagctcgtaggaagtgggaggaccccagctttatcttaaaatcattatgtatactggaaagaaattgattcaaatgcattcaccataaaactatggatggagaacctcattttattaatcacactaggacctatgccagcattgcttcatctttggcttttgttatatcctgttttgttaagttaaaaagcagttaaattttttttcacctacaccccattagtaaaaagaaattttcgaacactttcccatatgtgtatatataactgtttatatataaagtacctacatgtatcactgttctagtataatcagtatgttataaagcatacagagaataagggtatttgaaaagaacgaggaagaaaatgaatcatcttgtaaacttcctgactgcacacaccacagagagatcatttgtctttttcgagacataggagttagttctttttttctgattatgcttgtaatgggtccttcaggttcttgtgtatgatatctaagcaatttaaaaaattgataaccaaggcccagaagtaaacttacattcatggttaatattattgatccaggacctcatataatgcaagtttttctaatcatgggaaccttattgactaagcaaacaaaagcttgtaattttttatcattgtttgtcagtacattccataatttacaagtttgaagttgtaatggtcaatgttaaagttatattaggaatactaattttactaaccttatttttctttcagatgacattaaagtatcagtaaatgattttatcatcaaggcagcagctgttacccttaaagtaagtagcagacttcaaatgattttgtcttcttaagtagtttcatgtcgtggaatttttacaatgacaaatagaactcttatttttaaatcacaaaaattttataattgtcttgctaaaaatatcctatcgtttgatctccctcattttacaaatgaagaaactgtaaatcaaaagggctcacaatgaattagagcaggatgaaaaccatttattctaggcattagagatagagcagtaaacaaaagcttacttgatttctgctgtccctggggcttacattctagttggaggagacaaacactattatatgtcagatggtgaaagtgctgaggagaaaaagaaaggataaggggacaaagtaactaggggtgatttttcaaaagggaagcgagggaagcccctctgacaaggcgataatttagatacggcctgagaaaacagagggagtgagccacataggtatgtggtaaaagtgcattccacacagagggaccagcaaacaccaaggctgcaagcagaggatcgcattaaccaaagatgtggtgctgagggtggaatgtgcctagtatggagaggtgggagataagatttaaataacagtgggagagcatgaaggggaacccaagtacatgaggccttgttggacatggtgaggactagggattttattatgggtgagaaggaagcctttggagggttttgaacaaataactaatgtgatctgacttatacttcagaaacgaaaaggagaggctgccctgggtgctgtgtagaatgtagcctgtggagaggcaagggaggagacgatgagctcccctgggaggctttagaagatcacagtggcttggacaaatgtggtagcaaatggagctagggtgaagtggagatttgtgttatgtttcaaaagtagagccaacaggatttgctgatggattggatatggggtgtgagaaagagaaacaagcattttggcccaagcaatgggaggaatgagttttccatgtactaagattgggaaaactgggaggggtatagctttgggttaaggaatctagagtttggttttagacatgttacatttgaggagcctaacagatattccagtggaggtggcaggaaggcaggtgaacatatgagcctgcagttcagtggaggtgatgtaaacctagctggctggagttgtaaatctagaacccaggcttcctgccttcctgcctggcactatttttcatcatgcctcctttctgtaacgaggctattttctgggatcactgcttgttaacagactgtatttaaagtacatttataattaactttttatttcttgaaaaatacattaatgagggttccatggtgtaatggttagcactctgtattctgaaaattacattaatacagaacttaaaaagcatgccctttcagcagtatctaattattcatataacttttctcttttgatgaaatattttgaattatattaatgatttaattaattgactattattgtgattgatatcattaattgtgaatcatttttgcactccttaaataaatctctaatgggcataagctattcgttaatatttcattggataatgtttgtatccagagtcataagtagtggtaatttaaattttgtgccaacattatcagaccttttttccctaatcattggcttcattaaatgaatttggattatttcttcttttctttcctctgtacacatttcaatattataaatttttttatattttctagtttcatagaattcaccagtaaaaatatctgaacctgcttctattttgaggaggggatcttggcagctttccctttttttttttctttcaccataattactgatctgttttaattttcagcttttttaaaaaatcaattttaaaagcttatattttcccagaaaatcactcatttaatttagattcccaaacttactagcctagagtcattttgtttcttataattattttaacatcctcagtgcctggggttattctgacctctatctcacttctattgcatatttatatattcttagcttgtattgttttgttatgtattttttccttcatttccttagattcattttggtcagaactttaatgtgtaattcattttaattttttttaataaggtttaagatagtttcttttttttttttttgagcagcagcaagatttattgtgaagagcaaaagaacaaagcttccacagcatggaaggggacccgagtggattgccctaagataatagatttttaatgcaactttgaccgtgtcccataagtcttctttacattttgtaattaaatttatttgccatatattcttcattcatgagggttttgtttagtttctcttttactttagtgttgtctatgaagaatttcaaatcttctgagggtttgggactttattcttttaacataatgatattgttgaatgagtgaaggaactcagccttgaaagatggaaaaatggaagagcaattgaaaagcaatgtgaaggtagccttgcaatggaaatgagcgtagcatgacagtgagccaagtggaaaattcatctcaggggagtggtcacaagtaaaatgggatagatagagtggaatcaaattgtatattgccatgcttaaatgacataccaggaggcctggatctttttctttagaaaacaaagaatttttgagaacagaaatttgttttcagtttctgtttttcagcatcattttcacctgtgatacagggcaagattattaataggcagggtttccaggcatttcatcatttgatgaaatctttttttttattattattatactttaagttttagggtacatgtgcacaatgtgcaggttagttacatatgtatacatgtgccgtgttggtgtgctgcacccagtaacaagtcatttaacattaggtatatctccaaatgctgtccttcccccctcccccaaccccacaacaggcccgggtgtgtgatgttccctttccctgtgtccatgtgttcccattgttcaattcccacctatgagtgacaacatgcggtgtttggttttttgtccttgaggtagtttgccgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatatgtgtgcatgtgtctttatagcagcatgatttataatcttttgggtatatacccagtaaagggattgctgggtcaaatggtatttctagttctagatccctgaggaatcgccacactgacttccacaatggttgaactagtttacagtcccaccagcagtgtaaaagtgttcctatttctccacatcctctccagcacctgttgtttcctgactttttaatgattgccattctaactggtgtgagatggtatctcagtgtggttttgatttgcatttctttgatgactagtgatgatgagcattttttcatgtgtcttttggctgcataaatgtcttcttttgagaagtgtctgttcatatccctcgcccacttgttgatagggttgtttgtttttttcttgtaaatttgtttgagttcattgtagattctggatattagccctttgtcagatgagtagattgcaaaaatgttttcccattctgtaggttgcctgttcactctgatggtagtttcttttgctgtgcagaagctctttagtttaatgagatcccatttgtcaattttggcttttgttgccattgcttttggtgttttagacatgaagtccttgcacatgcctgtgttctgaatggtattgcctaggttttcttctagggtttttatggttttaggtctaacatttaagtctttaatccatcttgaattaatttttgtataaggtgtaaggaagagttccagtttcagctttctacatatggctagccagttttcccagcaccatttattaaatagggaatcgtttccccatttcttgtttttgtcaggtttgtcaaagatcagatggttgtagatatgccgcattattaaaattgacaccctaacattataactaaaagaactagagaagcaagagcaaacaaattcaaaagctagcagaaggcaagaaataactaagatcagagcagaactgaagggaatagagacacaaaaaaaccttcaaaaaatccatgaatccgggagctggtttttttgaaaagatcaacaaaattgatagactgctagcaagactaataaagaagaaaagagagaagaatcaaatagacgcaataaaaaatgataaaggcgatatcaccaccgatcccacagaaatgcaaactaccgtcagagaatactataaacacctctacgtaaataaaccagaaaatctagaagaaatggataaattcctcgacacatacaccctcccaagactaaaccaggaagaacttgaatctctgaataaaccaataacaggctctgaaattgaggcaataattaatagcttaccaactaaaaaaagtccaggaccagatggattcacagccgaattctaccagaggtacaaggaggagctgttaccattccttctgaaactattccaatcaatagaaaaagagggaatcctccctaactcattttatgaggccagcatcatcctgataccaaagccgggcagagacacaacaaaaaaagagaattttagaccaatatccctgatgaacatcgatgcaaacatcctcaataacatactggcaaaccaaatccagcagcacatcaaaaagcttatccaccacgacgaagttggcttcatccctgggatgcaagggtggttcaacatacgaaaatcaataaacttaatcccgcatgtaaacagaaccaaagacaaaaaccacatggttatctcagtagatgcagaaaaggcctttgacaaaattcaacaacacttcatgctaaaaactctcaataaattaggtattgatgggacgtatctcaaaataataagacctatttttgacaaacccacagctgatatcatactgaataggcaaaaactggaagcattgcctttgaaaactggcacaaggcagagatgctctctctcaccactcctattcaacatagtgttggaagttctggcgagggcaatcaggcaggagaaagaaataaagggtattcaattaggaaaagaagaagtcaaattgtccctgtttgcagatgacatgattgtatatctagaaaaccccattgtctcagcccaaaatctccttaagctgataggcaacttcagcaaagtctcagaatacacaatcaatgtgcaaaaatcacaatcattcttatacaccaataacagacaaacagagagccaaatcatgagtgaactcccattcacaattgcttcaaagagaataaaatacctaggaatccaacttacaagggaggtgaaggacttcttcaaggagaactacaaaccactgctcgatgaaataaaagagaatacaaacaaatggaagaacattccatggtcatgggtaggaagaatcgatattgtgaaaatggctatactgcccaaggtaatttatagattcaatgccatccccatcaagctaccaatgagtttcttcaaagaattggaaaaaactattttaaagttcatatggaaccaaaaaagaacccgcattgccaagtcaatcctaagccaaaagaacaaagctggaggcatcacgctacctgacttcaaactatagtacaaggctacagtaaccaaaacagcatggtactggtaccaaaacagagatatagaccaatggaacagatatctcttttaaatagggatgtcatgtattgagggcctgctgatatatatcccagagctgggctagaaagtaaggaataatgtgatctaatattattacctgtttccactctcctcctcccctcaagatcatgttcgttatcatatgaggtaggaagtacaacagacattaaataacttcttgcaatcaggaaagaaagccctttttccccaccatgatataaaggatcaaaacatgtacctcatcagaatttcttcaaacttgcttcaaaaaggtggtatgtttaattattcttggcaaacataaaagataattgacacagaactccataccattttttcaaacgaaatttttatttattttctcttatctagctatgttcactttggaaaatgcacaatgattttatttttctgtaaccgccttggtctaaagctgcttttttagtaacatttttctttttctatttctagcaaatgccagatgttaatgtaagctgggatggagagggcccaaagcaactgccatttattgacatttcagtggctgtggcaacagataaaggcttacttactccaatcataaaagatgctgctgctaaaggtatccaggaaattgctgactctgtaaaggtatgtcttaagaaagagtgtgctttcaaaatgttagcatatacttttggataattactttctgataaagttgtgacgtaatctagtcagactgtgatttttgtgtgtgtgaaggggagagttatttcatcaagtgattgtcacatatatataggtttttaaagtttttatccaagtatgacccattgtaagaaaatttaatattcaaaaattaagagataatatataaacaaattagggaacaacttcatgctaaagacaagctttattttccaaagtccagaattcagccataaagatgctatatcaggtaggttttaaagttgaagttaagctgaaactgtatttctatggacctcaatattaataacattttattcttaaagtgtatttacttcttctctaaaattgagaccattaaaagaacttagcggccaggcgcggtgtctcacgcctgtaatgccagcgctttgggaggccgaggtgggtggatcccgaggtcaggagattgagaccaacctggccaacgtggtgtaaccccatctctactaaaaatacgaaaattagctgagtgtggtggcgcgtgcctgtaattccagctactcgggaggctgaggaacaagaatcacttgaacccaggaggcagaggttgcagtgagccgagattgcgccaccgtactccagcctggcaacagaatgagactccatctcaaaaaagaaatggacgtaatgttccagaggcaaagttactttattttttcaggatttcttgaaaagcagtttttgtaactccaatgtgtaggaatcttatttcaccaaaaaatagtacatcgaataggcaagaacacaggcagtagggcagctttgacagcctcagtaatttccaagggtattttttgacagaagtatcacaagtcttaaagtgattgcatcgaaaatttctgattcatttgggtaagtgattatctttccatttgccaaggacctgttgtatgtatagtggtagaacaatttgtatatttataagggagatatgaggtagaacgtaagacttctttggggagccgacagtacataaatgtgtagaccttcttgctcaaaagaaataagtgcaagttaatctggttttaaaagcatacccataaatactgagtttacttggaattttagaggtagatataattaaaggtgaacctactagaatcaatatttttaggtctttcttccctcctctttgaaaagatttgcagaaagtgtttgatcgataaaaatgcaattgttaattgaaaaatgaggctgcacatggtggctcatgcccgtaatcccaacactttgggaggctgaggcaggcagatcacttgaggtcaggaatttgagaccagcctggccaacatggcgaaaccccatttctactaaaaatacaaaaattagctgggcatggtggcacacacctattatctgaactattcgcgtgacggaggcatgagaattgcttgaacctgggaggcagaggttgcagtgagctgagattgtgccatttgcactgcagcctggatgacagagcaagacactgtatctcaaaaaaaaaaaaaaaaaaagaaaggtagcgtttatttggtcagttcaaaagtcaaagtaatagagattggtttactgagatatagtatgttccttgtgtttatcaagggttttcagcgacaatgagaatatttgtgtctgtgtttttgtgaaggttaaatgagattaagtgttgaaacaacctgtaaaatataaagtactattataatgttatggaactttattgtagagctagaatttccttatttttatatacattaaattttaaaaattaaccattataggaagatttccttgattctgagcaatttaccaaatttactgctataatacataagtcgtaagtagttatgttagctttctctattccttgcatcctgaagactctaagtttaagaggtaagaacgcagtctcaccagcctctcagttgggcctcacagcaatgggaagggcagtcataccactttggagtgtagtggtctctggcgggccttgggcatttcctgtaacccccaacagggactcagggtttgctgagctatggctgcccgttagcttctcattctacctgcttctctttcccaccctgctctcttcactcttgttcttacgctatgccaggcactgggctaagtgcttcatttaatcctattaacccagtacaattggaaccttaacttctccatgaaattgaggagattcagttttagcaactttgataaatttgcccaaggcaatacagctagaaagcagtggcaatgaggactagttaacccaggcagtttgattctagagccactgcttaatgagctttctattataccacctctctccttgcttttactgtttacctttcttttttcctgtctaatcattcacttctttacctcccctttgtctttttctcccgcaaagttaccagaaaggagggtttggtttggtcctcaagtagtactttcttgtatgaagtactcttgctgggcaggtctgtcatgccaggccagtgtgtcacatggtacagagcataacaacctgatgaatataatcacctttggttgtactcggaaaaaataaggggacattgaagcacactgaggcctctcatgagaaacaggcaccttgcatggcctatttaacataatagttctgtagtttacaggagagagagagagcaaaagagaaagaaagtttatgtgtgtgtgtgtatgtgtaagagagagagatctgagctcctgcaaaattagttttttgttgaagtggtttatcttgtaagcatgattatcttaaaaacttaaatgttggattgtttaaacggtggcttaaaaactaaatattttagataggctctatagagatatgttcatttagctgctgtggatgaataggcattaaaaataagtatgcaccaagtagaaaccctgagtgtgtgtgtgtgtgtgtgtatgtgtgtgtgtgttcttcacgtccaatatagattttgactcaattccaagttaagcaagattatattgaattcagctttactgtgcaaaaaacagcatctgcctgagtgtccacgtatagtagtgagtcacctttggtaataaatgcattttctgtcctgtgctttaatgtggttatattttaccgcatcccccaaaaagggtagacagtaaatgttacatttatggaatagtagtgccattttatacagtttgagtctcgtcagtatttctacatcaagctttgtactatggcttatttaaaaagtagaatgtttatgtatttaaacagataaaatttagaatgattttaattccagggtaaaatctgctccgaccagagagaaaaaactaattcatatatgaatatagtatttgtaatcctcttgtttaaagacatgcaagttctagaagtatttgtactgcttaatgttttaacaactctaacaataatagcagcgggcatactttgtaccagtttttgctgtaagccttttatatatattaatcctctttaaaaccaccctatcaagtacaagataataatttgatatggttgatgaagcaactgatgggaaaaaagagaggttaaataatttgccccaaatcttattaagtgatgtagccagcatctgaacccaatcagactgtagactagagcctcctcccaaccactcagctttgctgcttcccacatactagttacataactactgtatgactatagaggtcaggttatcagccttctagaatcagtaatgttttctgtcaaaaaaaaaaaaaaaagaaacttgagaagcagctcctggattttcagaaattaacaagaagaatagctaaggactcaacagttataccaaatgcaccataattagttgattcaccaggtagaagaaaaggagtacaatcattggttttctgtgtctgtaagaccaatcttttggtttggaatttgaaatattggagttctctcttatccaaggtttcactttgtgtggtttcagttacccgtggtcaaccacagttgaaaatagatgagtactgtacaagctattttgagagagaccacattcacatgatttttagagttataattgttctgttttattattagttattgttaatctcttaccatgcttaatttttaaattaaactttatcataattgtgtatgagtaggaaaaaatagtacagtcatgcatcacagcagggatacattctgagaaatgcatggttaggcgattttgtcattgtgtgaacaccatagagtgtgcttacacaaacctagatgggatagcctgctacacgcctaggctttgtatggtacaaacctgcagtacagcctattactgtactgaatagtataaggaaatagtgatacaatggtacgtatttgtgtgataggaatttttcagctccattttaatcttatgggaccactgtcatatatttatgtctttgtcttaagtgtccttatgcggcacatgactgcatgtatagagttcagtactatctgccatttcaggcacctactgtgggtctttgaagtatcccctgcagataaggggggactactgtatgcaactgggagaaaaaaagggttaagaaagaagagacctgagtcaaacgggagagtactctgccaaagaagcagtgaagattccccgaggaatgtgaggttgtggtcttagcaagtaggcagtggataagagaacctgcagcaaagaaaccaaggctctctacctggtgaggcaggagtagtctttttgaaaagactgtgggatcatggacaggttgagctctggattctcactaagagacatactatccagtacacacttccctctgatcgtcacttggctggctttttttcatcattggtttctcagttcagttgctaatttcttaggccttctgcagcttctgtagctgaaatagtttcctaacactctttatctcattaccctgttttattgtcttcatatggtttattagtctttgaaattaccttgtttatttatttgttcacccttctgtgttccctactgtctgatgttcactgtccattgccatttatctaattctagaagagtgcttgggatacagtagttgcttggtgaatttattttaaaacaaatttcagtaaaacttgtttcattgaaattaatttttcaagagtttgtggctctctgcagattcatccatgaaccccaagttaagaatatctgtactacgcatttacttcttgaccctctgtaatcccaaggatgccactgtgggggctgtaggcataccccagccaagttcaagttggtattccttgaataaagtaatgtagtgacacaccttggatcctgtgttattcttaattcttcattacttataacagtattaaaaggcagaggcatagtttaccttataagtacccagtaaatttttttaatgaatagcaaggcattcgatgtattgtagaaatatttagtggtcattttttattctttcagctggatgcttcaggtaacatgtactttgattttgagtccacattgccaggagatcccagtgatgattacaaatttataaaaccaacgatccttctcagattccatacctatttcagacttactagagttcactgacaggaatttcctgttgatgtatttaggatctacagagtttttgtttttagtatgtgtgcgtgcaatctacttattaaagtgagtttttttcatttgtggtaattgtgtggtagttcatcaggatatgttgagatcatctgcctttaaaaaatgccttttaaagttcatatatgtgtcttttcaaatcatgtgaacaattacattgcttaagggaggaaaaatgcttttatagattattctctctcccgttattccaagaactgtataagtcaaaattcatctcattttttaccttgaatccaaatagttttataaataaccacatccaaatagcatacacctgtaattgtttctgttggcagtacgttacagtaatgtgtttttagatttttgatatttttaaagactttcaattttaaaaaattaaatcatctatgaattaaagttagttatcaactgtgattgtaatagtgcctatgttgcctatgtaatacaaaatattaagtaaattccacatttattttatctacccaaatgacagtgacctcatttttctgtacccttcctcttaagttaattcgttattaattttttatatatgatgactcaacctctgttcccttgcttttaagcactgaaaaataaaaattaacagaaatgtggttaattccaagtacaagtgagaggaaaatttaactaatatgtcatctgtcttgtcttctgtaagatttttagaaatcgctgtggtcaagagtgatatgaatcaagtacatccttatattccttgtggcagtgtaaattggactagctcattcaggaaatgatttagctataggatcaagaaccaaaagaagtctattctctagggcactataattccacttctgaaaatttacctgaaataattcagaagaaaccgtgaaccaaattataacactgggaaataaccaagtaaattaggcaggtgcagtctttaggaacaaacattaaaaaatcatttctgaaggctgacaacacagaagatacatataatattgaacaattaaatataaaatttattttttataaccattgtgtggggttgagattgtggataaagatgaagcaaactctgaaagataaaaacggaatgttggttgtgggattgtgggtatactactttggttgccattggataatttatttaaaacacacagattggccaggcatggtggctcatacctgtaatcccaccactttgggaggccgaggtgggtggatcacttgagttcaggagttggagaccagcctgaccaacatggtgaaaccccatctctactaaaaatataaaaaattagctgggcgtggcggtgggtgcctgaaatctcagctactcaggacgctgaggcaagagaattgcttgaacctgggagatggaggttgcaataggccataatcacaccactgcactccagccagggcaacagagtgagacttctcaaaaaaaaaaaaaaaaaaaaaactaaaaaacactagattgaccagaatggattcttgtattttttttcttaccataaagttttataggcaaaatagaaaatttcattttgcatataggaaactctaaagcattttgcataataattgatggtacacagggtaattcccacatttgaaaaattgttaaaggaagtgatttttctagagttttgattaacagctttagtttcttgaattatctgtgctcttgtttgttcttataattagagaaaattatttttatataggtaacaaaatcaaatcaaggcatatcagagatgagagtatatgatgtacaaatatttcaagtgacaagatcaactgtataacattttgttggttgtcctattctgtttgtatttttctcaggctctatcaaagaaagcaagagatggaaaattgttgcctgaagaataccaaggaggatcttttaggtaaaatttaaactcttaattatccatagcatcaaacagatagatgtaagacttataaagtccctgtcagcctttcatttatctgaaatattttttaaaatttaagctaaaaatactttatttagacaatagaatatctgaaaaaattcttcagactagtcaggctttcatattaaagctagtaggaacctattagtgttgaactaaacgttcgttggacattgactaacatggaatgataaatattatgtattctttagtatctgacccacccccaatattaatgtctgtaatattatattgctatgtgaaacaaccacttatttattattgcagcatataatattctattgtataaatataccagaattcattttactgttggtgggcatttgcgttgcttccagttcggggctattacaaattatggtgctatgaacattcttattagtgtcttatagtgaatgtatgtacattttttgttgtatagacctaaaagtagaattcctaagttagaagctttagcagctactaccaaacaattttccaaatggttatacaaatttacacctccaccaacggtcctgagaattcccattgctccacattcttgccactatttaataatgttaggttttaaattttaacaattcttggggtgtgtagtggtactctttgtaggaaaatgcaaattagtgatgttgagtacttttcactcatcagccgtttgggtatctggtaattcatgagataaagtacccactgcaatctggtgtccatttaaaaaaatgatgtatagttcttatttctggatatacagacctttataggatatatattgtttcaaatagctttcacactctgtgacttgcctttgggactctctcggtgatttttttaaatgaacggaagttctgagttttaatgaattcctatttatcagtatttttctttgtagttggtactgttcattttctgttaggaatttttgcctatctcagagtcatgaagttactcttctgtgttatcttctaaaagcatttacgttacttttcacatgtagatcacaattcaactgaaattggattttgtatataatgtgaagtttcaagtgctcttttttccccatatggatactaaatttacacagcatcatgtattgaatattgatttctcctttttcatagcattgaaaaggtgattatatatgtgttggtctagttctgtgctattttttttccactggcctgtttgtctatcctttgtttactaccaccaagctataactcttgatagctggtaatgaagtcttccaattttgttcaccctcaagattgtcttctggcttttcgtatttccaaataaattgtaaaattgatttgccatttttcacacacacaccccttgctggtttcttgattgggattgcattaagtcttttgatgatttgagaattgacatccttacagtattgagtattctaacctgtgaatatggtagaaaccattgtgtattcagttatttgatttctttcagttatgttttataattttctgtgtagaggtcttgtatatgtttcattagatttattctttggtatttgttttttgatactattataaatggtattgttttaaatttttattttctaattatagcaacttgtatgtagagtcatgtgccactttatgatggggatatgagaaatgcattgttaggcagtttcatcatgcaaacatcatagagtgtacttacgcaaatcatgcaaacatcatagagtgtacttacacaaacctaaatggtacatgctgctacacaccttagctgtatgatatagccagttgctcctagactgcaaacctatacagcatgttactctactgaataccgtaagcagttgtgacacaatgatgagtatttgggtatctaaacatatctaagcatttttaaaatgtacagtaaaaatgtaaaaagtaaaacatggtacacctgtttagggcacttaccgtgaatggagcttgcaagactagaagttgctctggaagaatcagtgaatgagtgaatgcttaggacatcactatacactactgtagactttataaacactgcacacttaggctacactaaatttatttttaaaataaagtaattgcaatatgatgttatgacagctatgatgccactaggcagcagaaattcctgagctccattataatcttataagaccaccgttgtatatgtgatccttcgttatgtgggacatgactcgatataaaatggattgttatattgaccttttatctgatgacttaactaaatttacttattaattttactagttatctatagtctcatttttcctgtgtacacaattaatttatttgtaaatactaaatgtttccttttttcattactcatatatttttttcttgccttactacactgcctagtaaaatatataaaatatgtgcttcacggaaaggggactttgattaaggacatgcctccttcagagctttttcttttccccctagtatttccaacttggggatgtttggcatcgacgaatttactgcagtgattaaccctcctcaggcctgcattttggcggttgggaggttccgacctgtgctgaagctcactgaggatgaagagggaaatgccaaactgcagcagcgccagctcataacagtcacaatgtcaagtgacagtcgagtggttgatgacgaactggcaaccaggtttcttaaaagttttaaagcaaacctagagaatcctatccgacttgcctagtcctcaaagataagaagttggtgttcagcttagttgattcagtagttgttaccaagaaacatatgttataggaaaacaacttggtatttaagtatgaagtggatgaaatgtttatttatttaaggtgaaagcatttgacccagggtgtcttcatcttcaatttgggtttaatgttatagaaataaatgatgataaactctaactaataaaggaaagagaatatttggttactcagatccatttttaacctctggtgctgtataaagggaatattaaactagatgtaaatcaaagtatatgtttggctcatttgagcattttggaatatttgagaatgtatgatacatgtaaaattaaaaaaactattagaactgtaccataattatgttgaaggtagaagtgatcttcaaagagatggccattaacttagcagtgggacctcacttttacaagcactgctctagatatacttgaagaatttaataggtacagaagtttattctggataataaataaataaggatcacactgtattaggggttatggcaacattattgaattttttatgtacataaagccatatgtttagggtggtttctatctgtcttgtttttcacttatataacactgtgaacttctaaagcaagaggataaaagaagcatgaatgaaaagaatgacatttcaaaaaaatggttcaatgaaaaactatagctaaaatatgtaaacctttctaggtaaaccgcttgccttcatcttgagtcggaatatatttaaataaattgtgttatctcttgccaaacattttgttagtgtttatttaaaaacaaaatgttgtttcttaatgcatttaaatcagttttgtattgtgcagtaaaatgtgagaaaatataaacatttctattgtattttaaatgttaaaacacaaaagttcaataaaccttgaagttgattagta

SEQ ID NO: 1391 - DNA, 79999 bp, Homo sapiens; identical to SEQ ID NO: 1390

SEQ ID NO: 1392 - DNA, 79999 bp, Homo sapiens; identical to SEQ ID NO: 1390

SEQ ID NO: 1393 - DNA, 181560 bp, Homo sapiens
cccggagcggcgcgggcggcctggagccccgggagcggcgcgcgcggtcccggcccagcggctctcctggcctcgcgctgcacattctctcctggcggcggcgccacctgcagtagcgttcgcccgaacatggcgacacggagcagcaggagggagtcgcgactcccgttcctattcaccctggtcgcactgctgccgcccggagctctctgcgaagtctggacgcagaggctgcacggcggcagcgcgcccttgccccaggaccggggcttcctcgtggtgcagggcgacccgcgcgagctgcggctgtgggcgcgcggggatgccaggggggcgagccgcgcggacgagaagccgctccggaggaaacggagcgctgccctgcagcccgagcccatcaaggtgtacggacaggtgagcagttttgcaacccgcctccctccagttttttcctctccctgcacttcctcacccccgcatccatccgttgcagtcgcctcctaggtgcaggcaccactggggacttcccggcttgcatttgtttttttccttcacgagtacaaccgtcagcacttgaatcgcattgatctttccttcttcctgtcgatttagtaaacgtattccaggtaactcgccgggtgcagtgcgtattaccccagggtgtgtgcagagagatgtagtttccggcaggtataggaggggtgcagcttcattttacatctggataaaaaacgggctttctttagtgtatcatcagttggcagtggaggcgagcaccctgcagttgcggtacacttacacagaacagcacgaggtgggggtttccacacttagcattattagcacaataaaagtgggcaaacctgaaagcttgtcgactatctctgtacagtcagacaagaggtgtgtgtatgtgtgtgcgtgtgtaaaggctgaatttttaatttttaatttttggcgagcgtgtgagatgctctccattccttcttccccacccttcaagatgctgactctcccacccccgtcaagataactttattttggagaggaatacccctcatggcacttggagatttgaaaggactgcaggaaatttggtgggcattattattctataagtgatttatttctacccaggcaataggtttattagatcataagtaacgtgaatttcacttttatggtcagacttactgcgaggaattgcagatggagtttgtaggttaggatcagcactggcaaaattaatttgaccgtgttattgcctcatgagactcccagtcctgcagttaagattgacatcagcaaaagtataaggtcggtgggggagaaaaagtaggaccagaggagggggtaaatacacttgttttctagagtcaaattgttccttttgaagtagaaattattaataaaagattaccctgagttctgccttttctcactaatttcactttagccatttcttcaggaaatacagagttaaatgttcaacccttggatccaggacgaaccttgtaaacatatcaccctattgtgtcattttgttggtgaagaaactgaagcgtggaatggtgaagtgactagtccaaggtcataccgggaaggtggcctgctctctagtttttgtctgcattgtctcagtgacctttgcttgactgcagtcaccctgtctttatgcaatgctgctgaaatacctcctttctaaaataaaatagatctggtataaagggggaaaggatggtggtgactgggtgggagcgttggatttccctccactattggtccctgggcaagaatgtgtgccccagggcatgtaactaatggtggccacaggctgcaggaacctgcatgctcagttcctcttgggcccagatccttgtccccctgtccccaccccatatgacaaatatgtgtatgaacaaaaagaagtcatcaaggtccttgctcttaacagcgacaccagcatggggctgatggagggtgggagaaggaggaggagtggcccacttcttcattgggcctccgcagtcagcccagctctgctgtgctcttgaatcagcattctgggaactgggagttgggggctggtgggagacaatccctcccagtgctcaggtcccctgaagctatagtttaggttgaggaaaaagttttctggtttcaaaaatatgtgtacatgtgccatttctttcttgggtttggtttatgaaaagctccaggggatgtggggcaggttggacatgaactctgttctcactgggagtgactcccaaaccctgggcttttgagtttctgggccagccagattgagtttggttcagctgaaggatggagaactagcagtcaaactcataatgaggaattcctaaccggagggtgagggtacaagggtgagatttttcttctctgtggctgccttcctatgccattgttgcctcttgctctgaggttaataagaagtggaattaatttgaatctgtaaggatttgagtcagataaaaggaagaacttccctgtactgggctttctgccacaagttctatctggtgcagacccttcagaatgcaagcacaggttggtgactgaaggggtttgaggtgcccctcttggaactctggagtaactaacatctatttggaatgatctttctagcaaggatgaccattgcctctgtgtttccctggggcagacctggtttctaagttgtctctggtggttatgaatagcacccccttcactctcaaaagtgtcaagatgtgacaataaattatatggtcctacttttagccttaagccaagttccactttgtaatcacgactttccccttcaacgtttaaacctaaggaatggtgatgttttccaacagtactgcttgacttgagtgtggttctatggaggtgcagtgagctggggaataaaatttcattcctgcttttaggaaatttacaatttaaggaggagagcaagcagatgcagatacaggcatgtcaatgtaccaggatgggaaccaggaaacatggtcacaagaaaccagccacaactctacaatggtgtgataacgggctgtgtgacatgcagcgcatgggagatggagagataaggggtggtgggctcagacactgtccagcttcttgccctctgacctttgagtgaggttaagaggacactggcagcacaggttagggctggaagcagaagctgcctgaaggaagcaggcctagaggcgatgttaaggccaccaccttcagggagaagagaagggaaggctttctaggggaatacttgcatctgagaaagagccctgtgctggagtcaatgtcggtcctttttcctctgcttcgctaatgtcttgggtaaactaggcttggttattttgaccattttcctcctcagtttctctaaggtggggagaccggcttctgccatgattacttaaaggcacatttatgatactgaaatgtgattgtaggggtgaaaataatttgctggcagatatcaggacttttctgcccatgttcaaggctcacgcctgtaatcccagcactgtgggaggccgaggcgggtggatcacttgaggtcaggagttcgaaaccagcctggtccacatggggaaaccccgtctctactaaaactacaaaaattcactgggcgtggtggcagatgcctgtagtcctggctactcaagaggctgaggcaggagaatcgcttgaaccccggaggcggaggttgcagtgagccgagatcgcgccattgcactccagcctgggggacagagtgagactccatctaaaaaaaaaaaaaaaaaaggcaaagtttagaagttgagccccttcttaaaggccaggtccaagaagagggattccctaattcatgccacactgaatttcctcctgatttctcataagctctgtctgtctgcgccatcatacctgctttttcctctgcctgaaatgatcttccccaactcttgtccttgcctgggaagctcttattccattctttaacatccaaggaatacctcttggtattctcaggctatggtgggaagagtttcttctgagcttggaggcagcacttactgccttgtgttagaattgctcaactgtctcatcttcctgtttgctccttgagggcatggatcaagttctcttgtgtttccctggcacttgggaggcccttaatgagtatttgtggaccagccacacacctggaagaagagaggcccagagggtaggaagcacattcacattatataaaatgtatttgtaaggaggaatacagtgaacccacacatggatagtgaaaatgagatggctcattcggtagtgaggatgcaagcggcatggcctacagatagtggagccctgatttgcctgtgctatatgggagttattttcaatgaagagcttggattctattttacagaatcctcccttttagggctatcattctggtttatgctaatggtattgttttggggaaaaatcctttggaataaagcacaaagcctaacaggatttacaggtttattttccttccaacaagctctctcttcataattcctacattttagaagccagggagtattcagtgtcctgatttgagactgaaaataaagtgtctattacagcacaaggccctgggacaaaaggcctcctttgggggtggaataccgttcagctttagatctcttttgagtagattcttccatgatacacttgcttgggaaagaattggctggttgattctgaagttaggatgtttgacctgtgtgcttccagaataagatgagaaggcaaagaatgtgctgcttcaggttggcttttatgtagctgaagagttgctcggggccttgggttggctcaataagggacgtgaccttgaaaagctcttcctggttccacttggcgtcttttcttagggagctctgtgcccagtctctggccgcttttagttcataaatagcttgcatggttagaggcacagaaggtggaggctttgcgagggggaaggaatggaggaaaggggttggtgagaagagtaaggaggcggaatttggagggatgaaataaaaagctgtctgattaggtaatgcacgtttacaaaacaaaatttgtacaaaagcgtatgtggtaacaaatttccttccctctcatgccccctgttcacccagagctcctttccgggtggcatccgttgttatcaatatttttgtatatctttccagaaacagtctatgcatgtacaacatgtatgtacataaaattggaaacttgaattataaatggcttcctgttacctgtagtccctggtatcctgaataatgagattaactttagctctaaattatatttgtgatattatgatggtgaattgttagaaaattacctgaagtatcataatataaaatagatgattactttttttccaggccaggtgagaaaaacctcattctcctttcacttcaagcgttcttgcagagcaggagagcagcctgatgtagcccccttgtaacttggagagatgctggagcacagttcccttgagatgtggagtccaggcttgtaagagcatcagaatacagtgatcatggatcttggttttaatttgtgttctgtctgagaatgttttctctatgttctgtaaaatgaagttaatggtatgcttaataaattgctttgagacttgggatccacgaggcagatccttatagcaacgaacatcccaaggcaaaaggtggatgttgtaggaacatttcattgtcagattttggtctgttcctccttagagatgacagccatcttcatagtgtcattgttgaatcccagggcagagatagttggagccagctttgttccacccactgtaatggagggacacagggggcagtcttatcataatctggagagcaggtaatccaaaaaataatcgatttgcttttgctatgtatttatgtagtcttttttttaaagcattcgtttaccttcctaattaagttttgctcaggtgaatattaaaatgagtttgcattctttgatctattgataagggaaatggctggcctaaatgtattcagggaaaggcagtttggagtttagaatttgcgacaataattcagatgcagataattgagagttgataaaaatgtattaaatgttttaaatgaataaaaatgtattaaaacctgggggcattacattgacctttcctccatttatttggatttaaataaatgtgatggaaagtaaaagagagctcactgcatttttggtttgaatattcagggattagtatttctccagaggtggtctgggctgtgggggtgaggcattctctgttgatgagcatgggactttcctatgcattttctaggtatgccagacactgttggcagatggtatagtcagtctagccacgtacatgcaaaaatcaatttccctcaatttaaaatgagccacagttaatttcgacctaatttattggcttatcgacctgtgaaccctgggccttcgaagaagtggcatgggcggccttcaagcgctgaagtggctgatgaagctaaaatccagaaaaggcagggtgggctgctgagcaagatcaagatttgagtttcctcctgtgttattgtgagatgctcagttttttttaactgtaacatgaccaatgctttgtgcattttatggtgggttccgtaaaaataggactgcgtaacgatcacaagtacactagtgtgttaaaaaataattacaaagttctgttatccactgggtaactgtttattataatggtaacatccatgcccatagcactgctactagccaagagctggaagatcctatcttcctggccgcgtcctggaccctccgatgtggcactgttcaatagatctttctgtgatagtgatgttttctatctgtgctgttcaccatgttcactagtcagatctggccattgagcaggtgaaatgtggcaagtgtgactgaagacttgaagtgtctttcatttaattttaacgaatttaaagttgaaatagccacatgtggctcttggctactgtgtagacagcacaagctttgacaaggcctcttcttcccacctgtaggcaacctctgcttcacccaagagagaagttcctgcaaagacctgctcgtgtaggcagggcaaacagggcaataaaagcaagagtggagggcttgggtctagaccctaggtattggtggctgctgactgccaagttgagtgtcaggagacagtggtccttctttcctaggtaggaactcaccagggggaccgtggagggccaagtgggtccggtggttggctctagggcatgcctctgcacagttgcctccttctgtcagtcacttagtcaatgaaggctggctattcatagggtgaaccagatctctgtggcttcacttctcatctggccttgcgcaaacactgcacttgtatcgggctttgctaaggtggagcgcagaccctgcacgttctgtttagcaatgaaagatgtaaacagtgccttaacagtggggccatctccctgccctgccctttgcttcctgtgcttttgttgacttaccttgatgtagctgggtctgtctttcttcccttcaaccctccagattggcatgaagacaaacactacaggcgtgtggtcttcatctttgcatataaacctcccccacttcttggctgaccttttaacttagcttgccattgctgttgctgctgctgcaggctcttagcttggaaaatcaggacccttcacaatgatttatctccagtcccctgaattagattcaaaacacagctacgaattctcagaaaggcaggctgatgtgattatatcccaaatctgagtggctgacaaggacaataaaaagatgtacctatatcaaatgcatttgtgccgtgtagagaccaatatgttgtttattatctccccccctttctgggggttttttaaatgaagaaggtaactgatgtgacctctattatttagaagagagactagcctgttgagtagaaaccctgggggaagatgactagggtgaatcttacatgaaataaatgtgggggtgaatcaatgggtgggccctcagttgggattttaatattttagggatactgagatgatttccttctgactttggggggctggtgagctgaggtgtagtgtcatgatgaattttttttttttttttttttgagacagagtctcgctccgtcacccagctggagtgcagtggctctatctcggctcactgcaacctctgcctcccaggttcaggcgattcttgtgcctcagcctcctgagtagctgggattacaggtgcgcaccaccacgcccggctaattgttttgtatttttagtagagatgaggtttcaccatattggccaggctggtctcgaactcctgacctcgtgattcacccaccttggcctcccaaaatgctgggattacaggtgtgagccaccgtgcctggccttggtgaaatttttaactctgtgcccagaggcattggaaaggctggtatgatctggttgagcctggagggccctgggttaagagccacctgtggagaaaggctagcttggggactgtggctgggaagactttaataggtacctgtgagatagcaagctatagggttaaggtcccagatagttaaggaccccatttctctattagcccaggagacacatgcgagacagttccacctgtctctgccccagggacctggggagaaaggccagtgctgatctgcccaaggatctcagccaaggagcccgagatggcagggagtggggacagagcagagtggggtgagtgtcctgtgaaaccagaagtgtttggaaggacttgcatgctttgaacctgtgctcaattaattgagtaacctgagactctgtacctatgacttacctcatctgtgtacatttagttccctgaaattctctcactgagtggttaaaaaaaaaaaaaatctgcagttaactgtgcacatggtttgctgaatttggcaaggtgtgctgttggtggtggtggtgatgggtgggctggagggggacggttactgcagaaacaaggccttcaatctctagaggagaaaaatgaagcagtggatgtggaaagttggttagaggtgaaagagctatctaaacagagctgggggagtttagctagcagaccagagcctgtgggacgtccgcctgttgcctcacctcctggtagcccagagggcatctcctattactgagaaattggccaagccatgggtttaatgcactcccccttctccattagtcttgtttatagctgccctcacagggtggtgaagaagccactggtagggtatagaggccttcggttctgggatgtaatgtttacatgcttttctcttggagttaggaaagtgctagaaaacagtgtcgcctctgggctggagccttgggacctggaggttgggtttccccaggtttcagagttcggctgggaatcaaggagaaaactgcctgtgagtttcagttaggcaggagctcctagcttgactcaggcgtgcagtgttttgtcattttatatatgtcatcgcttgctcttaggcctttcgctaatgttaatgttctatgtggagccgttttgtgaggaatggcttattttggttgagaggcatttggtaatgaaaagaaatgatgttttagtgcgtcgaagtttatgaaatgacatccacaggctgcatctcatttgattcttacgacaatcttgaaaaatggggaagataagaatgattattcatctcatttcagagatgagtatcttgaagcttgaaaaggtgaagtgacttacccgtagttagacaggtggtaaaccggagagaacaagactcaaaccaacccgctaacttgtttcagatttatgcaggcatatttgtctatcctaagtaatctagtgaaatttttgatctcaagcagggatccacagcttttttgcagtacttttttttctccacctttaaaacctggagatctcacataattccactttctcctggccacactgatcttgtaatttttcaaacacagcaagtctcaaggcccttctccttcctggcttctgctctgccctgccttaggtctgggtccatgttctctgcctcacttttccatccccttttccctaactcctccctcttcatccttatggtgtcagtacataggtcaggtcttcagtgaagcctcactctctccccgatatgaggttaggtcccctgtgtaacaacagtaattcaatcatcattcctggaattagttgtttaatgcgtgttttccctactatattcagagctatgaggcaggacctagaatcgtgttatttttctttcttttttattttttgagacagggtctagctctgtcgcccaggctggagtgcagtggcatgatcatagctcactgcggcctcgatctcttgggcacaagcgatcctcccacctcagactccctagtagctgggactacaggcatgcgccaccaggcccgtctagtttttgtattttttgtagagatggggttgtgtcatgttgtctaggctggtcttgaactcctgggctcgagggatccacccgccttggcctcccaaagtgctgggattgcagatgtgagtctgccattttactaacacctagtatagcatctggtatatagttagtgcttgataaatacttattgactgaacgcggtgaggggctattcatggtgaagctgcagagggcaagtctgtggtctggaaccatcctgaagagctgtgagaaatgactttgggctcacagggaaatcctcacgtagggcaagtcctggcttggggtgcgctctcttgagggggtatttgctgtgctcactctgactgtgtttcctgcacatggccgtgtgttttcaggcagtgagaaccaccacattgccttaaagtctgtctctgagcttaatctcatttgcaaaaggtggcatttcatttaattgttctctgagattctttctggctttgatattttcctcattttttttttgccaactggtaaattaaggggtgatattatgttcatgagaaagagagttttccacagtttctttttagtagggagcccctcccaaaacagcaaagcatattcgctcattgacaaagtgggttcaccaggacagagtggcacacagaggtaaacagtagataggttctcgctgccaaggatcaatcagaaagggaaataagctctctaaactgatattataaggcagtgagattatgattatcatccttttagcaaagagaaaggaaagggcatatgtgtatttttctctgtagaatggtcatggctccagtgaaggagatagtagtgaatgctaagttctagtccaaggttattctctccttgtttcctcatctggaaaatgggcagcctgaattcatcagcaaagtagttcaggagttctgtaggtgaagcatcttgagcaaactcaaaagtcaagtgagtgagctgagattccatgaactgggcctctcttccgggagtgctcgtaaactagatttcagctttccttctgaggtgagcagtccagggaggataataagcctgctaaatatagtgagaacacagtcttgaaaggggacagtgagaggcaatttgcatacctagcatttaagccatgcaaagggatggtttgggaaaaccttgttctccttggacctcaggaggctgtctttgacttcctcagtttcgtcatatagttcaggggagtgcctggctccttctgtcctcacagttgaaggacaggatatttgttttatgctatattgtagaattttaaaaacgcttctttgtatttcactgctagtgaagcagagaaatgaatcagactgccttatttgtcctccttgtactgcgttttgggaggaggctgtgtaggagttgtgaggactgcaagctgtgggagtctaggacatcctgatttttgggtttgaccaatttgaaagaggtgtagagagggtacctgtgacccattctattcagtggccccacctcctgcataagcctcaacaactatacagatttcggtggttttattggaaacttctcatcattggcttagacttgcaaccctaattcccccagaagtgctctgtgtgagctaacaggtaagaaatgattaaagagcctacagggtgcctggcacctagcagacctcagtgcctacttcatccgcaagtgaacgcatgagtaatcagtcccttcatccaagccattgacttcctcccctctatttataacaacccagaacttgaggactgggtggtagcaggtccttcccctcactctgaataataggaggtgaatcatttcacctctccgggttgccagggcacgcagggggctgagggacaacacttgtggggtgatatggacttgttcgatgaagatgccgaggcgagtcaaggtgtgggtggcatccactgttgtgagctggcggtggatgctagccttgggcctgcggctgtttctccagctggggacagggaggcctgtgcggatgctgtggctctgcagatgccgctgacagcactttgaaggattggtttggccagagacccagtccacagcctgcctcctgtatgactcattctagctgcatattttggtagcatgagggcttgagatgagataaaaggagcacttcttaagagtggaagctcctaggttcttgattagcacttgagaaatataatgttctctgcaggtcctagaggccttaaaaaaatttgagtatatttcacattacataaaattagccattttaaagtgaacagttcagtgaacttaatatcgccgcaatgttgtgctaccatgatttccaaaacatttccatcgctctgaaataaaaccccttacccattaagcagtgattccctcctctccaatctcccagcccctcgtaaccactaatcagctttctctccctatggatttacctattcgggacatttcatataaatggtgtcatgcaatcatgcaatatgtgaccttttgtatctggcttctttcacttagcatattgtttgtgaggttcagccacattgtagcatatatcatcagtatatcctagagttttaatgaccatcccaaatccccaaagacaagcccccccgccaaaaatggtacatctttctagctaccgtcatttagttccaactcctgccaggaggcaggggaatcaactagattcattgtttcccaaagaagctgcattagaaatacctggggttggggtgtgtctcctttttttttttttgagacggagtctcgctctgtcgcccaggctggagtgcagtggcatgatcttggcttactgcaacctctgcctcccagattcaagcaattctcctgcctcagcttcccgagtagctgggactacaggcacgtgccaccgtgcctggctaattttttgtatttttagtagagacggtttttcactgtgttagccaggttggtctccatctcctgacctcgtgatctgcctgccttggcctcccaaagtgctgggattacaggcatgaaccaccacgcccggctgggtgtgtcttttaaaaaagactgattcctgggctccaggcagagggcgacagagccggtaggcgtggagtggggcctcttaggtgattctgaccttcagtggggcatgggacccccctaggccaggtgatctttggggggtggggtgggaggagttatcttgactcttaacgacctgccaatgagccagatgctgtttgttgtttatgatgcagtttctgtgttcagaggtttctgtggcatgtaatttttctctgtttgccttctgaggggaggcactcggcccctccctgctgccttaacagctccaattaattgtgtctcatttatcaagctccagctatgccctgtgagctagacaggggagagggaaggttgttcacaccccggggttgtggttatagctgattgcacgtcaaggttatgttcctgggaaaaccaccctcccacccactcccaggccagtgtcttctgggtgtgggacctgtgtgggggattggcgatggaaaaaggcttggggaggaggaaaggggagatcagggggagatccttggggatggatggaaaaggaaccaaacaaaccggaagccactgattaagtaaagggatctagggacctgtgggttgttcttgattgctggggtctgccctgggctgctggtgtcttggccacatgccatggagagctagcaggaaaagcctgctttgttgacttcttttctttcccctgggggtgaggatgggggcaaggtggagacagaggagacaggtgaggccagagggtagaatgcatgtcttgataataaaatttacttcctgtcagcctgcctgctggctcccctgtcctgcgcgcatccattcctgattcctgcaactaggtctgctgtggggggatgggcacccgggctgccttggggatcagctgtgactcaccagggagttattcttatgaccaggatgtgcctgacatctcgccaagcaaaggagctgagctgttcctgcgagtgcctggtggccctcgtacaagtcatttcttgccagggattttatccccctactgggctgccccttttcagtctgctcttatgagtaaaagggacatctaataaaaaaagctttccttaaaaaaaagaagagaaagaaacaaagtaacaaacaaacaggtgttttaccaggcttgccttctagaggttttctttttttctttttttttttttttttgaggtggagtctcgctctgttgcccaggctggactgcagtggtacaatcttggctcactgcaagctccgcctcccgggttcacgccattctcctgcctcagcctgccgagtagctgggactacaggcacccgccaccacgcccggctaattttttgtatttttagtagagaccgggtttcaccgtgttagccaggatgggagtttttctttgtagaaaagcccttggatgttttgaggcttgcccttggtgctcttctcacctttcacctgccttgggattggtgaggaggtctcctgtcctctgagtagatcgatttcagcaagttatcttcagaccttttgcccactctgatcactgaaagctttgcaacctactcaaagcattatctgagtgttacctgccagagggagcattttgatgtcatctttgaggatgcccaagttgaatatttgaggactttttatcccagatcccaggggaacatgggtgattttttttttctaggttcctagtcctttattgtattgacatttgcatagttttctatccccactctggttcaagagtgcagatgttttgggaggggaggaaacttttagctgggattcccagggcacatgtgttgtgagtttctgatctccagatggatccaggggattgggctggagaggaggaaaagggaaggcttcagcgaccggaggagattcctttagctgctttctctttgtagcattctggattaaataatttatttacttctatttcttatttgcacttctctgttagtgcttgcctggacttctctatctgggaatgaggagagacattttggaaggacacatattcctaggtccttttctttaaagtaaggtcgcctttcaaatgtttttcaaaaagagtttgatcctggatcaaattaaatgcaggtatttaaaactccaagtaacgtcgttaaggattagctgctttgtccttctgccagccaaatatgtggcacaggtgtttctcttttccctgatgacatctgagagcacctcaaggagtgggtggggaaagttcgagtgtgctggggggaggaagcgagagaaggagaaaggagctgtgggttttctgccgcagagccttgatgagaagacagctcggagggcaggttggcccaggcttgaactgtcatcagtctaggcttactcgtgggtggggtggactgtgcgggctggagtcccagaagcttgatttccttccacgtgtgcctcagacagctgaggttgaggaggctggtggaataggcttctctcagacatcgctcagcaagagaggcagcctgtgatcctggtttcatggcattgtcctgcttctgagtgttggaccacctctcagaattttttttttgagactgagtcttgctctgtcgcccagattggagtgtggtagctcaaccttggctcactgcaacctctgcctcctgagctcaagcgattcttctgcctcagcctcccgagtagctgggactacaggtgcatgccaccatgcctggctactttttgtatttttagtagagatggggtttcaccgtattggccaggcgggtcttgaactcctgacctcaggtgatctgcccgccttggcctcccaaagtgctgggattacagtcgtgggccaccgagcctgaccagctctcagaatttttgttattcctgtcatgactttgctttccacagagtgggtggaatgtatggttcaggtgttcaaatgccagtcctcagacaggtgtccatcagccaacagtgaaataagaaaataaaagtaatgtagttttccatacagtgaaacaatggttctttattctgagatgatatgcttcctcagttttcagtgttaacacatctttgaaaaaatgacaatgactctagatagtggtcatattgccctgtaaggtgagctgcgtaacagacaaatcccaaaggctcagcgtgtggctgagttgaggctccgggttatgagaagttcaggatgagtgctactggttagcggaggtcttttccatggggatgcagcctccttccgtcttcggctctgccctcctctggggctttggagtcctctgaatgcggcctgcggatggggaaagaaaagaggactgcatgggggccaggccgatagtggccctgatgacttctctcacattacacctgctggaactcagtcccaggccacaccttctgccccacagcctggaccagagtctgcggtgtcctcaggaagcagaggaaagagattgagagagtagctagtcctgtttttgtgatgtccttacttggcagaatagaagttgccaaccagtcctctgttggccttcctcatttttattttatcggtttaccaaatctaaaagtctgagaactaaaatatttccttatttgagacctttcaaaaataattttgaaaagcttcacaatgatacttctctcatttctcattaccagctgaaagtgaatgacagtaccaccaagccagaaaaaacatagttggaacagaagtttgaaaagcatgtgatctttctggcctatgaattttttttgaacaagggcaatgtttccatgctttggtttaaaatcttaccagtgcatgtcatacatagagtaaggatcagagtaaccagagattggtatcataaaggatgaaaataatcaaaggaattggttatgccaatgagagcccaagaagcttttctacaatctctttacatccaaaatagcaggggactcatttctttgtggggaagttgagtgtgacagaatatgcatgaggtgggaggggaagaggccaccttggcccaaatgctttagatggcagaatcttcatcatttctgcttgacaaaggaggaaagagtcttgatttagaatgtgtgtggccatcacttatcgtgggtcctaattcctacattgatctctttcaggttagtctgaatgattcccacaatcagatggtggtgcactgggctggagagaaaagcaacgtgatcgtggccttggcccgagatagcctggcattggcgaggcccaagagcagtgatgtaagtgttgtgttggctctgggcacaccttggtgccatcaacatgcccttttctggtccactgggattatcatactggaaaaagtagtgggtaattggaacatggaatggatgaattgtatgacagggaagataatctagaaaatgatatatcccttgtttgctgaacacagggaggtgcagtcagtgttgcaaacagatccatgcaatgtgtgattacctttgggaagtaatagcatatggactggattgttgcatctgcccaagaaaataccagagtgccttcctgggcagagctgcctgcctgcagctgagcccgatggaatcaaattggcctttcccatatgctggtttcttctaacccattatagtgggatgagctgttgaaactgattctctaatattcttaatttctatagctgggtatttgtgatctttagtaggtgaggtactttgaagactcaagatgccaagggttataaactcaaaggcctgtgggaggccgggcaggtaaaggacaggagtgaagccaccttcaagtttataacactcttttctattttttttttgagttggggtctggctctgttacccaggttggggtacagtggtgtgatcttggctcactgcaacctccgcctcctgggctcaagccatcctcccacccactcagcctccagagtagcaggaactacaggtgcacaccagcatggctggctaatttttgtgcttatatatattttttggtagagatggggttttgccacgttgcctaggctggtctcgaacccctgggctcaaacaatccgcctgcctcggcctcccaaagtgttgagactacaggcttgagccaccacacctggccattacaacactctacctcctcagagaaatatggtttctcccatttttcttgaagtctgtggccttgttggacaatatatgtcatttccacttttgatggagatgcacattcaagaaacattctcccatatcttaatttgaacatactaatggatacttggttcctgtgttggagagacgtggggaaggggaagggcctttggggaccgggagaagcatgcttccgaggagcattgactgtcagctccaggctctggttgccgtgcaggatgctgggcccagtgttgccacatcttctggttttccagaggaacccagaggtctggagtttcatgtgaaaactgctgagtcttacaagttggcagccagtgtatagtttttacagacaccgcgtgagccaggtaaaacacatgtaagggccaaagctcgcccaacggctggtcccaggtctgcggcctgtgctctggactcctccttgtgggtgagaggagcagcccctgcctcagcctggggtctgacactgtggcagcgcgaggctgcagacggaacaccatgctttacagcttcggtcaccctgcattctggccgggggaaccttctgatgaatttgccagcactttcacactagccttaaggatacatttataattcttgaatgcggatttggtctctgtgaggtccctctctgtatatccactgtctgggttgggtgtgttgagaagcaggtgttgggaagttgtctcagggactgtttccagggagttgaattagggcagccacagaagggaagacagaagggctggctgtcaggatgcatgactttgcccggggtgggttctgagccatgctgtgtgggagaccaccgctactgatggccagtctgggtgtagtgctctggggcagggctagacttgtttggggcaatgactttggcccatttataaatatgatcaggttttgcaagtaaaagctgtggccaccacagacagctgtgtctgaatgcctttggtggccgggtgtggtggcctgctcccatagccccagctactcagcaggctaaggcaggaggatcccttgagccaaggagttcaaggctgcggtgacctatcttcgtgctactgtacttcagcctgagtgacagtgagaccctctctctagaaaaaataaaacaaaaaatagaaaagaatgcctttggccctgtgagactcttcatagacacctgtgtgtagtccctgcccatgggcatatccctcctgggcacaggagatatatatactgtgctatactgtgttgagaaatccttcttggaatttttatgcgtttaaaaaaactcttaatccagacaacattttttgtgaggtagataaagaccttaagcattgttttatagttttgctggacaaacaggagccaagaggtgtaaagagacttgcatgaggtcactcagcatgtcagtgggaaggtcggggctgatgagaatcaaggcccaatcatgtactcagtgtgcgaagatgtggtattagggtgaccaacttgtctaggttttagcactaaaagccccacatcctgggatcctcccttaattctgagtgaaccagggtggtttgtcaccctaagtattgccagtctattgaaacccaactcttgctctctctgtatatttgggtgtgtctaactaagagcccattgaacatgtgaagtgggatacactattgtggaatgaaatgggagatagagccgaggtgggcagatcacctgaggtcgggagtttgagaccagcctgaccaacatggagaaaccccatttgtactaaaaatgcaaaattagctgggtgtggtggtgggtgcctgtaattccagctactcgggaggctgaggcaagagaatcgcttgaacccgggaggtggaggttgcgatgagctgagatcatgccattgcactccagcctgagcaacaagagagaaaactctgtctcaaaaaagaaaaaaaaaaaggagatagattaaatgggaaggaaacgcaatggccagggttaataaatagggatggcagaaatggccttcctctctatacaaactgtgttaaaggattggcagatgcaagtgagatgcctgatgtaaaaagttaatgtgaaaagaaatgatgactcagaggcagtagttggggtaataacaatccaaattctctttaaagaagactgagcatggtttgtaaggtcccatcagcagtccagaagggaaagaacctaaacaaatcaggaactgtgtgggtgttggtgagcggccaaagtcatgcatattcagtatctaaaaagggatggctctggaagctggaatccagaaagtcttgctctcaaacggggaaaaaatgaatcatttatccactgatgaagttgaagccagtgtgattccatgaagagaacggctcctgcaggactcatctgtcctgtgataaatcaacaaaagaattaatagatgtttatctcaccttttcctaactctttgtttctgctctctcatgatgtattttacaaagtactaggtttacaaagtgctcaggtgcaacataattggctgaagagctgtccaggggtacagtccaccagaagatcagaatcaaccaggggctgggtgaggagtggctcatgcctgtaatcctagcacttcggaaggccgaggcgggtggatcatttgaggccaggagttcaagaccagcccggccaacatggtgaaaccctgtctctactaaaaatataaaaattagccaggcgtggtggcacaagcctgtaatcccagctactcagaaggccaaggcaggagaatcacttgaatccgggaggcggaggttgcagtgagttgtgatcgtgccactgcactccaggctgggtgacagagtgagaccctgtctcaaaaaaaaaaagaaaaaaagaaaagaatcaaccagggaagatactgtgcaggataggactttctgcttttgtccctagagcagtgtgacatcatgattgtacccctcaggactgactggggagcagtgtcagttcttgctaacagagggaggccgatgtctggctgagcacaggctctgaaatcagaacacctgggctggaatcccggatgtgccattcattagcaatctgaccttgggccaggtgatgtaccttctcttgtcctcctctgtcactgacatagtgcttgttaaaccttgctacccaaagtgtggttgtggtctgtggatcagcccttggggattttctgggagctggttagaaaagaatctcaggtcccatccggacttcttgaatcagaacctgcacttgaccagtgtcttgccggggccagggggcaggtagggggcggagagggggcagtctgtgggcatattacagtttgagaacattgctgtaaagtacttagaacagtgccagatatggggatgttttctgtacattttagctgtcatctgtttctcccctttctctccctcctctttattattacgtagttttgaggtacaagggaaagaattaaaaatcactcactttcaaggaccatctttgtaggtaaaaaaggatctaaccagaaaccgtgggcagttcagtaactcctcccctgtgctattttgctttttagggagtagcatcatattgaggtcagaggggactatttagtgcagaaatcccgtctggatgaaaaaccaactaggagcacaagatgagtgagtccggggtgttctctcaaattcacctggagatggtattggactgtgagtcagcagcatggtgctgccatgaagaaaagacagctagaaaggaaagcgcaagtcggggtggagccaccaatccgcttgagctaactgcacactggcagaggccttttctgggctgttcaatgtgggggaagatagataactgtgcaccagctttaagcattgtccttgttctatggagcttatagtctatgctaattaagtagaaataagaattaaggactgggtgcggaggctcatgcttgtaatcctagcactttggaaagctgacgtgcgtagattgcttgagcttaggagttggagaccagcctaggaaaccccatctctaaaaaaaatacaaaaatttagctgggcatggtggcgcctgcctgtaatcccagctactcaggaggctgaggtgggaggatcgcttgaacctgggaagattgcttgaccccgggaggtcaaggctgcagtgagctgtgcttgtgccactgtgctccagcctgagtcatagagcaagagcctgtctcgtcagaaaaaagagaaagaaataacaattatgaaggtaggataaaaatgtcatgttggaatttttcaacctggccaagggaaggaaagttgatgagtggttcatgatggccttcaggcataggacggactcttacatacttgcttttcacttctgttaagtagaagacccaaagagatggattttgtttgtaggtgagaattagggaagagctctttgatagtgaaggtggttttacctccatgtgcacgatggcagcggcatggctgagaatctcaggaaggctttctacttggttaatgtgggtcttttctctctgcgggccagcactccttccagtgcttggcctgtagacttggtataagaccttcctacttagcagagaaacgttaagatggagaagagaacattctcctagaggtaacttgttggagtagagagacaactggacgtggaattggaggaaactgtcatagttttgtctcttactagcggtatgacccggagctagccattcacttctgggaatcttagtttttgtttatctcttaaatggaaatctcttagtgactcactgattcattcaattcattcttttctattcatttatttatcacatttgtttatttgctctttggtttataatgatatttattcatcctagaaatctttgttgagcacctgctatgccccaggtacactgaaagagacaaaggtgagactaactccggtttttcagatgaagagagagaatgtttgtaaaggagtattacatactgaaaaatgctaccttaatgtaaactatcacctttgtgcccctgaagatatacgtggggggttatcaaattatgggatgtcagagctggaagggactttagtttccttcctgagaagccattattttgctccatgtgatgtttgaacctaaccgggacactaatgtccattcttggccggcagaatagaagtgagaaagtgctacttcgtcattttacccactcagattatctgtgaactctcagcctgcacaatttctgaagctgcttttgtggcagctccttactgtgtatctggtagttgggaacacatactgtgtgttccaatagcttcttcaactgtgactcagataaaggcagaggctctgtcttggcctcttctaaccttaacatctagtaagtattaaagacgtgcatgtgctctctgttccctttctacataccttgtgtttacatagggcattgtttgcagacatttacatgtttacatgcccatcgtgtctaaagactatgtcttttattagtctttgtctgtctggtgtctagacaatacctggctcacatggaaccctcaaaacatgtttgctgatgactcagacaagcaaggattggaatacaccctgctccactttgaattcacctgcccttccttccctccctcccttcctccctctctccctcccttctcctccctcccttcccttccctccctcccacgcttcctccctccctccctccctcccttccttcctcccttcctccctcccttccttccttcctcgctctgtcacccaggctggagtacaatggtgtgatcatggctcactgcagccggaaactcctgggcttaagtgatcttcacacctcagcttcccaactaactgagactacaggctcaaaccaccaagccaggctcatttttatattttctgtagatatagggtctcactctgttgcccaggctggtctcaaactcctggcctcaagccatcctctcacctcagtctcctaaagtgttggggttacaggcgtgagccactgctcctggcctcatttttctttaatgctcatcctaatccccttttccatgaatcatttgaaaaataactaagttattttaatatattcacctatcaggcttgtttttaaccccgtgattatattaattatttcacatctcacaggtaggtacatctcacagtattgtcacgtcactcagcaatctttcatttccatcttgggctacgtggtggagacccatgagagttttcttctcttttgtatggaatgctgtacaaacagaacttcccagaagaagaatgaagaattagatacgttttgggcaccattcaacagatggcaaaacaaatcctccgttccattcccctcagctagccacattctcccccttctggatgtaatttgttaaacactgaactcagccccggtgaggaggttattactgtttctatcatttgtctcctgctccagggacttgccttggcctcagaaaagaggcttgtgtattccaggcagtggggactgcaggggtcccatgctttctgcccccacatgcttggggacagacatagaggtgccctgcctcacctttgtgtgttatctggtaacatctgtcatttcctatcaggcacctaatgggagccacgttcaggatccaggatgggatgtttgaaagagatctttctgcttgggctcggtggctcatgcctgtaatcccagcactttgggaggccaaggcaggcggatcacaaggtcaagagattgagaccatcctggccaacatggtgaaaccctgtctctgctaaaaatacaaaaaaaaattagctgggcgtggtggcaggtgcctgtaatcccagctacttgggaggctgaggcaagagaatcgcttgaacccgggaggcagaggttgcagtgagctgagatcgcaccatggcactgcagcccgggcaaaaagagtgaaactcagtctcaaaaaaaaaaaaaaaaaaaagaaagatctttctgccagtttctcaccaactctttctttttcatctccttttctctgtattccaggtgtacgtgtcttacgactatggaaaatcattcaagaaaatttcagacaagttaaactttggcttgggaaataggagtgaagctgttatcgcccagttctaccacagccctgcggacaacaagcgggtaaggaagtggccatccctcctgtcccgacttcatgggactgggttttggaaagattgccgcacttaagggggtgctaggagatggcgctctctgtgatctttgtagcatgactggtggctagtgagtttttgtgctaacctgggcatttgtgacagactgctgttctcagggttggtctctgcacaatcaggcaggccaaggactggtcaggcaggatttctagacaaacaatgacaggttaaaccacagaaaatcagccaactcttgtaataccttgcccgacttgcagatggcaaaaatgtttcccaggtacactgagaataaccttgcaatcaaattcatgttttctaggatactatcagtgtgtctgcttgcgtgcttatgcgtgcttgtatgcgtgtgtgtgcatgtacgtgcttgtgtgcgtgtgagtacctgtgtgcgtgtgggtacctgtgtgtgtgtgcttgtgtgcatgtgggtaactgtgtgtgtgcttgtgtgcgtgtgagtacttgtgtggatgtgcatgcttgtgtgcgcgtgagtacctttgtgtgtgtgcttgtgtgcgtgtagttacttgtgtgcgtatgggtacctgcgtgtgtgtgcttatgcacatatgggtacctgtgtgtgtgcttgtgtgtgtgtgcagatacctgtgtgcatgcattggtacccacgtgcgtgtgtgggtacctgcgtgcgtgcgcatgcttgtgtgcacgtgggtacccacgtgcgtgcgcatgcttgtgtgcacgtgggtacctgcgtgcgtgtgttggtgcaaccctctgtcccccggcctctgaacctgtaccgatatggaaaagaaaaccaaggcagcagatattgctatgcctcctgctttgttttcccagctggctggccctgggggctttgtttcttcagttaggcaatttgatttgaggaagcgttgaccctgggcccccagggaggtggaggcgggagggcaggaaccgggcagccggcaaggctttcctgccagttgggtagctcttagctcggagagttgtatttcgttgctttcttccccactcttgtgttaccgtgtttgtttccaggccagatcttctacggaaagacccttagtagaaaaactaagagaaacattctagtagcaaaagctttctgctccagaaaggaacaagcaagcaagatctacagggtcctctttccagtccctagtcctggcttctcaggttgcttgaggtctcctagcaggggctgcattcaaaatatttagcgactggtgtggcttgggcactgaccaatcagaacaaatcctgtctggaggaggctgggtcctggacgtcccctgctgggccatgcattaacttttgagttgctgaatttcagggagatcctggggaagggaccacgccatgggaagtgttgtggggtaggcttaggaagggccacttaagggtttcagggcagcggctgttgaccaggtggtacagagcagttgttttttaacaactggaatggtcattactggtacatacttgttaaaatatcagctctgcctgatgatctcagagtggagtggcagttaggagcaaacttccctttcttacctaactccagggtgacagagtaatttttccccctgagatgaaaagcaaggagaaggtgttggagggaattggccccatagacgggtcagccagcctttgtgcccctttgccccaccgcacagtgtggtccccaggactcccagagaggggtgggccccgctgcttgccttgcctttggctcctccgtgaggtgaggagccctgaccagggtccagctcatagctgcctcttctgtggatggatccatatgcgccccgcctctcaagaatcaaattacacctgctgatgtgttgtatgcttggaaatgcagagtggattttgtgttctcacacaaaaataactatgagagggaaagcatttgttaattagccagatttaaccattaaacaatgtatgtatgtttttaaacattatgttctacatgataaatacatataatagtatgtctatttaaataattaaatttgaaaaaaactaatcaaatattatcataagtaatgataaaaaccacaatttcttttgcagcaaactaataacacctggatttctcaatttattaagttgtacttacctgatgctgatgatgattactgtatttacacattgtctcagagctcactcttgcggaggttgtggcctcgaaaatgccttgttgtccctctggaatctgtcttttcagcttcatctcctcctcctcacctcctgctgtggtgcacagatacctataggcaggctccatctcctcctccccagctcctcccctagtgcacagatacctataggcaggcttcatctcctcctccccagcttctcccctagtgcacagatacctataggcaggctccatctcctcctccccagctcctcccctagtgcacagatacctataggcaagctccatctcctcctccccagctcctcccctagtgcacagatacctataggcaagctccatctcctcctccccagctcctcccctagtgcacagatacctataggcaggctccatctcttcttccccagcttcttccgtagtgcacagatacctataggcaggcttcatctcctcctccccagctcctcccctagtgcacagatacctataggcaagctccatctcctcctccccagctcctcccctagtacacagatacctataggcaggcttcatctcctcctccccagctcctcccctagtgcacagatacctataggcaggcttcatctcctcctccccagctcctcccctagtacacagatacctgtaggcagactccatctcttcttccccagcttcttccgtagtgcacagatacctataggcaggctccatctcctcctccccagctcctctcctagtgcacagatacctataggcaagctccatctcctcctccccagctcctcccctagtgcacagatacctataggcaggctccatctcctcctccccagctcctcccctagtgcacagatacctataagcaagctccatctcctcctccccagcttcttccatagtgcacagatacctataggcaggctccatctcctcctccccagctcctctcctagtgcacagatacctataggcaggcttcatctcctcctccccagctcctcccctagtgcacagatacctataggcaggcttcatctcctcctccccagctccttccctagtgcacagatacctataggcaggcttcatctcctcctccccagctcctcccctagtgcacagatacctataggcaggcttcatctccccagctcctcccctagtgcacagatacctataggcaggttccatctcctcctccccagctcctcccctagtgcacagatacctataggcaggcttcatctcctcctccccagctcctcccctagtgcacagatgtctataggcaggctccatctcctcctccccagctcctcccctagtgcacagatacctataggcaggcttcatctcctcctccccagctcctcccctagtacacagatacctataggcaggcttcatctcctcctccccagctcctcccctagtgcacagatacctataggcaggcttcatctcctcctcccgagctcctcccctagtgcacagatacctataggcaggctccatctcttcttccccagcttcttccatagtacacagatgcctataggtgggttctgacttcctttctgcttgttgtgggttgtggtgaacaactgctaaggccacaagtctgaagagtcagaagacaggacagatgatgttttggacttgaaggaggagggttagtgcaggcagaggactggggctttggaagcactggatctggagaaggagcagagcaggggccgtggtgtttggggcaagagcaaggggaaactggagggtgattccagtaagggagtttaggtgctgcactgtggaatgggggtgacatgtttgcatcccaagtgctgtgtacctccgagtggtgtgtcttagattctcatgggtggatattctttggagttggtggggttggagaagtcaggagaaaaaaggctgccttcttggagaatttgttgacagttgggcctcaggcctggaacaggctgagtgggttggtgggggcagcattctctgtagatagtttctaattccccagagaaggctgctcctcaccaccccaccagactctcaggaaggaaatgatgactcttaacagtgctgattgcttctgttacttttgcctttgtcccctggaaggcaaattgccccaccagacctaccacttcctgagaaaaatcacacaaggctggatgccttgctgtcaacagcagggcgctctgcctaggcaaatcacccaggtgaaaatgcgagctgccaaggagcatttgaaatggtcgaaatgaatgttagcagctgcttggaaaggttaagatgtcaggaaagggcagcgtggatgtctaggagcatgagtgcctgtggaaggggagagaaggtgctagcgcggcatccagttccagtccgaaggctttgccttgtgatggagatggtgcttgtgggcccatgtgagttttgggtctatttctgcattagccagcagtcccacttccttcttggtctcctgtgtgctgccctgaaccattgtgcagtgctggccacatggcagttctgccaacattgtggggcccctgagattggtcagacagaattgaaatatgtttggcgctgttatttgcttacttaataatttttaaaaaatagagacaggggtcttgctctgccatacatcctgggcacaatcatagctcactgtaacctcaaattcctgggctcaggtattccttctgtctcagccttccaagtagctgtgactacgggccagcgccactgcatatctggggctttttaaaaaaggacactgaatgtacagttaggcctcacagcctcagcctcagcagaagcaagacccagtcctgcctttttccaggcagaggttggtcctaggtaaaatttcattcccaccttctagagggatgttccttcattgccttctctgcccttcctcctctcattgtactcttggtttctccacttgaaactggagaaagtcacttatgctaatagactgtggatacattctatagcttagtttgttttctttccagaggtatttgtattttcagaggaaacagcttttaaccaaaggaggaagctcctctggaatattaagttactgcaaacagggttggagagattggggtacacaaaggcactcctgaaattgcatagtttgggaagcaccttgtaggtcagctcttggtcagtctgtaggtttggcctccagtaaacttgacagccaggcagcacagagacttaaaagccagggtgaaatactgtgtcttcctaacatgtacatatctgaccctttgtatcacagcatgaggtaccatgtgctcaagtgatgaatgtaacctacaaataatagagctaggggaatcaaatgaggttggatcatagaagccaagtcttcatggggtacttaggatttgatatgagcttcaaggatggacatgtgaccccagtaagtagaggagagctgtcaggagccctcaagcaggagaagggcgtcagcagagactgcaaagtgccaaaatgtggtttctgtgcaggacagcgaggagattcactttttggtggtggagagcttgtattgagctgctgtgcaatgtcaaacaggcccgtgtctgaagatggagattgtcttctgctttgagggctgaacagagctaggaaagaatatttgagtaggggtgtaaatgaatagtgtcctttagggaaatgtgtcttctggcaatattcttgactttcccttttagcagggaaagattagggaagagtctagaaagggaactattgtggcagtgtaggcatgaagttgctcaatcaaacctggtatcaccctctaagtatttcatttaggccctggaagacatgaggatgaagaagacccattgcctgcctccagtttgtttagtctctagtgaagacgtgggccatgccaatagcactgagaggaaaaaggaaggcacatattttgagaaagattttaaaggaaaacaaaacaggtttggtggctgatagagagtgagggccaaagggaaggactggagtaaaaacccatctctgcttgtgagtagtggggctgggagaaggcatagcaggcaggagacttgggacgtggggagggagaattgggttttgttgggaaagttttgaagaactcaagttttgcgtatagtaaaatatcttggcccatcaaaagtggagatggtgagaaggtaaacaaaaatggaatctctgtaagaattgagggttagactgtagatttgaaagtcatgccatgcttcttcttttgtttttgagacagggtctcacttcatcacccaggctggagtgcagtggtgtgatgtcggctcattgcaacctctgtctcccaggttcaagcgattcttgcacctcagcctcctgagtagctggaattataggtgcacaccaccatgcccagctaattttttgtatttttagtagagatggggttttgccatgttggccaggctggtctcgaacccctgacctgaagtgatctgcccaccttggcctcccaaagtggtgggattacaggcatgagccaccccgcccggccccatgcttgttcttaagggcggtggttgaagctttgtgaaaggataagccaaagttagcagcaaaggatggaagaagaatgaggttatatgagcgtagggagtggggaggaccaaggagccagcagaggagaatcaaggcttgagatgatcaggggctggggatggagaggtgaaatgagagggtgctgtggattaggagagaaggcacacaaatgagttaaatggtacaaggtaagacctatgaatgaagttcaggaaatgttgccgttttgttaaaagagctgttaaggggtgagatgtgaacatgtgaaccagtcagatattgacgtcaatgctgcctagtcctgcgtcaccttgggcagtaaactactctcagtctcagtgtcctcattattaaaagagtgtataacggtaatatccaaagcattgagtcactgtgaaccctgaatgagatagggcatgccaaacttttagctcagtgcctggcatataggaagtgctcttgaaaacgtttagctattaccatggacaataatacattctatgacggggtgcgtgatttttggattctccaatgtgagactgcaggaagccatggaacagatttctggggaaatcttttcaaattgaggatgcttccttccccaataacctaggtggtttgggagcaggaagatggactatgttatttctggggaatacttttatgccagaaattatgatgatcctcttaggatcataattgttttttataacattgcattttattgtagtttttgctttcaaaacatttactaccttttccagtttgatttaatgaggcttctgcagagtttagagatttacctgagatgctggggaggaaacgtgagagagcgaatccacaaaatatgtccctgggaagtttatggtctggatttggggagagagtgcaaatgaaaaggagtgagcacatctgaaagcagcatgagacaagtgcaaagtgctggtccacaccgaggctgtggcactgaaaggtttcagagctggagattgatctgggtcaggtggagtccattcgagaaagtgtccttgggcttatcctgcaggattgcttgacttctaggatgtcaatgactggctgtgggtagaactaggtccctgttgctctggtttctgattcataatctcctgagccttcctcattcttccaggagcagggaccggcctccgggtcttgccaggtgtgcatgcgaggccttacatcatctgtgcttcccagccttgttttctggttatttctctcaggccctcaagactgtcactgggtgcagtggctcatgcctgtaatcccaccactttaggaggccgaggcagcctgatggcttgagctcaggagtttgagaccagcctgggcaacatggtgagactctgtttctttctttctttttttttttttttttgagacggagtctcactctgtcgcccaggctggagtgtagtggcacgctcttggctcactgcaagctccgcctcctgggttcacgccattctcctgcctcagcctcccgagtagctgggattacaggcccccaccaccatgcccggctaatttttcgtatttttagtagagatgggttttcaccctgttagccaggatggtctcgatctcctgacctcgtgatccccccgcctcagcctcccaaagtgctgggattacagccgcgagccactgcgcccggcggtgagactctgtttctacaaaaaatacaaaaacttagctggttgtgatggcacacacctgtagtcccaactacctgggaggctgaggtgggatgacctcctgagcccggggaggtcaaggctgcactgagccatgattgtgccactgcactccagcctgggcaacagagcgagaccttgtctcaaataaacaagactctcatcaaacccatgctatatctcttttccccctttgtgcccaaacccacactgccctagacgtggaatattctttccctgtgggagtctcacctgccctgcgaggcccacctcttccatggaatcatttctcatctctcagcctggagaggcactcataggactctggtcatggcttctcattcagcctcactttctcttgactgatggttagccctggacatgtctgtctcccatgttagattttgagctacttgagggaaggcatcttgggtttttgtggcagctcctgagcgtctggtccgtggtgggaatgcagcacacatgtgttaggttgaattgcctggatccttctccccagggaattctttcagccgcagccactatccagcctaaattgttcagattcactcatccacacagaagctaagtaggatgaggcccgtgctcaccagagctacttactgctctgccccagagtgagcctgccagccacagtggcagcctggtccccagagctgccgatcacctggcatagcagcacgaaggagaagcttatcttcttagatggaagtgattttagtgcttttcctggaaagccatgtcccatagctgcttggaggatgcagggagactcaaccatcccatctgtgttagccaatctgaaaagtagggcgtctgtgtcccagatgccagtaactaccctctggttgtgactgagtgacccactagggagtgggaattgctaatttcattgaaaggaaacaacagaaaggcccacttcattacctggttaaacaagcccaccttgtagcttcatcccggtccatctccaggcctcctttcgctgagccttgtttggagtatgccagtgtctttttattgccaagagatggggagaaagccattgtggaagccctgtaaggctgtggtgccttgttggtgccagctggcccctgcacatgtgtgtactcgtgtggactcgcacatggtttaggggagtgttgggcagctctggacagggcctgctctcaacttacctgttttcccttgcagtacatctttgcagacgcttatgcccagtacctctggatcacgtttgacttctgcaacactcttcaaggcttttccatcccatttcgggcagctgatctcctcctacacagtaaggcctccaaccttctcttgggctttgacaggtcccaccccaacaagcaggtaagagggctttcagaacccagttgcatggggctcctctagttttctcctctgcctgtgtggattgtgtgtcctttgagtgacctcgcctcctgcctctccctccttctctcttgggcctagcctttgtagctactatttcacttaccagggctcaagaaaaatatctcctcctggcactctcagttggcagcccagccagccatcagcacccagcacttggcaggccctgtgagttaaacatcatgcccttctccatgcagttgcacctttgttagcccttggggtaaatcgaggctctggaatttaatcagagagagagccaggtggagaaagctggaatctgagctcttcagggaccttttgttgaatttctgttctgctttctccatcctccatcttaaacactgcttttgcctcccatttatttgaagttaccactaacagtaatagtcttccttcgagtgcgtgcgtgtgtatcatataaatgtgtgtattttcctccttcaacccaggtttgaaggaaatctgagagatgaggaaagagcctgagtaagacttatatctcaaggttgaagcttgccaagtcaaggatattagtttggcaaaaatctgtgaaacttgtagatcctgtatgattggatttacagtgagccttgaatgtttttgctcagagaaaccttggaacgtttttttgcaggttgtttaaccaaaacacagatctgtttacctttgcttgccttagggagtaacctaagtatgggctgggtcagtttaccagcggagggggaattattgttactttgggtctcctgcttcttaatacatggttgctagggccggaggaaccctcagattccatctgtggaagttgaggggctttggcaaagatcagcaggttaattcctcattgccacagccgtgtattcagttggttctctgtggggctctgtacttagctggtgtcctctgcattcatctttaattatcagggcccattactgttgttttcttcctcttttttgtgcgtgttaaaatactcataacgtacaatttgctgttttgacccttttaagcatgcagtgtagtgatattgagtatattcatattgttttgcagccatcaccaccatccatctctagaacacttttcatcttgcaagactgaaacgctacacccatgaaataatacctctctgcccccagcccctggcaaccaccattctactttctgtctctatgcttttgcctactctaggtacctcctaagtggaattaatactatttgtcactttgtgatggacttatttcacttagcagaatgtccttaagattaatccatattgtagcatgtgtcaatttttttctttttaaggctgaataatattccattgtatgcatagaccacattttgcttatttgcttatccctcatggacacttggattgcttccacattttagctgttgtgaataatgctgctatctgtgaaaggtttttaaggacactgtttcttcgttgaaaagtgctgagtataatcatcctttggtttttaccattacctagaggctagtcttgagtgaaatataatttttggtaatccataaatggaaggcaagtcctactcatttttccttccagttgctattgagagaacacataggtacacagttgtctttcctttcttgcccttgtttgcttttggagcaactgagctggctttggcagtctcagtgcctgccttcacagacagcgtgtcatggaaggtgggatttcagcgggtgtttgatggtgatgccattcaggttgtattatacatgcctcttgcatcatgaccacttgtctttgcagctgtggaagtcagatgactttggccagacctggatcatgattcaggaacatgtcaagtccttttcttggtaagttgtgtcatctaagaaatcttgatatatgtaacctcctttctccagttctagctccttcttggtggacaaactgccctcccctgaaatgtccagcatttattcaggaaatacatttttccagatctgagaattagagctgcaagtacaatgatctcactgtgggagagagttggggggaggagaaagtaaggtatttatgagaggagtggtagagcttttgcatttttcaatcaatcagggaacccaggggaatcttgaggcccttgcatgtttgtagagtttcatttttagagcatcatattagaagtgggagtttttctctatataaaattcatgcatttcgctgggtgcagtggctcacgcctgtaatcccagcactttgggaggctgaggtgggcagatcacctgagctcgggagttcaagaccagcctggccaacatggtcaaaccctgtctctactaaaaatacaaaaattagctgagcatggtggtatgtgcctataaatcccagctacttgggaggctgaggcaagaaaactgcttcaacctgggaggcagaggttgcagtgagccgagatcgcatcactgcactgcagcctgggcgatacagtgagactctgtctcaaaaaaaaaaaaaaaaaaaattcctgcatttgttcataacattttcttgaatgtctgttaaatataaaacctactagattcttaagggtataagaaattgaataatttatggatatagttattaaggagaggtaaggaaagacatttcaggtacgtaacacacattgtgaaagaggcacagaggtaacagacatagtatgagaagctagagagaggatttatccttccagatgggaggatcataaacagctgtgtagaggaggtggcccttgatccaggatgtgcacaacaggtaggatgtccctgtgtggaggtgtggaggacaggaattccaggcagaggaacaaagtgacttgccaaaggcacagggatgcgccaatgtggtgcttgggtagagaacatgaactcttaattttggacagtgtattgggtgaagttttgaaagggaagttggtattagaatctgcatcgcttgataaaggaatttgggctacattctgaaagcaatgaggtacccctgtagttttgtgagaagaggagtgaaataaacaggctgtacttcaagaagtacttctagaagtaaatagtaatatacttatcgtaatttactattacagtgataaagtagtataggatcttgaattatatgaatttgtacatgtgcaggcaaatgtgtaggacagatttctaggagtgggtatgctgggtcagtgggtttatctaacagctatccattcactcacatggatgactgatagatattgcaaacttgacccctcgcaaattgactcttgatcttcaccaccccaaatcagctccacctataacttttctcatttgctcaggccaaaatctttggagtcatcgttgatttcacatttgttttatgctttacattcattctatcaggaaatcctattggcttcaccttcagtatatatctagaatcttctactcaggtaccacttctagtgccagcctccagtgtcattgctcattagtctcccaactagtctttctgcgtttactcttgtttttctatcattaattctcagcatgtggtcagtttgagtctattcaaataaattagatcattttgttcctctgctttgaaccctttaatgcttcatcatttctctcagattaaatgtcagataccttcttaccacagggaacaggatatttgcaattgctgttttctctgcctaaaatgctgttaccaaagatatacttactgcttactcccttacctcattccagtctttgctcaaataacatcttctaaatgaagcccacctcatttatgcccaccttaggatcctatttaaaattgcacctggccaagtgcggtggctcatgcctgtaatcccagcaccttgggaggccgaggtgggtggaccatctgaggtcaggagttcgagaccagcctggccaacatgatgaaaccccatctccactaaaaacacaaaaagtagctgggcatggtggcgggtgcctgtagtcccagctactcgggaggctgaggcaggagaatcgcttgaacccggtaggtggaggttgcagtgagctgagattgcgtcactgcactccagcctgtgcgacagaccaagacactgtctcaataaataaataaataaataataactgtctcaatgaatgaatgaatgaatgaataaaaataaaattgcacctactcccccattactcccaatctcctgtactgtgttctgttctgttttgcagagcactttaccacattctaatatactattattatgcttattatttgtctttctcccttcaatagaatgaaagcttcccaagggcaaggacttttgtaagttttgtgcactgatatatccacagtgaataaatccttaaaattgtaactttggtagagagtgccagatttgatatagaaagtgtcaagtttgcactcatctcaacaatatagaatagtgtctccctccacagccaatgtgttagggaagaaatattatctctgtggtttaatttgcattttccttattatgagttagaacatcttttaatctgcttaagggtcatttttttttttttttgagacggagtcttgctctgttgcccaggctggagtgcagtggcgtgatcttggctcactgcaacctccgtctccagggttcaagcaattctctgcctcagcctcctgagtagctgggattacaggtgcctgccaccacgcctggctaattttatttatttttattttatattttttagtgagagtctcactctgttacccaggctggagtgcagtgacactatcatagcttacagcagcttcaaactcttgggctcaagtgatcctcccacctcaccctctcaagtagctaggactacaggcatgtgcagccatccctagctaatttttacatttttttgtagaaaggaggtctccctatgtttcccaggctgatctcaaacacctggcctcaagcaatcctcccaccttggccttccaaagtgctgggattatggtttgttttatttatttgtttgtttgtctgtttaagtatgaccaggctggagtgtagtagcgtgatcttggctcacagcaacctctgcctcccggattcaagtgattctcctgtctcagtctcccgagaagctgggattacaggcacccaccaccatgcctggctaatttttgtatttttagtagatatgaagtttcaccatgttggccaggctggtcttgaactcccaaccttaggtgatccacccaccttggcctcccaaagtgctgagattacaggtgtgagccaccgtgcctgatctcatgcctgttttctatttgattattagtcttttcattgttggtttcaaggagctctttatatattcgagattagccctttggctgtgatatgagatagatcgtatgtgtgtgtatttatatttctatctcctagtttttcatttgtttttagacttttacttgtaattttagtcctcattaagtgtaatggtcccagaagatgtagatactgcctttgtttcttttagttctccatgtaaagtgaaatgtcttttagttggtattgcttccttagtaatagaggtaaagatggagctggtatgttgaggagccttacagctgaccatcatcagacacccatagattctgtttatgtttccacagagggtagctgtttctgacccttttgttattttccttgagcaaaagttgtgggatcttagtgaaattataaccacagtctcatccaaggacaccctctgctcaaggagaaccattagaactttcttctgctttatttgaattttaaggggaaaaattgttcttttatctgcttaagaaactataaattaagagggcaaaccagcagaattactagataagggaacatacaatttagaaattttaagttctaaaatcatattgtaccttctgcctctgtgtagatatacagatatcctgggagaaaggactggtttatctcattgaagctaatgacatgtcggttaggggattttaggctatttgtgggatttctccccctaggtttccccataataagtgaaagcgtaatctagtctctcagaataatgatatacatttgttcaacaatgcttggcgagttgggagcagcaggagtgggaaagctaaaaatttacatggtccggagcttgagattggcaagacagaacagtggaagacctggagggggctgaggggactcaaagataccctgtggagcatcattgagggatttcaggtgaggccaggtgaggctggtgactgctcagagatagagcaaggattggaatttctcaatgaggacaaagacaatagaaagtaggtgtcagtgagcgtaagacattggaagtctaagtgattgcaaagtatgagaacttgtaggtggagcagcttgcagaaatgggaggtccaaatatggattacggaagaaaattgggatgaaagtcacagttctttctatctctaggtgttggctgctgcttttggctaggaaggaataatagaggtgagctgggtctcaaaatagctcaataaaggttccttcctctctgccgttttaaaaataccaagcagcctcattttaatttgcatatcctctggctagaggaagtactttaatcagtacttctaattgtggaaaagaagagaacatgccaccacccgcccacacatgcacacagaggatctgataatgaagaatagtgttctcccacactaggaccaaagctgctggtttctccgttgccctaagaatccagattgtagggcaaaactcaagtcttgctcccattgtaaaaagaagctcttttttctttgttttttcaagacagggtattgctctgttgcccaggctggagtgcagtggcacaatcatggctcacccagcctcaaacttccaggcttcaatccacccacctcagcctcctgagtagctggggctacaggtgtacgccagcatacctggctaatttttttaaatttattttttgtagaggtggagtctcactatgttgcccaggctggtcttgaactcttgggttcaaatggtccccctccctaccctggcctcagcctcccaaagtgttgggattacaggtgtgacccactacatctggcaaaagaggttcttgtttttctgtttcttattttcctttttgggaggggtggggggaatatgctcttgacagtatatctctgaaggaatttgacacgattaccttcattattctgagagccatcatgcatatgggattgtataagggcagttacctaactgaggccttctgcttttccttgagtcatcactctgtattctcactacaagactatcttcccgactttaccatttattttttccatttgctgaatggttcccatggccttggtgttcttgagaatgttaggagacctggagcagataagttgtcctctgagctgctgtgtggggattcttgggggatcactggctcagaagttcttctccaaggtagtttggcctggtcattctatgttttcattttggattagcttcttgaattgccccacagatccaatgcagaaagtatctcttcagctaggaatactatagggtaaaatgaaatctaagacatggccttccgaggcatctatactgtgtctaggaagctcagacaaatacataatggtgaacaataaaatacagtgtctaagaggcattactgcataaaggaataagactgattctaaaaaatcacccaactaaaggggttttatacctttgtttggagttcaaactcatgtaaaaggcttggaattggatgctgcagagggatgttattgctagtgttgggagaagagaggacagcactgaggaaggcttcctggaagatgaagacttgaacttgatgacagaggagagtaggaattggatggagggatcagagtgcgtgcagagggcatctcctcacgagagtgtggtgtttgcaaaagcacagtgggagaaaggtgccctccctttctgaaggacatcaaggagatcagtatgtttgagaaagagtttgtggaagagcctcatgggagacgaaatgcacaggcagctccagattgcctagatccatgacattggtaggggacagggcagagacagggcagcgtcacttggaaggatcaggctcagaggttcatggtgtggtttctccagtaatgttcttcagaggatgtagcaccttgggaaaactctccttcattcctctgagattcataactttagaccagaaacttgcttatagcttcaagcagtcccttgcttattaattttgaaacattttatcttgtactactactttttgctcttcctaagcagggcagggttgccttgagctaaacccaggatgctttgaaaacaacataaaacaccttgcaaatggcaatttgtcccctctatcctgagtcaaggagtaaccaaagggatatgtttgaggcacagagagtatgatctgtgggtcacaccatggtaggcctaaactctagttgattatcccattgcaaaacttccatgcctctagtaattaaatgtgcaaatgataacaacctttttttttttttctgccaggggaattgatccctatgacaaaccaaataccatctacattgaacgacatgaaccctctggctactccactgtcttccgaagtacagatttcttccagtcccgggaaaaccaggaagtgatccttgaggaagtgagagattttcagcttcgggacaagtacatgtttgctacaaaggtggtggtaagttgaatgtactaaagaataaactacttttgagtttcctttgtgaagtttggcattctgtgattaaacaggtgagtttgcatacacaggaattggaaggatgtgcttgggacagattgactgaagggatctcaacattgacaacattgacgaacattccgaaagggcttggcaggtgctaggaagtcagaggagtggagaggcctaggacaaacactcaaagtggctctaggctctaggaatttggttgtttcctggtagccaagcatccttgacaaagacgtatttctttgaaatcccaatgaaaagaacaaagaatggagaggggagggtggctcagtggcttctttcctttaatcccactgcctgatttcctttaaacttatgctgatttctttgagatttttcaacacatgtcaatttacatggctaataggatgtgtagtcattggctagtgggagttaatgctctaagaaaagcagtaattaagcttccagctgtcagtaagtagcttaactctcagcctttgggaaaatcttccccttgatttgatgtgttggagccagatgccgaaatggtgggcttgctcattcaaaaccagagttgattacttaacaggacttgtcttgaaattgtattgagttcagtctttatcaccctggttgtaaaggaaaaaaccaggcccagtcaagggcaggtggggctcttatttctgggaggctactagcttgctttcctgatggtgcccttcccttgttgactcagggtctgttgaaggcctttgctaactgggaggttactctgttgtctttcactgttaaccttagagactgaaatcagacgtaatcttttccttcagattctcatttacttctataattggtagcaggccaggtggaagtaggtcaaccttcttagtaggattttagggtcaagagaggatctccccagcaggaaaagcagggagtaaggacagaatgagaagagagatgtgggtggctaaaggctagaggcatttccagttacataccttgcaaaatgttctgaaaaaccattagcctatggcagtttttcttgtcaggccatttgcattgacccatagacattggttcagtgccttcctgccttgactgtttctttatctttctcttaaacacacatgcacaaatatgtacagcagcccagaaacataagcatcctcgaatggctttgggcagggatggggtgatgggaacacacagataagaaatcaggcccaagcactggtgccttgtgacatcagttggacagtcttgagttttcagtatggtctaaaaccttgtcttcagttctccagggtttataggccttttctgccttaatgccttgggcctggagttattgtgtgattttaattctgaactctaaaacacattgactgactgcctggtttgtcctcctttttgcttgaaccagggcaggatggatagctgttgtgcatttctcttaaccgggttatttctaggtgtcacggtcgagagtttaagttatatcccagctgggccgggcatggtggctcatgcctgtaatcccagcactttgggagtctgaggtgggtggatcacttgaggtcagtagtttgagacgagcctggtcaacatggtgaaaccccgtctctactaaaaatacaaaaattagtctggtgtggtggcacatgcttgtaatcccagctactcggaaggccgaggcaggagaattgcttgaatttgggaggtggaggttgcagtgagccaaaatcatgccattgcactccaatctgagcaacagagcaagactctgtctcaaaaaaaaaaaaaagttatattctagctggagctttctgtgccctccattctagtctaacagctatgtctgttctccagatgtatctgatttacagagtgcctgtggtgagtttttaattaaacctggccagtggtaagattaggggtcatgtttgttttgatctcaccgatacagtacccagtgccttgcgctatgtttgatacgcagcagatgcgcaatagagttgaatgaatgccatgtttgcccacctaatttaaaaagtagtcaatttttagaaatttggtgggagacgtattaaatttttggtacttttataggcaattcttaactctctgtatggcttatttatttatatgctgttggtggcaaaattgtagttatgagctggctcctccttctgcacatggatgagccaccagattccagggtcagtggtattagtgagaggatgtaggtaagatgagttaggccaccactgagaggtgtttcccaaattgtggtcttaggagtacccacgtcagcatcaggcaaggacagttgttacaagtgcagattgcagggctcaaatgcacttttccccagatcatcccaaggttgtctaacaatcaccagtttgagaaactctgccctgagccttctacaggcagatgcttcaaatgacagagttgtactactgtctagggaatatttctcaagggatggattgatgggaaaagaaacacaactggctgtggatagcacacaaaatatgtgctttcctcctttttattacatcagactgctaaacgacaaggataaacaaagttggcctcggtcagataatcccctcccagtaagagtgttgaaacctgcaagtgtaactttttatctggggtctgcctagctctaaggctgcctgagcttgggaaattccagctggctttagtgttaaatgaattcaaatcaaattgggaaaatcaaagaactgattttaaagctacagaaagctggttttgcatgattaactcttttgcttccttccagcaccatgaatgattacagtcctttgcaagctactgtttcagccccctggcttctggactggagctggtgtccaggtcttcagaacctcctggtaccctgttggcctcgctctggctttataatgtgctttgtattttttgcccttaagttgccttgtttaatttttattccttgctttttgacatgaagttcacttatttgtcttcatagtgtacatcaaaatgatagggccattaaagaaacaatgaggttcctctgtgatttgttaatttggtaatatacaactgttaggctctttcagtagataacagtaattgctgaaaagcttgaggtgggtcagggttagctactcccctacaacctcacaacctcataacctcactaccagattaagattatcatgcaagccaggcccagatatttcttgcacaaatgtgtatcagtaagcaaagacatgatctgtggacttgaagtctcttctgtgaccttacagatgatgcagccacccacgccttgcatgctgcagacgctgtgttctagagtggatgctaggaaactatggcccaccacctgtttttgtaaatgaagttttactgggacacagccatgctcattgcttatttgtggtctaaggttgctttcatgcccagtggtagagttgcataggtacctatacagaggcaatatggctccaaaagcctaaaatatctattatctggacctttacagatagttgtctgacttcctgtagttgctgactatgctgatagttgtctgttaccccttcagttggcatcaggtaactggaatcgcaatgtcttgacaggtcccaggcattatccagaaaagtataggttatgggcctctctaaattgttatgccctgttaatgacaggatggtatctttagaatattatgcccaattcaagtattttgatgtcacaccagtctcccaagtgagggtccatgtgtattttcatgattctgactaagcaaccacgaatttcactattgaaaaccaattttcaaccttaagctaatttgctctctaatgttgatcagaggtaacagaacagtttagtaactgctacagggtgttgtgggcttctagatgagaaatcagctgacaaaactgtgttgtgaattataggataactgacccaaaccaaactacttataaattattttaactatgttacttaaatgtataagcacccaatgcttataactctcatacgtgatcaataaaacccagatatttacagattaaaaataaaactataacaatacatttaaaattaatatttgttacaactgtgttgagatacaattcacattctgcaaaatttaccctttttaagtgtgcaatttagtggtttttagtttattcataaggttatacaatgatcatcattacctaattccaaatatttttatcacctcagaaagaaaccacatacccattaccattacttccttctcctccctgatgctggtaaccactaacctagtatctttatggctttttcaattttgggcaatttgtgtaatggaaatcatacaatttgtgactttattagtccattttcatactgctatgatgaaatgcccgacactgggttatttataaagaaaaagaggtttaatagactcacagttccacatggctggagaggcctcacaatcaaggcggaaggtgaaggaggagcaaaggcatggcttacgtggcggcaggcaagagagtgtgtgcaggggaactgccctttataaaaccatcagattttgtgagacttattcattatcatgagaacagcacaggaaaacccgcccccatgattcagttacctcccaccaggtccctcccatgacatgtggggattatgggagctacaattcaagatgagatttgggtggggacacagccaaaccatatcagtgaccttttgtgactggtttctttcacagtataatgttttcaagtttcatttatgttgtagcatgtatcattactttaaccatttttaatggctgactagtattgtaatgaatataacacattttatttatccatctattagttggtggccatttggcttgtgtctactgttttactgttacaaacagtgctgctgtgaatgttcgtgtgcacgtttgtgtgtgaacttatgttttaattctgttagtttatacctgggagtgtaactactgggtcatgtgacaattctttttttttttttttttttttttttttttgagatggagtctcactctgtcgctcaggctggagtgcagtggtgtgatctcggctcactgcaagctccgcctcctgggttcatgccattctcctgtctcagcctcccgagtagctgggactacaggtgcccgccgccacacctggctaattttttgtattttttagtagagacagggtttcactgtgttagccaggatggtctcgatctcttaacctcgtgatccacccacctcggactcccaaagtgctgggattacaggcgtgagccaccatgcccggccgacaattctatgtttaacttttcgagaatcggtcaagtggttttccaaaactattgtaccattttatattcccaccagaaatgtattagggtgtagttttcccatatccttgtcaacatttgctactgttttttggatgatagccatcccagttaagtgtgaagtggtatcttatggttttcatttgaattcctgatggctaaggatgttgaacatcttttcacgtggctgttggccatttgtatgtctttcttggatggatgtctattcaagtcctttgtccgtttttaaattgggttcttttttattgttgagttataatagttctttattctatatattctttatatacaagttatatgatttgcaaatcttttctgccattccgtggtttatctttttacttttttctttttcagcactgaagtttttatttttattttatttttttgagttgggggtcttcctctgtcacccaggctggagtacagcggagcgattgtggctcactgcagccgtgatcttcgtgtgctcaagcaatcctcctatctcagcctcccaagtagctgggaccacaggcatgtgccaccatacctgttaatttttttattttttgtagagacggggtttcatcatgttgcccaggctggtctcaaactcctgggctcaagcagtcctcccaccttggcctcccaaagtgttgggattgtaggcacgagccaccatgcccagccgtgtttttaattttgatgaagttcagtttatccatttttttttgctgcctgtgctgttgttatatccaagaaactattgcctaatctgaggtcatgaatatatacttccctttcctttaagagttatgtagttttagttcttacagtctatgattcattttcaattaatttttgtatctagtgtgaaatagttatttaccttcattcttttgcatgtggataaccagttgtcccaccaccatttgttgaaaaggctatactttttccttggcaccttggttggaaattattttctcataaatatgagaatttatttctggactccttctctctttttttttgagacagttttgctgtcacctaggctggaatatagtggcatggtcatggctcactgcagctttgaactcccaggcttaaaggtcctcctgccccagcctcctgagtagctgcaactgcaggcattcaccactgtgcctggctaagtttttgaagagacagggtctcactatgttgcccaggccactgcacctggcctgtttctggactcttaattctattccattaatctgtatatctacccctatgccagcatcacactgtcttgattactgtagttctctaataagttttgaatttggaaaatttgaactctccaactttgttctttttcaagattgtattggctattctgggttccttgcatttccatgtgtattttaagatcagcttgtcaattttttgccaaaacaaaacaaaaaccacagataggattttgatagagattgatctacagattcaacacaatttggagagtgttatcatcttaatatatcatgccttccaatgcatggacaaaggatattcttccatttatttaggttttctttaatttctttcaactgggttttctggttttcagtgtacaagtcccggacttctttagttaaaatttttttcctggctgggcgcggtggctcacgcctgtaatatcagcactttgggaggctgaggtgggcggatcacgaggccaggagttcgagaccagcctggccaatatggcgaaaccccgtctctactaaaaatacaaaaattagctgggcgtggtggagcgcacctgtagtcctagctactcgggagactgaggccgaagaatctcttgaacctgggaggtggagattgcagtgagctgagatcgtgccactgcactccagcctgggcgacagagcgagactctgtctcaaaaaaaaaaatttcctaagtattctttttggctccattgtaaatggttcttttctaaatttcattttcagattgttcattgctaatatatagaacatgattgatttttgtattattgatcttatattctacaaccttgctgaactttattagttctaacttttttggtgtgtggattccttaggattttctgtttacaagatgatgttgtctgctaaaagagacaacatcatcctttaattcttccttttcagtctggaggccttttatttatttatttttttgcccaactgccttgggtagaacctctagtaaaatgttgactaggagtggagagagtaggcatccttgtcttattcctgatcttaggggaaatgcattcagtcttattaagtatgatttttaactgtgaggtttttctagatgtcctttatcaatttgaggaaggttcccttctattcatgggttgttgagtgtttttatcatgaaaaaatctgggattttgtcagtgctttttctgtgtcagttgcaatgatcatatgtttcttttttttcctcctttagtctattaacattgaatattacactgatggatctttctcatatgttaaaccaatgcacatttttggaatgaatcccacatgctcttggtttataatcatttttatcctttaatttgtttggcagaatttaccatctttgtgggaagttttctggatactaattcaatcttttcagtttttaaaatttctctttggttcagtttcagcagtttgtatctttctagtaatttgttcatttattctaggttatttaatttttaattattcatagtgttcacactaatcttttttttatttctgtgaggttgttaatgatgtttcttatttctttcctaattttagtaatttgagtcttctctttttttcttggtaagtctagcttgtagtctagtttattaaatgttgttaatcttttcaaagaatcaatatattgtttgagtaattttctttattatttttctcttctctatttcatttattcctactgtaatctttatatttctttcattctgcttgctttgggcttagtttgcccttatgtttctatgttcttaaggtggatagtcaggttattgatttgatatttttcttctttttttatataagtgattacaggtatacattttcctctaatcactgctttagctgcatttcatatgcttatgttttcattttcattcatcttaaagtattttctaatgattcttgtgattccttttgacttcattgatgatttttgaatgtgttgtttaatttcaatatatttgtgaatttccttcactttttggtttctcattttattctattatgatcacagaatgtactttatatggtttcagttctttttaaatgtattggggcctattttaatacttaacatctgttatccttgagaatgtggctgaacatgtggaatgaaacatgtgctttgagaagaatgtgtattctgctgttattgggtattatgttctataagtgtttattaaatctacttggctgatggtgatgttcagtttatctttttccttttctgccttgttctatattgaaggtgggaaaatcttcaactgttgaaatctttaagtattatcatcttgattatttatttctcccttcaattctgtcagttttccctcatgtgctttggagttctgttgttaggtgcatatatgtttatgattgttaattcttctagattgacacttttatcattattaaatgtccttccttgtctctagtaactattttttgtcttaaattctattttgcctattattatagctattcttttcttctgggtacagtaaacatggtgtattagtccgttttcatgctgctgataaagacatacccaacactgggcaatttacaaaaaaggtttataatggacttacagttccatgtggctgggaagcctcacaatcatggtggaaggcaagcaggagcaagtcatgtcttacatggatggcagcaggcaaagagagctcatgcagggaaactcctcctttttaaaaccatcagatctcatgagacttattcactatcaggagaacagtgataacactatcatggaaaagacctgcccccatggttcagttacctcccacctggtccctcccatgacatgtgggaattcaagatgagatttgggtggggacacagccaaaccatatcacatggcatatcactttttcatccttgtagtttcaatctatttgtatctttgaatccttgtaaatagcatatggttgtgtcaggtcttttatgcattcttttaatttctgccttttgattaggatgtttaatttacttacatttaatgtaattactgaaaggtagactacatatctgctattttgctctttgctttctatattcctgataaattttttttggatcctttattacttcattactgcctttttttgtattaaatacagattttctagggtgacatttaaattcccttgtaccttctttcactaaatttttcccaggtgttttcttaatctgtgctttggggattacaataaatatcttaatttatgaaatctaatttggattaataacaatgtaacttcagtagtgtacaaaatctttgtcattatatagctttattgtgtccctgcttttgtgctattattgtttcatctttatactctttaagcccatcagcacagttttagtctaattgaggactccttagatgagtcatttttctttgctgctttccaaggttctttatctttggctttcagcagttttactgtggtgtgtctgggtatgggtctctgagtttatccttttaggaattcattgagctgactggatttatgttttttatcaaatttggggagttttgggtcattatttcttcaaatattctttctcctttattctctcatctcgtcagtgactttggtaatgtgtatgtcaggacacttgatggtgtttcctgggtcttttaggctgtttatttttaacattcttttttttgttgtcagactgagacatcacaattgacatgtcttaaagttcactgcttttttattttcctggttcaaatcttctgttgaacccctctactaaatttttcttttattatacttttcaactcccaaatttctatttgcttgtttttaaaaaatatttctatttctttattgatattctctatttgatgaggcattgttctcatactgtcctttcatactttatacatgatttcttttagtcctttgaacatatttataatagcttatttaatttttttttttacttagtctaatgtctgagcttttaaggacaatttctactgactactctttttgtttgtgtataggctatactttgttgtttctttgcttgtcctgtgattttttttgttgaaaactggacattttaaatggtgtggtacctccaaaccactgacaccccttcctcagggttttgtgttgttgctgtttgttgttgctgtttttgttgttgttgttattgttgttcagggagtttcctgtactgctatcaagtttgtgttctttattgtttttgctactgaattgtctcgtaatttagcttattggtcagctaatgataagacagagattttcttaaactctttgaaccactaagtctctcagcctttgctaatggcctctgggtgtgtgttagggtataccttcaatgcttttgcaggcagtttacaactctgtcctagccttcacttcctgcttatgtagagcttcaagattagctggaggtaagagactagaccccgttcatttctttcttgagcatactcacggctcttatgtgcttgaccttgtagagtcccaggaatactcatctagagcttattaaagcctcctaagggcatcttcttccccattttttccttttaagctttttagttagcctctttttaattcccaattggtaatactgtcttcagaagttacagtgataagcctttgctaatttttattcactattttcagtaaatgccttggctggctataaggctgtctatatcatgaaccaagtcaggctatgtaaagacaagagctgataatgcagccttcctgtgagcccccagacaggtcaggctttttgggaactccagacctattctgtcctctccagtggctgccaggctgctgtttttcacagctattgtagatgtgaggctgtgggtttccaaggctaccacagagctagagagagggggatgggattagggcaaatgaaaacatcacaaagctggctatttttgccaagattcagccattgttcttgagtaaatgtgccttggatttttgcaaccctttatttcatttgcagaattctgaaaaagttgattttgaggatttttgtcagtgtttttcttgcttttatggataagtatatttttagagttcctagaaatgcttccaattaatattaactttgtaaactttattataggcattttccaacctacacgaaagaacagttaatgctgatatgacctccccacgtgccctcaccaacttcaatattacttacctacatttgccaacctctccttagctatctactcactacttttttttccccctggaatatcccagatgtcagattttagctatgtttcatttatgattttttttttttttttgtaaacaacattaaggtggatgaggatgttttgctgaacctttgttgctgctccaagggaggatgtgacccatggctctggtgcttctgaactagtggccctgtgcttccccatgccttgggagggcttagttctttacccattttctctagctgagctgccatgcaactttcagtgggatagctcattgcagtatcctttggcctttacttgataagaatgtcctttatttagttcctttactcctcttttctccttgatcctccgtttctttttgctcttgacacaatctcaaatataaatggaaattcaggttattcagatacctagatgaatttatttatttaattatttattttttttctgagatggagtcttgctctgttgccaggctggagtgcagcggcatgatctcggctcaccgcaacctccgcctcctgggttcaggtgattctcctgtctcagcctcccgagtagctgggattacaggcatactctaccatgcctagctaatttttctatttttagtagagacggggtttcaccatgtcggccaggatgatcttgatctcttgacctcgtgatctgcccacctcggcctcccaaagtgctgggattacaggtatgagccactgcacccagcagaatttatttttagttatcagaaatgaaaacacaaaattaaaaaaaatcttcttataaattctcagactctataagattgaattagattcaaatatttaaatcatttctactagttgatgaagtttgtgcatttgtggatgtattagttggtacaacctttcaggagggctatttcatgatagctatcaaaaatacaaattttgacttaataattcttctaagactgcatcctaccaatggtattgtgcagttctgaaaaagtaataaatacatgcttatttatatgtgtgtgtgtttaagaatgtttctggaaataactaaagtgcccaccaatagctgttaagtggaaagatgtctaagatacattgccaatgataaaattttaaattgtgggacagtaagatacactgttaatggaaaaagttaagtaatacaacagcatttatatcatgatccaaattatatgtgaaaaattaaattgcctctgtcagtttagaactatattaggttgctggtaatagactagaaataaaaattgcttaaccaagtcaggagtttagttttctcccccttgctgcctggaggtaggctgtcttgggctggtatgttggtgtcctgatgttcttggggatccaggtttctgtcttaatgttctgccatcctgactagtgatttccattctcaagattacctcatggttcaagacatccatactagccttcaagtccttattgcagttaagaagaataaggaaagacagcaagtaggacctcttcccaccaattctgtctgtttaggcagccttctcagaaatccagcacgaaacttctgtttttatctcattgactagtacttagtcacgtgacttcccataggtgcaaaaatggtagagaagtgcagtcatttattctgggtggtgtcagagtcccactgctcaggaggaaagggataatgggtgttgggggtaggtgtagcagtgtctgtcactatgtacatatgcttgcatgtggtggcacagtacatttctgaaaggatgcacaagagctgttagccactgggcactctgcagggtagagtgggaggagggatgtggagatcagagcagagcttctgcatttaccttatacccatctgtgctgttggatattttccatgagtatgctttgctttttaataatagtgataaaaaacaaaccaacccaaaacctatggtttattaagaaaaatctcagagccttacaatacatcttataatcactagtgtgccatagtttaattgttaatatatttcttggtggaagtaaaacaatacagtaactctttaaaaatccattaagaatgaacctgaattgtccaggtttaggaataattctccaagaaggtagtgggatcgatgcattttgagattttttttttgatgattgtagtattctgtgatttttgcatttatgaggtaagactgacctgtgaaatatattcttaatactcaggcctcccagcagcaatcgttaagtatttttaactaatgatgggcctgggtgtcattgagaaatcactctttttaaagttatactcacagttggaagtcgtaaaaaacaaagcataaaaatgtatatttcattgatatgttcctctatatattcacaaaaatgtatgtgtataggctgacttaaactaatcatctgacatagccatgacattttatcaacttaatgaaggcttttggaatttatatgtaacaattttgctgggaactgttttcttattcagttaatatgcttttacatttttaatagatccatcatttcctacggccctatgtttagtacaagctattaatatggttttcaggtttccattttggtgggcagtctttcgtacctctctgcctgatttctttaaaacaaactacttttaaccatttgttcagtggtgatttgaatgtctgctgctcaaatggattaaaagtaactttgtctttatcagctgggtcctcacagtatttatggggcatgtttgagcacagggtactgaatcgttatattgcagataaaataaatggatatgttccttactctataggaagttaatatctataataaacagcaacctagtcaaggataagtgaagccaaagtaacccctctggctgggaatcccaacatctcaatatgtttaatagtcatttgtatgattatgtccacatgagggtatgcctccctgtgtctttcctgatagatatgcaacatttgccttcagcttctggccatgttcttttagagctggaagaaaccacacagagtttttataatagttcttatccttttttgagtggtggactttcttgagaatctgataaaacgtacggagcctccatagcaaaataaatgagtgtatataaaaaaatttgcatatatgtttacagggttgctggaccatttaaacccatctacagggaagtcttgatccaaataagcttctccttttgtatatgaataaactgaaagctagagagatttctatcattttctcagttggtagagctagctcttaatctatgcttttatacacatttccaagattcttgctgtgacttaaaaatctctaaaatgcaatgtgatgtggtcaacatcatgttgaatactctaccaatgaatatgtattctagcaaaagaccttcctcaatgagattattcagagatggaaaaccagaatcaatgaagattctctcaagtcttggtgcaaattaaaaccttgtgactggagcatccttgtaatctaaaaataggagtagaaagaagaaaagaacatgttttgtgtgcatggtgtgtggctgatctcaccctttagtggtttgggggccgtaggctcctccctgcgtgtttcttcagcctcatcacacaatcctctttctatctcttactctgttgaagtgttggcagcctccaaaaacctcctctagtccaagttctaccatcataccatttccttatctaatatccatggagtgtctagtgtctgttgcaaaccgggtatctaagatgaagcagtacaacccaaactgcccagtgatggcagacattgcaaaaacatgaatttgcaatcacagtctctattttgtgtttccagtagaactggaagaatctgactcttctatttttatttttgctgcttttgaatgactgtaatgtggcaccattaatttttttttctcctcttccttggcagcatctcttgggcagtgaacagcagtcttctgtccagctctgggtctcctttggccggaagcccatgagagcagcccagtttgtcacaagacatcctattaatgtgagtggggtctgcttgaggatgggaagaagtatcattgtctttatgcagaggtcagaggaaggttgttgcagggatggcctgctggagtggatattttatggcgcctccctgaagtcaggtctctagagagtgcagctatgctttgggcatcgtggtctgtggttcccacttcactgaagcagagctgaacgagagacttagtttgctttaagtggagcagcactggcagagagaggttcgagccagagtcagtgccatctgagcaacgtgccagtactgaagcaatgggaagtttgtgcatgataggatctttttttattaagtaactgctggattgcttgcaggggatgaattccagcagaggataggatttgggtcccaccttttagaaacaggctggagagactaaaaactgagtagcagaagaaaccagacataagcaaatgcttaaatatgcagctttataacatgaagatggataggaaaagtctgcatgggatgggtcattagaggagctgccacagggagacggtcacagtgaaacgtcttgacattggcaggtggtttggtgaaaggtaagtagctcacttacttaccttccaccaaatgagtgggatcatacggagaacagtcatgccagtcctttgctagtttctatggattctgctttcctttggtcaccttaggaaaaataaagggaagtgcattaacccgtattgtactttgtacgaatgaaagttctcatgggaaaatgagggagacattattaacggaaagaggtttgtaggtcatttgtgcagtgcagtggcccattattttgtgccccatttgccagtaaggggcccgctaagctgcagatctgcctcaggttctccaaagggaaagtcgccaaagcttctttgccaaggttagggagcttcccgtgggctttaggccaacattcatcgctagaacatttgaaagtcattgcttccgtgtgtatagtaaaagcccacagggcacatttgttttttgacgtatcttttttgacttttgattccaaaggaatattacatcgcagatgcctccgaggaccaggtgtttgtgtgtgtcagccacagtaacaaccgcaccaatttatacatctcagaggcagaggggctgaagttctccctgtccttggagaacgtgctctattacagcccaggaggggccggcagtgacaccttggtgaggtaaggagactgtgagtccttctcctgccttcttaggccaacacaaccattagcttctctctggttctgtggttttcaacattagctgcccatgtggatacacccggggagctttcggaaacccgatgcctggctcacgtgcgcagagatcaccatgggatgggtttggggtgtggccaggttatgaggatcttaagaagcgccctaggtgattcttacgtgcagccaagtctgagaactacagctctaggtaacatttagggtccgagctactgtgttaatcacttccttgagctgcttttgttcagttttctggttttgtggtttctgagcagtgaaaaacagcacttggtaaatatcagtcagtgagagctggcatatgcggccagtggatcaggttaattgatgtcattactctttttaagagataatcggacggtgttttgtaaagaaaggcaccaacgtcattgatcctttgtctgtaaatcatgtgtttagagctgttttgtagtccagcagtgggcggtctcggagcaccacacccatcaaggggtggtggaggagttgggggtttgggagggatgaattggttcttaagatccgttcagggccatttattctgatttgtcgtttgacaaccagacttgtgtgacctgtgtggctgtggttagagtcccctctgctcttggaaagagtctcccgtgtgaagctgactggtctggggtggggtctggctctccagccatgacaaccaggtctgagggcatgcccctgtgcccactgtttctgggcaattcattccgttgtcagtttattcacaggtatgctgctgctctctgccagacagtgttctaggtatagccacaaagtaatgtatgaagcaataaaatatcagaacaaagtccctcttccatggagtttgtattctagttggggaagatagaatataagcaaatatgtgatctgcctggtaacatgttgaaaagaagaataaagcaagatcaggggatggggatttgcaacggtgttcttttattctattggctgcttcaggagggggacatttaagcaggtgcctgaattacatgagggaaggaaccaggcagacccctgggggagtagcgctgcaagcagggcagacaggaagcacagtgactctgaggctggactgcactggtgttttaggagcagggaggaggccagggtggctggaagggctgcagagagggagagagaaggaagaaacaggacctaagagagcagggctcagatcctatagggccttcaggggcttgtgaagaactttgtttttttcttttttgttgtttttgtttgtttgtttgtttttgagatggagtctcgctctgtcgcccaggctggagtgcagtggtgcaatcttgggtcactgcaaccgccgcttcctgggttcaagtgattctcctgccttagcctcaaaagtagctgggattacaggtgtgcaccaccaggccaggctaatttttatatttttagtagagacagcaccatgttggccaggctgatctcaaactcctgacctcaagtgatctgcccgccttggactcccaaagtgctgggattacagatatgagccaacacactcaatcctgtcttttccttcgaaatgagatggaaggtttagaccaggagatggacatgatctgatttaacctttcaatttttttccgttaaaatctgtgaattgcattatataatgaaaagaatataacacataaatggatagtgttctaaataattataagtgagcactcatgtggcttatcttttacaggagttatcctcaatgctgtgtgggaatttgactactgtgactactgtaggggacaaaggtgggaacaggaagactagttgtgaaagtattgcagagatacaggccagtagggatggatgttggctggacccagggtggtcacactagagacgctggaaatggtcagaccctaaatatattttgaaagtagagccaatgggatttgttgatagatgggacgaggggtacgaaaggaggaggagccaggggactgctactgcttcacccgagctgcctttaaagagatggccacacagggagtcagggagagctggggcaggggcaatattggggggagatcaccagcttggtttgggacttacctggttggagaggcctattggatatccatgtgcccagccttctacctggcctctgacagtgcttttccacttcctgtttcttctcttttggaggtgctgtcatcttttattcctttcctcccctgacatagactcatggattaattattatttaatgtgttataaaccattcctgccatgatacattttgatgctcagcttgtcctggtttggtcagtggcggaccctacctccttctgtttggttcttgtcgttttttattgaaaaaattatttactggccgggcatggtggctcacgcctgtaaacccagcactttgggaggccaagatgggtagatcacgaggttaggagatcgagaccatcttggctaatgtggtgaaagcccatctctactaaaaatacaaaaattagctgggcgtggtggcacgtacctatagtcccagctacttgggaggctgaggcaggagaaatgcttgaacctgggaggtagaggatgcagtgagccaagatcgtgctactgcacttcagcctgggcgacagagcgagactctgtctcaaaaaaaaaaaattatttattgaggtgaaatgtatataacatcagcttaactgttttaaagtgggcaattcagtggcattcaatacatttacaatgttgtgccaccgccacctctgtttaatttcatggccttctcatttctccaaaagagaaccccatgcccattaagccgcttctctccaccgtccccttctcccagcccctggcagccgtcagtctgatttctgtgtctgtggatttttccctattttacaggatgtttcatataaatggaatcatacaataatatgtgaccttctgtgtctggcttctttcacttagcctaatgttttcaaggttcatccgtgagtaccatatatcagtgcctcattcattttaatgggtgaataatattctccttttaaaaataattaaaataatgaatcactatccctcagacctttcactgactctttaatttttcttttttcaccattgaaagcccctggctgtggaatggaaaagtcacagcttgctaaatattttctcgtcttcctcatttgtcagatattcagggtgaatgtttcatgctgggacagagtatgagccagaagccagagcgatggccctttacagagtcatgaaggcctcccctccttgcctgagcgcacagtccagtgaagaaactggaaatagattcacgtcaagagtcataggccaacgtcccactcagttttctcattgttctcagattttatctgaggactagagaggttccattatactcagttgagtgatgttttgtcatctgcatctcaatctcagccaggtgaaatgggataaaggtgaattagcacatcgtgtgggcaggctggtttagagtaaactgctatgtgaaatgagcaagtctttgaactgaataggaaagagtggtgtctgggaactgcttctgatttactcagagacatggagaaagagctctttctagggaatgaccctggccctggtgggatgtgccaggtgggagtctcatggaaagcactagctagatgttggatgctttggaggaactaatgtgctgaggagatgtcagccccgtgggtcaccttagggaggggcatgggcccagttggtgggggtattgccagggcatggattctgcactgagtggggctataggggacctggtgagcttcctggtaagccttggcccagggcactctgggaagaaggggagaagtgccctggggagggccagtgaggataaaatggaagaaagtagaccctcagagaaagtacttagggtggggcagattgttgcagggcaggtcaagtgggggaaaggaaaggatgggctgggacttctggtgaaggagcatgtgaggtacaggaagacaggcttctgcttagaagtaaaagataaaactccaggaatccgactcgggaaagaaacagggctcatctaaatgagagaaactcaggcctcccagatatctagaagaagcccataaccagtgggatgacaggtttatgatgataaccctcagagaggtagagcagaggtcagcagagaaggaggaatcgagaccttcagctggttcctaaggaagcccctgaaaaataactgaactagacctaaggaaaccacatgtcagagaatttggtctcaactccagcatttcattcggcactctgctcagtccctcagcctgaagctgctttggtggggctcctagtgttccttttcctgcctcagaggttgttgtttgggtctttctgtctgaggtggcagggcagtcatccagctgaagagattgtgtggagatggttgatggaggacagcgtttctcggctttattgtgtagccggtggcttagaacccctgaagtaaagggcaagcttccagtcttttttctttttctttttttttttttttgagttggagtctcgctctgtcaccaggctggagtgcagtggcacgatctcagctcactgcaacctccgcctcccgggttcaagcgattctcctgcctcagcctcccaagtagctgggactacaggcacgtgccaccatgcccagctaatttttgtattattaatagagatggggtttcactatgttggccaggatggtctcgatctcttgaccttgtgatctgcccccttcagcctcccaaagtgctgggattacaggtgtgagccaccatgcccggccaagcttccagtcttaacagccacctatgaaccctggttacaatttctcagagatccgctctatttgtaatgcgtgtatcattttagcgcaaaaccacttccctgtggctgtggcatcagggtatccgcatggtagataaagcctgggaaacccatattctctctctctttttttttttttgagacggagtctcgctctgtcgcccaggctggttggagtgcagtggcgcgatctcggctcactgcaagctccgcgtcccgggttcatgccgtccatattctcttaagaatataaccccaagctttctagagccatccttgctatatgtacagtttctttaggaaagaatcgacaggttctgctgagcttcctgacagaaaaccctgtgggcttctatctgatcagggtgttggataattaggttgtaagtacctggagaggggctgtgtaaccctgagctaggttcctacagattgggttgaattttaagcctcagcactgttattaatgtcttgcaagtctgacttaatgatttctgtttttgaaggctcactggaggatttggagtcaatttcgttagtgatgtaatagatgtgactctttcgtcaacttttgtatgttatattcatcattctaaaccccctgttaggaattgttggtcagacaagccttttgaccctaaaagttgaaaagaaacaaattttttaaaatagcagattatctggctggacatggtggctcatgcctgtaatcccagcactttgggaggccaaggcaggtgcatcacttgagctgaggagttcaagaccagcctcggcaacatggcgaaaccccatctctaccaaaaaataaaaaaaattagctgggcatagtggcacacacctgtagtcccagctacttgggaggctgaggtgtgaggatcattgaggatcatctgagtctgggaggttgaggctgcagtgagccatgattgcaccactgcactcctgcctgggcagcagtaagactgtctccaaaaaaaaaggaatgaagttctaacaatgtgctataatgtggatgaaccttgaaagcattatgctaagtgaaagtaaccagatacaaaagaccacatattgcagattccatttatatgaaatgtctagataggccaattcataaacacatggagcagatgagtggtttccagggcttgggaagggaagaggaaatggagagtgactgccagtgggtatgaggtttccttttggaatgatgaaatgttctggaactagatagtaatgatagttgcacaacattgtgaatgtgcttaatgccacaaaattgtatacttttaaatggtcaaattttatgttatttacaataacaagcaaataccaattcaggttcatagctgtttattttcatattgtaggtattttgcaaatgaaccatttgctgacttccaccgagtggaaggattgcaaggagtctacattgctactctgattaatggttctatgaatgaggagaacatgagatcggtcatcacctttgacaaagggggaacctgggagtttcttcaggctccagccttcacgggatatggagagaaaatcaattgtgaggtattgatgctttaatcttcttttgctttttaatataaaggaaagagccctgctctgtggtagtttcctatgtctagtatttattgaaaaaatacaagatcacatggtattctattaatatcacatggagcagacttctatttgtgttgctacacttgcagttcccaaactctgctccaaggtcttgctaccacttctgggcagaagcaactcagaaaaaaaaaaaaaaaagtagtattcgtttttagtactacttgtttagttagaccattacttggtcttttggatttttgaattttgtttgtccatggtgggctatgtggacactcccctatataatgtatctgtggcccttgggaaaattcttttggagactcttaccttagaatttacttcttggtttttcttctctatttggcaatgggtcttggcttaccacatcaaatctaattttggaaagaggcagcctataaatggatatagacaaatatctgggtacttcctcttccctcaatagtgtcttctacagcagcttggtgagatcctgggatagttggggcttgggtgtttttgagcgtgctgtgggggtcaggctttagttaaatcgaattaatggtatcattcaaattcagctttctgtttccctgactaatcagtttatttatgaactgtcgttcatcagctttaggtataggtttcttcttctgagtttaggtggtggaaggaatgtataggaaatgggtaagtctgattacctgaggttacagaaactcttcaatgaatagacttccttgcaggcagagaagcatgagtcagaaagaggagtgagcaaataaatatttctttgagacccagcctaatttgttccagttttcattggtcaaactgagactctagcaagacagatacttgttagagatccttttatgacaaaaataagtagcaaataatccagcaaaccttgctaccatttttacctgaccataaccacataagcacatagtcctcctgtgcagaaccctggccacatctgagtaacattgaacaagctctttctgaccaggagaactgagtgtgaccatatggcaaagggtgttgtcctgattgcttgcagagctatgaaaatctggacatgagtgatggaggccagactgaatcgcttgaagccttgccctgtatacctacacctttgtgcaaatgtaaaatacataggaaaaaatttagtgctaatcctttgctttttatatctcattgatactgtacatcaggggagcttttccatgagacttatgacttctgattcttggtctttcttatgacagaattgctggaatcatgtttgaaatatgtctctgacttagaaagtgaatatgacaaaatcatttcatttctctttagttctgagtcacttgagaggatctctgagtgataggatgagatgatgactttcccatctacttgagttgacactgatttctaattgttattccctgagagtctcagaaggcctttttaagttgtaattgttctcttcttccacgggacatttatgtgggttcagatgatcctctctgtctggggggtgtggggacagctgggctgtgagtctggtttcccctgggccaggcctccttgccccgtgtcagctgcactcccctcacacaggccgcagggtttacagggaacgctaggcatggtatcatgtgctgacactgcctgaaactttggttgtatagctttcccagggctgttcccttcatctggctcagcgcctcagtcagctcctcaacctccagctccggagaatgcccatcctgtccaaggagtcggctccaggcctcatcatcgccactggtaagtgtgcttgcctgttctcaaaaggggttcagctgtctggtgatgtgcaggccaaatgcagagcgatcacccacacctccagcagtaaccacgctttgtggtttgaaagcattcttagttgctagatactacgcagaatttctggctgggcaaggtgattatctgacatattcttgaaattaaaaataattatttctcttgcattttaggctcagtgggaaagaacttggctagcaagacaaacgtgtacatctctagcagtgctggagccaggtggcgagaggtcagccccctcccccaatcccgtcccctccaccctcattcccatttgtgtgagaatgtagactgtgccttggcatttcagggacacaaatggtccatggcagagaccagtaatgccagatatgactataaagtaaagaaaggtacctgaagccactgatttatatccacagttactttaaattaaacacagacctttgcaaatgtgtgaattttactgaacattctaagattatgagttctatgagggcaaagacaatgtctgttttactgacttctttatccttaggacctaagagtgcctggcatggagtgggggctcagggcatatatgctgcatgtatcagcaaattatagcgtagtggtattagccctgaaatgggctgctattattattattattttgtatattattgaagttgagatgaagcctgtccttgctgggctatgttgtataggcactttcgtctcactctgtgctatggaagtagactctctttttgccttaaggttgtataactaatatcgatgctgattataccaattcctaagacagggctagttccctagttccaaaatgctaattcatcttcatctttgggcattagagaatttccaaacttgtaaaaaaaaaaaaaagttgttgccagcctcccattgattaaggccaaggaagtgcgtttggtctcgttctgtaggggttgctttcaggggtgaccctctagttatgccaggagccaccagggtaaaacccaacagatcacttgacaggatgagcaccttgtcatcgagcagccccgcaggctgggcagccggaacagcacgtcgggagtgatgtggagttctcagaacagctagcagacatagttcccatccacgtggtgctttactgggaatgcaccatgctcaccttgatatttgaataggtaatatgtaaagcagtaataaaaataccaacattcatttggcaccttgcagttcacagaggcctgtcacaagccttctctcactgtggcagggcttcccatccctcccgaggagagagatgaggctcagacactgtgtactgtatgtggtgaacgcaaatatgtgttcagatgaggcagattgttaaggccattgtagtcagagtgcaaacagtttgaatggaaattttcgggttgtccttgtgcagctcccaagggaagattaagcagctgctttcccctttcgtggagctggacgctccctttgaaatggggtatcctcttctctgcgaataggcctgtggtttgtttgtgccttctgctgttggtgtaatctgggatttgcacatctgcaagtgatttccttctgggtagaaagcagtgtcttgttcctcctccagtgaagtggtatcgtctggtgattaccggggcagctgtcagtgcctccctccacacgtgccttgtccctgccaagaagcaaccagtgcataagagaccttattttgggacatagcagaaaactaacttggggatgaaaagattgtgagtttatctgtgtgagtgggcatctgagtccccatgggcagccttcactttagagggacaatctgggctgtgtgcaggagcaggtggtggcagaggaagaggctgtagtggacagaatgttgcctggagcactgatgactgtaattgtggttttctttttcctcctaattagttgtgcaaattctctgatcctcagaattcctttttttgtgcttttttctctttttaaataatttttatttcttttatttttagcttttttctttatcaactttattgaagcagatgaaggcacagtacactgcacatatttaaagtgtacagtttgatcagaattaattatggtcaccacaattaagataacaaacatttccatctgcaaattctctgatcctcagaattccgtttttgtgctttttttctttttaaaataatttttatttcttttatttttagcttttttctgtaacaaatttattgaagcagataaggggacagtacactgcacatatttaaagtgtacagtttgatcagaattaattatggtcgccacaattaagataacaaacatttccatcaccctccccgaggtatctttgtgcccctcggtaatccatcccactctccagtcttgtccttgtctgcttctgttattcattggcattttctagaataggttattcattggcattttctagaattttgataagtggactcacacagtatatactctttttgcctggcttctgtcacacatcacgatgattttgggtttcatccaagttgctttgtgtatcaattgttcattcctttgctagttgtatcccattgtagggatatatcataatttatttattcattcatctgttgataaacattccagttttgctgattacaaatatagctgttatgaacattcatgtacatattttattcatttctctagggtaaatacttaggaatggaatagctgggtagcatggtgggtatatgtttaactttttaaagaactgccaaattattgtcccttttacatttccaccaaacagtatgtgagaattttaattgcttcacatctttgccaacacttggtatgattagtctttttaattttagacattttaataagcatgtgataatatctcattgtagttgtaattggcatttgtgtgattattaatgattcttttcatgtgctcattggccattttaaaatctggttgtgaagtatctgcccaaatcttttgcctttttgaaaaaattgggttggtccagcacagtggctctgcctataatcccagcacttcggacggctgaggtaagagggttgctggagccatgggcaacatagggaaagcttgtctctacaaaaaataaaaatagccaggcatggtggtgcatgcctgtagtcctagctagttaggaggctgaggtcagaaggtcacatgagccctggtggttgaaggtgtagtgagctgtgattgtgctgctgcattccagcctgggcaatggaatcagagcctgtctcaataaatatataaataaattttaaaaactaattttaataattgagttgtctatcttctttgagttgtaggagtttttttaaaaatatattttggattcaggtcttttgtatgatatatgggtagatactcattttttccatatggagatctaattgatttagcaccatttattgaaaacccttctctctctcccattgaattgccttggtacctgtttgaaaatcaattggccatatatgggccaattttaggccaattgggtctatttcaggtctttattctgtcccattaatctgtctgtcttttcactaataccaaattatcttaatttccaaagccttatagtaaatgttgagatcaagtagggtaagtccttcaactttgattattttaaaaatctttttttattattgtaggtcgttcgtatttcctgatacatttcaggatcacttgtcaatttctatggaatctgctgggatttttattataattgccttgaatttatagaatcagtttggaggagaatcgacatgttaatactattgagtcttctgatccatgaatgtagtatctttttccatttcttgttcaatttctctcagtactttgtagtttccaatgtagaggtcctgtacatcttttattagctttattcctaggtattttaattttttgtggtattactgtaaatggaattttattttctaatttttgctctagtatataaaaatacaactgattttttatatattcatcttgtattctgtgaccttgctaaggtaattcattagttctagtaggtttttagattctatgtaagcaatcataccatttgcaaagagtgacagttttatttcttcctttctgatcttaatgtcttttatgtattctctcattcttctcttcttcctttttctcttctttcttgtccttctttcttctctttccctcctttcctccattttctcccttctgatttctttcattcttcttatcacaatggctaggacctctatacagtattgaatagaagtagtgaaagtgggcattcttgccttgttctctctctgggggaaacaattcaacctttttaccattaactatggtgttagcagtagatttctttatcaacatttgggaagctccctattatcactagttgttgagtatttttttttttatcataatcagatactggattttgtgaaatgctatttttacatttattaaaatgatttttttctattactatgatgattaaatattacattaattaattcttgaatattagaacaacctggaattactaggacaaactctacttggtcataatgcattattctttttatgtgcagctaggtttgatttgctaatattttgttaaagatttttgcattatttgtgagagatacttgtctttaatttgtttttttttgtaaaatctttctaaagttttgatattagtgtttggctagtatcataaaacaagcagaggggtaaacccctcttcctcttttttaggacaaagtttggtgttattttttcttgagtaattccctaatgaaactgtccaggcattgagttttctttttgggaatattttttgataagagatttaatttctctggttgatacaaggctattcagattttcttctttttgtttcaattttgatgagttgtgtgtttcaagaaatttgtcccttcatgtaagttgtgacatttgttggccttatgttatcaatgatatattctctttatctttttaatgtctgtaggatctttggtgatgatttcattcttgatattggtgatatgtgtattttctctatttttcgttcgtttaggtgtttcaatactgttgatctttccaaagaatctgcttttggctcttgttgattttctattgtctgttttctgttttgttgctttttttctttattattattttttcccttatttgttttgttgttctttttgtagcttattaagatataaccttgggttattgattttatatcttcttttctaatgtaagcatttaaagctgtaagttttcctttaagtactaatttagctatatgccacatatttagatatgtttttagtgtttttaagttcagagtatatttaatgtccccctttaaaactgagatataggctgcacacagtggctcatacctgtaatcccagcacttaggaagaccaaggcaggaggatcacttgagaccaggagttcaagaccagcccaggcaccatagcaaaactttgtctctacaaaaaataaaaaaattaactgggcatacctgtgatcccagttactctgggggctgaggtgggaggctcacttgagcccaggaggtcaaggttgcagtgagctgtgattgtgtcagtgcactccagcctgggtgacagagcaagaccgggtctcaaaaaaataaaaaaacagataaaattgagatgtaattcacatattataaagttcaccattttaaagtgtacagttcatatgtttttagtattattcagtcatcatcattatctgattccagaacattttcatcaatccataaatatctcttgatttttatcttcgaatgataagttacttagcaaagtgttatttaatttgcaggtatttgggggtttcatagatatcttgttattgatttctaatttaatttcctatagtcagagaagacactttgtatgatttcagtccctttagatttgttgagatttattttgagatccagcctgtggtctatattgttgaatatatcacgtgcactgggaaggaatatgtattaagcagttgtttgaggtagtgttctgtagatattatttatatgaaggtggttgataatgttgttcagatcttttgtgttcatattgatttttgggggttctagttctctaaattcctaagagaggaatggtaagatctcctactatgattctgaaattgcctcttgctcctttaaattctatcaatttttgctttattttggtatgcattttgagtctctgttgttaagtgtattcacatttataataatattttctcatgaattgtcccttttatcattatgaactatctctctttatctattgtaatgccatgtgtcttaaaatctattttatctgatattaaaatagttactgtagccttcttctgtttactatttggatattacatctttttttgagttggtgtcttactctgtcacccaggctggagtgcaatggtatgatctcggctcactgagacctcgacctcctgggttcaagtgattctcctgcctcagcctcccgagtagctgggatttcaggcgctcaccaccacacccggctaatttttgtatttctaatagagacggggtttcgccatgttggttaggttggtcttgaactcctgacctcaagtgatccacccaccttggcctcccaaagtgctggggttacaggtgtgagataccacgcccagccctggatagtacatcttttaacatccattcgctttcaacctatatatgtctttatatttaaagtgttttttttttctcttttttgaagttgggtcttgtgtgttgtccaggctggtcttaaactcctgggttcaagtgatcctgccaaatagttggacttaaaggcacatgccaccatgcccagttctttgaagtgtttcttctagacaacatatagtagggtcttgcttttttactcattctgccaagctctgctttttaactgaaatgcttaggccattaacatttaatataattattgatgtatttgaatttaggcctaatatttcatttattttcttttcatttctcctatttattattcctctgttccttctgtcctctctccttttgtattatctagatacattaagtattctacttttatttagattttttggggggcttatctatgtgtatttctagtgacttctctaaggattacaacatacatatctaatcttttatagtcttctttgagttgataattgcacttaacgtaaaatttagaaccctttcaaccatacaagtcccttttctcctcccccacctatatgttattttcatatttatcacatcaacacacattacaaaacccacaaagcagtgtttgtttttgcttcaaattatcatatgaatttcaaagaacttaaatatttacccagatatttaccatttctcttgcttgctcttcgttctggaaaaatctctgtttacccatgggaaatttccctatagcctaaagaaattcctatagcatttcctgtagcgagatctgttggctgtgaattctcttgtttttccctcttttgaaatttctgttttatttaccttcattcctgaaggatatgtttattggatagagaattctgggttgacagtaattttcttccagtactttaaagatgtctactgttttcttgtttccgtgggttctgatgagaaacctctcttcactttagctatcattctcctgtgtgtaacatgccatttttctctagatgctttggagatttttttttcattggttttcagcagttttggtatgatgtgtctaggagggcttttctttgagtttattctctatgtagatgctgattttgaatctatatttatatctttcaacaaatttgggaaattttcagccattatttcttcaaatattttttttctgctcccatccctttctcctgttcttctcggactccagttacatattagacctactgttattgttccttgtgtccttggcaatctttctttctttgaaatcctttttcccctgtatgttctctagaacacacagatagatctgtaatttctacagatctatatttattttgaagttcactaattcctttgtcattgcttttctgatgttgagcccatcagtaaatttcttatttcggacattatatttttctgttataaaatttgtttggtttctttttaaaaattgtttccacttctctgggagaattcttttctctcattcatttcacgtgtatttttctttccctcatgggacatggttataatagctattttaaaattccagccaggtatggtggctcatgcctataatcccagcactttgggaggccgaggcaggtggaagcacttgaggtcaggagctcgagaccagcctgaccaacatggtgaaaccctgtctgtactaaaattataaaaatgagctgggcgtggtggtgcatgcctgtaatcccagctacttgggaggttgaagcaggagaatcacttgaacccaggaggcagaggttgcagtgagctgagattgcaccactgcactccagcctgggcaacagagtgagaatttgtctcaaaaaataaaaaattaaaaaaatattccaatatatgggtcacttgggattggcaccttttgactatcttttcctttgagaattggacacatcttatggatatgtttgtatgctgtatgttaagtaattttggtttgtattctgcacatatgaatgaaattcatgaaattaagccttctggaggatattgatatttttgtctcagcatgtaatcagcctgtttaggttctgaccctgagttctgtcttgctttctgtaggtggtagtttaactctcagttcagtatgctaagcctttgttacactggtttgtgtctgtttcatgcacgtacacttcaggggttaggctgcgacttgcgtaagttcatatacaaaattaggggatttacttttttgacactctctgctatgggattccatccacactttacctaccctataggggctcctttctctggttcctttgggggaaataatatctattgcagttttagctgtgactgagactgaggtgcaccccatgactgggacttttccttcgggcaaagctttaccaggatattcatgacttgtgtgtgtagcttctctaggttttaaatctccacaagcggcttgctttcgtttacttttcagcatccactggtagttgttttttgtccagagttttcagctgtaattagcaggaaggatgggctatagagggctaatactgtcatagtagaactgaaaccccagttacttaatttttaatcaagggttggtgggagtcatagatttggatttgagtcctacctctgctgttcacagtctaccattttaatattaagcccgtgtttcttcatttgggaaaaaaattgagatactagaacttgctccacctgtccctaggattgtgtggaacagatgagataatggatgtcaatgtcttctgtaaacggaaaaattgttttcaagtggttgtcattgctgttatgtctatgtgcacgtgtgtgcatgcctgtgggcatgtgtacatggtttctgcacaattacctccacagcagtggtgtcaccatggatttttcctcttcaggcacttcctggacctcactactacacatggggagaccacggcggaatcatcacggctattgcccagggcatggaaaccaacgagctaaagtaagtgtctctgatgaggccttttaacatcaaactttctcccagaaatttacgtctgtgattataattggattatctctctatagcactatgttgttgacagcacaatttgtgatctctggatatgagttaaacttttttttttttttttgagatggagtcttgctctctcccccaggcaggaatacaatggtgcgatctcagctcactgcaacctccacctcctgggttgaagcgattctcctgcctcagcctcctgagtctgggattacaggcacctgccaccacgtccggctaatttttgtaattttagtagagacacggttttaccatgttgatcaggctagtctcgaacccctgacctcaggtgatccacctgcttcggcctcccaaaatgcttggattacaggtgtgagccactgtgcccaccccgatttaaactctttatctcccaaatgggaatataagaacctgtcctttctatcacaaagggagattgtgagcaagagggcaattaataataatggccaaataattaagtggaggctctttaatttgtccttctttgctttgtgtctttattacatagaaagactaataataaatagcaataataataataataatacatcagtaacaattacagaatgcatacaacttgatagccattgacttttggtgcgttaggttggtggggggtctcatggagctggaaggggtgtttagggttaactgcatcatttcacagatgagaaaacaggctcagcaaggcaaagtaacttgcccagggtcattccctttgttagtgacagagacaggattagcacttgggtttttcgattgcgtcctacattctttgcaatatattgttctgaaaagcaaaactgtcaagagtttgtaacctctacacccttatgttctgattttatcagaaccagtcctctgattacctttggctcgtttctgaatggttcatgttaggtcaagttcatgctggaccacacttctccctgtttttgagctgaacccattagatggattggtgaaggatctggagagggcttctgtaactctcttgtttattgcaaggacaaagctttctttttctttgctccttttagaaacggggccagcagtaagtgagaggtgggtggtttggaaaaagagatcttagcagctgtttttttttccctgtggttaatttgacatgtgctgagcagcctggcctcagagaaggagagagaagcaaagtactggtgtttggcattccacctggctgttctctgttctgtgtagcactggttagctatttctttagaggtgatactccgaagaggtcctgtttgtgtgcaacactctgtattcatattcagattggtgtttgctcagacaacgaccatcacagagcacagtacttcccacatttgtgctatcatttatatacccattaatttaattttcatttcacatgttcaccaagcaccgattgtgccagatgctgtgtatctgtagatgaataggatgcctgccaccctgtagttgaaaggtgggcgacgaaacaattgtagtgtttggtatactgctatgtgtgtaatacgcacgtaggggacatagtttggcttcctaggaatacatttcattctttgtatggctttcagatttcagagtcagttctcgatttgccttgtttaacttctctgaaaattaaatttgcattccaaactggctcctctgaaggagttagtgtgattctagtcctcttacaccatctgtcggtgcatatgtgctcagggaacgcagcgtcattctgcacgagctggagcaaaacatgatcaggaaaataaacttgctgccagaaaatcataaagccttccccagacattttgaaatgacttgggggttgtagactttgggggattatggtcactgtagcattcctctatttgtataggtttcatttggaggtgtctgtttgaatagttcaaataaagcatttgaaaatacgaaaatacatacaagcctcctattgacaggtgcatgtgtcccacataacaacctgagcttggcctaaatctgtgtagccacctggcatttactcagtgtgttgttcacagaggtattttgcttcttcccctgctgctctgaaaagcaagaaataatattcaagttagttgatattctcagactacaatggtgatttactgtgacacccatgcacaaggacaggtggcttctgacaagactggatatctgttgctgggctagggcctcaggccccttctaagtttggcctccccagtcacagagatctcttttcctttatgactcgtagcatgtataggctgtcccattcatttggcattgatcatattctgactccttatgttagttacctttacatgatgcgcctgaattctgcaactcgttagtaaggtctttgtaggtaaatatttctgctcgatgtaggttaccaggcacttagcaaatatttgattgaaataggtcatgcatacttaatcatccaagattgcttatggtttttttttttttaactgatttataaaactagaggagaccgagctagtgtgccaattgcacagctccaaggggaccactgccactgtgctccatgtcaatgacaacccctagagcacagatgtgagtggaggctccctggatgtgtgcaacccggtagtacccaagagacaccagagatgacctaatctactttccttagttttcacatgagggaataagagattagtcaggagttaatgcccacactggaacttgagcatatttctgttaggaatcatttcaggtccattacacagacaactgtcgaacatctacaatgaagcggatgctgtgctggataccaaggatgcaaaggcaagtggggcactgatcgggagctgcctgtgcccactgtggctctgtgatgtttctgagccagatgcagagagagaggctgggaggagggggttgtttgaaagagggctttctgctctgattttactcatctttagggagggaagccaagtaaagtagcattagtaactcaaataggttgtagtggggacagcaattgaagcattgctcaaagtaaacattagggttttttttttttttggtcgatgttcttttaagttatgcatgtctttctctccctgattagcacagatatctaggagttgactgttatttgtttcagcttctgccttgagtctcctctgagactgttacctttgttattgttaattgaaattgagagcaagaagtggaacactttgttttgctcttgtgtctacatgtctgaaatgggtaaataagaacctgcactggggatccacttattcgttcattcagcccgctgctcctgtgaacctgctcacgggaggcataggagcagtggctttttcgtcagagaaggggctgttgcatttttgcaccctgaccgaagaagattcaaacacgtttgtcagcttgatcacggaagagaagatcaatttctgtttcttcgctgcggtttgcttgtcagcatgatgatatttttcgtagtcagtaataatattttgaacttgccccaaagcatcttttttttctaagacatccaatttcataggggcttctctctggaaatcctgaaaagcccctgaaaagactccacgcagcagagcagctgtcttttctggacctgggctctggaagcagccccacagttccagaatgtgggaggcagtggttaatgtcttcacttgcttgcagcgcctctcaatggtacagttgtcgggagagccacccctactttatcctaacccctgtggtttttctgccccttgaggtatagagaagcaggtgttcttatcactgtgtttttttttttttttttttctggagttcagtggtgcgatctcggctcactgcaacctcctcttcccagactcaagcggtcctcccatctcagcctcccagtagctgggaccacgggcaggagccaccatgcctggctaatttttatatctttttttttttttggtagagacaggtttcgccatgttgcccaggttgttctcatttgaactcctgagttcaaagtgatccacctgccttcctaagtgttgggattacaggtgtcagccaccaagcttggtctttatcaccttttaactgttaagaaaccgagaaacggagttgcagtgcagtttctttaacttccttcaacaagcgtttatgaataatgccctttctgtgtgctaggaaagattcgaggtgccaggggcagaaaagtaagaggtcttattcctgatgaacggcaatccagtagaaaacactcgcaaaatcaagtcactgaaatacagtgaggtataagattatggagagcgctgggtgcggtgggagccagaatgagggccaggtgatgctatctgggggacaaaggaggacttctgagagaggaaaccccagctgaacctaaaaggatacaaagcaaggtcggaatgcttttccaggtctagagagaccttgagcaagggccaaagcatgatcagtggggaatgtgcacggctcttgagtattaatagaatgcaaatttccaggtgggaagtagtgagaaacgaggctggaggaaggtatctatgtagaggccaggtcctgggggacctcacctgtgccttactaaagagattaaagtttgctttgaggtgatagggtccctttgaaggattttagtaggggaatgacatggctagacttgcattatagaatgatggatctggcagaatggagaggatggattcagtggagagagactggaggtgagagctgatgctggggtgtgtttgaggactaagtctgcagggcatggtttctgattcacctgggatgatgggagaagtgattataccgctcatagaaaggcagaggtaaaggagtaggcttgcagggctgtatattaaatgcagacatggacaggttgaattgaagcctctgttgtgggtccaaggggcgatgtccagcaggaatctggacatattacaatatctggtgcagccttccgccaccctttgcaagaattttctccgtgccatctgtgatagacaatcttttgttctatacttgaacatttctattaatggggaatttgccatatcaaaaggtgcttccattttactttgggacagtttgctgttcatttgttcactaattcatttgtgaattaaagttctctggtaagggagagcccagattctcctccctccagcttctattcgtggactttgttctgctccctggagatgcacagtagatacttccttttgcatgaaagcctttcaagtatttaaggaccctgtcatgttctcctgagtgtctgccatttcatgatgaatatcctcggttcctttcctcatattctatagatcctcaatctctatcttctaggttctcccttaggtctgcctcacgatgtcagtgccttaaaatgtggtacctggatctggccccaatagcctgaaacatgcagaagatgttgagattttgtcttcatgattctgaacactctgtatctattaataaaaacctctgacagtgtttccatttttaacagccatctcaaactggtggctcctatttttttttttttgagaggaggtatcatttgcataccacaggatgctcagatattgactacaccatttaatcagttctgaagggtgcatgtcaagatgtagagtatttccatcagtccagaaaatactcacgtgcccctttccagtcagtgctctccacccccaaacccctgccccaattacaggcaaccactggtatgtttatcactgtagctgcctattccagaatttcatgtttgtatgttttgtatttggcttcttttactcagcataatgattttgagatttatcaatcttttaactggtatcagtaggctgagttcactttaactaaaatacctgagatccttctttcttatggatcttattatacaatcaatcaatcaacaggacggatgttccccgtcctgtatttgagcaaacaggtttttgaaactacatgtggagctttatttttatttttgcttatttttttttggtttgaattgtatttttggcatttatttatttttttgagacagagtctcactctgtcgcttaggctggagcacagtggtgccatcttggctcactgcaacctccgcctcccaggttcaagcgattctcctgcctcagcctcccgagtagctgggattacaggcatgcaccaccacgcccagctaatttttatatttttagtagaggcggggtttcaccttgttggtcaggctggtctcgatttcttgaccttgtgacccgcccgcctcagcctcccaaagtgctgggattacaggcgtgagcctctgtgcctggccccggcatttattatattatttatacaattagccttttaccctttgcaaatttggcagattcgccttccagatccctatccagatcattgacagatgtgttgagctctgtgagaactagaagtcttatcttgggttgagatcaaaccatacgtcagcactcttgggatgtgcttattttaccatcagtgaattttatctgactgcgtggtccacaaagatcttcatgaaaaaaagaatgttctgtgtcattgtcctgtttttcaaatcaagaattaccacgaggaaaggaaatggagttagtctgttgtgacttgtgtgtgaaaccatttgggttcttagccttgacctccttttcgtctgagtgctctcaaataaactgtttcataatccattcttgaaaccaccttttcttcattaaggaaataaaagtattttccctattctagtttttgagatctttgttcttcataattctcctagagattattgaaaaggatgctataatcatcctatctttaagtctttcagttccttagaatttattttgtactgattttcctttaacttaaatggtttttcttgtccaatttgaagattattttccttgataaagataaaagcaaaatagaattttttttctattttttttagacccagctttactactatgttgttattcaaagatttttttctttttttttactaacgaagtctttatttcttttgttttcagctttccaatcagccagaaaacataaagtattttcaattcaaagttctagtaaagataggaagaactgggtgatggttttcataaatgaatgaatgaatgaacgaatggatgaatgtgtatcaagtgctctgtttttttaaattgatacatatgattatgtctgctattatttattctattggccatcagagcaatgatcctattcctttctaattctttatagaacttgccagataaccaatccactgacccaccagtctgccaattattttggtaatttgaaacataaaccttgattcattttgaacttatcttgctactattccaacagactactggctatgagaattacagctggaattagctagcagtaactgaatttgttgctcttggttatatgaccttttttcccatcttgaatatgttctttagaaacctgaactcatcaggaacttttctgggtagctgcctgctagagtcctaagttgggtatctaccacacttcttccttttagagtatctgtggttatattatgttttattattatattatctgaccttcccatcttcttgagagtttttggccctgggattatgtctatatttttatctgaacagtttgatttcttcattcctaaaggctagtgccctatatcctctttcataacttaagaatgcaaagatgggccagacgcggtggctcacgcctgtaatcccagcactctgggaggctgaggtgggtggatcatttgatgtcaggagtttgagaccagcctggccaacaaggtgaaatcctatctctactaaaaatacaaaaaaaaaaaaaagaatgcaaagatgactttgtttcttcacaaggttcttgtcacttacttttaccaatacaagttctcctttgggggtcagaattcagtccaaaatgcgtgttctcttaactgttgctgttgataagacaagagccttttccccaaaattctgaagagcaccattttctaaatgagcagtgtattttcagatacaagctatgcttggtcatgtacctgcttgttatttcattaatgagttattgtcagagtcctctgggaactctcaagaaatggggtgattcatttcctgaggttatgttgggttcgaggagctcttaaagagaattaacttggcaacgtacacatagatagactttagcattaccactgagtgggcagatggctgccatcatgtctggataataggttgactctgttggttcagtttgctttaaaagtaatataaacctttagcttcacactggttacaagaaggagactgaatgagttaatttatccaaatatctgtttcaaaattttcttaaaccaaaagcatatctgccaggtgagatttctccccttgtgagagatttgtagggggagattacttagtctcccattgacatttattattctgccttgtaaccctaccagttggtttaacccctagcctttttgtagcagtatcttttttttttttttttaaggcagggtctcgctctgtcatccaggtgggactgcagtggtgcagtcatggcacactgcagcctcacactcttggactcaagcaatcctcacacctcagcctccagagaagtagctgggaccacagggggcaccaccacacgtgactaattttttaaaaaaattttctgtagagatgtggttctcattatgtttctcaggctggtctcaaactcctggcctcaaaagatccttctgccttggcctcccaaagtgctgggattacaggcatgtgccaccacgcctagccaaatcgattttaataatctcaatatgagatgaagtgtttggatagaatgatgtcacgaaaagatttctgtcaaggattagaatcccaaaggtgtaaaactaaaatctcaaaaacatgagaaaggtgaaagaaaaagttttgcatataatttggatttaagaaggacccagaagccctgtgattctaaagaaggcttgaattgagtgatttctcatgtcaagcgtctcaccagctcactgggtgataaaacaagtgttgggcagattttcttccttgcctccctctccgtccctcttctccttcttcgacaccaaagataatgtaaaatcagtgcagttactcaaatgctgcttagtttttcaagggctggcttcctgcttctgttatagtctgtcttggagactttcctcagtatatactttccttcaactttttactttttaatttctaagaccacgggaaagttggaaaaaccgtataacgaacacccatgaaaccttcacctagagtcacaaattgttagcatttgccggtttgctctacttctatcattggtctatttatctatcctgtgtatccatccattattttttagctgaatcattttaaagaaagttgcagacatcatgctccctcacagctacttaaatgtgtatctccaataaataagggcattttcctatataatcacaatgccattctcacacctaagaaaattaacatgaactcggtatgacttatagactatattttctcagttgtctcaaattatttatggccacttttccccttcaatccgggatttagccagtcctgaactaaatcctggattggatttacacattgcaaatttgtttagtcattgcatttggcttttatactcctttagtcttttaaaatctataacacattatctgccttttttctttatttatttggtttttgtggccttgatttttttttgaagaatctggagcagttatcgtgtagaatatcccacattttggatttgtccaattgtatagaatagtacacagaggatgtgttattctcaatgctttattcaggaggcacctaatatcaagttgtcctgctattgatgatgtttagttaagattgtgactctctgatcattcattgtaagattatgttttgtaaaattttatttccccatttgtagtgaatgatttgtctgttcagatcatctgaacatcctggccccaacactttcaccgaatggttttagcatccagtgatgatccttgtgtgatttagttattgcagtggggataatttttctgtaattatattatattatattataatatatatattgttgtgtccaacccttattaagtgccattctaatataagaaaaaaattgggggccagacacggtggctcatgactgtaatcccagcactttgggaggccgaggcaggcggatcacgaggtcaggaggtcgagatcatcctggctaacatggtgaaaccccgtctttactacaaatacaaatacaaaaaaaaaaaaaattagccgggtgtggtggcgggcacctatagtcccagctactcgggaggctgaggcaggagaatggcgtgaacccaggaggcagagcttgtagtgagccgagatcatgccactgcactccagcctgggtgacagagtgagactccatctcaaaaaaaaagaaaaaaaaaaagaaaaaaatttctcttttgctcctctgtcttttagtatcattagagacccatgtcctattttcattcaatgtgtaatctgttaccatcatttttcttttttatgtttgaattctcctaaattcggccagttggagccccatcaggctggttcctgtgttcttttgagatgactgcatttatttctgagcatttccttaaactttccctgccttagcccaggatcagccatttctccaaggagccctggttcctgttcctggtgaatgttatatggaaaccaagcctttgccttagagactttcactgcaaggattctcttacttgcatttgggcagatacagtaccaatgaaggggagacctggaaaacattcatcttctctgagaagccagtgtttgtgtatggcctcctcacagaacctggggagaagagcactgtcttcaccatctttggctcgaacaaagagaatgtccacagctggctgatcctccaggtcaatgccacggatgccttgggtaagctgctgcctccttggaccttttcacatggatatgcgtggacttcctgttatgtgcaaagcaccagcttagatactgtgtactcagaagagcctgacattcattgggggagatgggcccataagagttagcaaaaagcatagggaggtaattgaaggcctgctcaattcttcttagtaagactgggtgctattctttgtatcttagtttcctcatgcagttcctggcacataagaagtttaaatatatgtctgctgaatatgtagataaatgcatgaatgaaaaacatatttccaaatcagcagtgccaattggacgtattcagtgagtgtgcctgactgtctgtaagtcagtgtgccaagcgacacagggtcctctcaaagccatctaggatctagttgtgatctgctaatctagatacaggatgcataagtatgcagggagaagtgaaactcttcagcatcctctccctgcttccccatcttatcttaccctttcctacctctcagccttggctaacctgattctagctgcccggagtgccctgtttcttctcatttccacccgttcagcctcccctactcgaaatccttttcatatctcaggatccaacacatttgtggctgatatcccaaccagaagacgtctcccttcttctctatgtccagaacataagtgtatgcataactttgtgtctgtcactcggtgtgtttcaccttccattgactagattataaagcccttaaagataagaacttgccctgtgcatatttgtattgtacctactggaaagcctgatagcctaacagtctgtaggagtttaataagtttactgatttgcatggcattgagtcaaaggttgtgtatcagcttcgggtagtatctaatctgactgaagacacatatataagagacacaaagtgccaacatagacataggcatactttggaatgcttgtagaaagcaccctacttagacatttcgatgaacgtggcagatggagtgatggtgcaaggtatcttagcattttccagcctctttccatggagatcctgtaccttcaagtagggccagcgagccctccattgccttcgggccacactaccagatgtgccctcactgcctgaggaagcaggccaggaacattaacccccaatggtattgctcatcaaggattcagctgttccctagttctctaggagagaaacacttctgagtactcatttctaaagggcactgctgactcttctgtaatgtttcggaaatttggatagtgcctaaaggtggcttgcttctttccaacttttccaggcagatgcctgcgtttcaggtatccttttcattggcatagggctgcccagcttcaaaacaagctgattggagggtctgtgtgcttgcggggtggcaacagatagacaggaagtgggggttgaggccaggcaccttgaggcatagcaggaaaccctacatgggcctgcctctaatgcttcgtgctgtgttcctttttctttaggagttccctgcacagagaatgactacaagctgtggtcaccatctgatgagcgggggaatgagtgtttgctgggacacaagactgttttcaaacggcggaccccccatgccacatgcttcaatggagaggactttgacaggccggtggtcgtgtccaactgctcctgcacccgggaggactatgagtggtcagttcttctttgatggctggggactgagttgtgttttattcactcagcagtgttgggggaagagattaggcatggtccctttccctgagcaaaggaagggaatagaaggaaacaagtatttgtgaagcatcttttatgtgccaggaactgtgctaagcatgtttcatgtaagttgttttctttagttcttatagccaggtaatgcggtagaggtgtctaggagagctgcagctatttctacaggaatagatagctctgggatttatttctattagggtaacccaaaaatatgctgaaggtttcattgtttttaatccttctccttaggaccctattctagaggggatttatttctttatctgaaacgaggggatgttagtgtgtgtatatgtgtgtgtgtttgcatcatttattattccttaagcaaaatatccaaggcactgctgcgaatgctaaaagtaggagaagtgatttgtgcatggctaattggcacaggagatagaagagagcaagtgcctcagaggaggaactggtacttttattgtgactattgaaaggaaggagagggctgtggattgctgttggagaatgaggagatttttggaagaagtgctgtttgagctgggctctcagggagcatcaatatttgcagacagcagtgttttgagaccatgtgtctgcaacagtcaggtgtagaggcagcagggtgtggttgggagttgaattgggatgccttgttgggtgtatgacatggggatgacaattggagatgaggctgaaaagatagaatacagtaggggagaaagaccttagaggggatgaaccttattctataattaggaggaggccttcagcggcttttgaggagagttgatgatgagaacagagcttagctgtaggagcttttgaggagagttgatgatgagaacagagcttagctgtaggaagaggattctagtggcagagtacagaggatctcagagctcctggacagtcactgtagtctgtaattcagcatgaaatcattgtagtttagtcaggagcaccaagagagccatgggtatttaatataaatacacaactcatatttcagtggttgctgaggcacagaggaactagattttgctttgggcagctgtacttgtcttgactaaagccagaaacctctgatgtattctagaccagaggttggaacatggtcatatagtaaatgttttagactttgtaggccatatggtttctatgatctgtgttacaactcctcactttgcccatggcagtgcccatgggtgaatgaaagcagctctagaggaatgaacgtggctgtgatccagtaaatctctatttacaaaaatggccaaccaggtttggccacttctgttctcaaccagtgcttctgaaactttaaggtgcatatgaatcacttgcagattctgccttggtcacatgcagattctgcctcaggagttctggggctctgcgtttccatcaagctcccaagagatgtggatgctgcttatctgcacattcgccctttgagcagcaaggcttagaacagagaagacagtcatttccttagaaaggtgtgtgctcccaaggtaacgacacagactctttaacagcaaaagcacagggctggctgatgttcttggtgacttcagttccatgctgtttgccttctgctctttcttacacacttttgcattatagtctaatctaatctgagagctttgttggctccaggtagtcctccccagaccagcttgagactggagaggtcctaatccctgaaaagatcatagtgccctctctctcccctcttcctatccccaatatgtacttcaaaataaaattaagactaagtaaaaaataggtaagaaagtctaacaaatctttggggtttttttttttttcatgacatttaggcttaaaaacaaataacattaaaattttctctcttgccctacatttccccaaccctcaccaaaaaaaaaaaaaaaaaaaaaaaaaaaatcacacacacaagaaaagaaatggagcttggtgtgccctcctgggtaaactggcctgggacctgctggtctaccatgcccaccccatctgccttgctggaacctgctgtatgctcaccctgcttgtatgtggagtgtttttattgtagaccagtaaaaccacctgctctgccccttgtggagttgggttgcaggccaaatgagatcgtggggtgatgaccctctgaaatggtaaggggtatatggatgtcagctgttccccgctccacccctcccaattgtttctctgcttgctgtagctgctggaaggcagccagcccaactatatggctcttggagatgtttgatggcattggactatggcactgagaaggaaaatggtcccaagatggacgtcaggaaatgagatgagaatgagcaagcttatagtatctttccattagttcaggtactggttgacaactgtgtttgaacaccaggttatttctgatagtccttttagaccacactgggaagcccagctattggcccatgtttcctgatttccatggtagattcttttatgttcttatatttctcgacattgccaagtcatacagctttcacattcttgactgcaacccctagtaaataatacattttctcttatgaccctgtacttacatatgtacgtgtagatacatacacacatataattaaaacacaagttttaggagacaacattgacttttaaatgtatgatggggccttttgcaatcttttgcacttttttgggaggggaagaatctagtcttgggcctcccaagtactctcagagtccactaggtcatgacctatggtcaaagaaagctgcccaggaagagtgctttgctattggaggcaaataagtaattagctaatgctttatctggttcctaaaaagatttaaagtggccgttcagtaataacgaactgaggtaatgaaagaggcacatttgatacagtgacaaaactgctgccttttgaacaattcttacaaactattaaatgtggattatgatataatgcacacaaatcactctctgtgtatctgttaatactttttgtgtcagaaatgtttaatgaatatttggagtttttctttttgttttttgtttttctgagacagagtctcactctgtcacccatgctggagtgcagtggtgcaatcttggctcactgcaacctctgcctcccaagttcaagccattctcttgcctcagcctccagagtagctgggattacaggtgcgtgccaccatgcccaactgatttttgtatttttagtagagacggggttttgccatgttgcccaggctggtctagaactcctgacctcaagtgagccacccgcctcagcctcccaaaatgctgggattacaggcgtgagctaccatgccggacctaaatatttgttgaattgaatagagcaaataaatgtgttctggtagagcacatgaacgtggaatatatgttctgttctataattctttgaatatattctgtaattcattgaattatagaatttacaggtttggaagggccttagaacattcatagtacagtcacctcgttttagaatcgtcttcgactgaggcctcctgcttcctactccaggatgctgcccttcaagctgggaggtttggcagatgtgactccagatcacaagaggtctcatgaacctaactactgtatctcaaagtacagggtgacttagctagtatgtggatatactcttaaataacattgaacccctagtcaaattttttctttttttctgagacaggggcttgctctgttgcccaggctggagtgcagtggcgcaatcacggctcactacagccttgacctcctgggctcaaatgattctcccacctcagcctcccaagtagctgggaccacaggtgtgcagcaccatacctggctatttttttttattcttttttgtagagacagggtcttaccatgttgcccatgttggtctggagctcctgggcttaaacaatatgtctgccttggcctcccaaagtgttgggattacaggcgtgaaccaccatgcccggccccaaataattttttaaaaaggttattcttttaaaattcctcttttacttcttcagattctgtcaaaaagaacgtctcattggttgctagtaactgtaacatttgcctaatcccttttaacagagagggcaggtccagagtcttaaattgggaactggatctggctaaaatttaatactgttttgatttggcatgatgattttttttttttttggtctatttatggcatgtgattgtgtttttccaactgtggttctgatataaatcttcttttgaagatgtattttatataaaaagtaaatattctttaaagggacatgttaaataacttataataaaagtgaaaagtagtaaggtaaagtcagcagaattggtacaggaatgcctgaaatgtataaaaccgtggccttaacaaagcccaattgcctttttagtgacttcggtttcaagatgagtgaagatttgtcattagaggtttgtgttccagatccggaattttctggaaagtcatactcccctcctgtgccttgccctgtgggttctacttacaggagaacgagagggtatgtatcacagaggttgccctgtcaggttctcagcggtccgcacatggagcgagagagcatagaggaccgtctggattgctctacactcgaaattctagaattccaagttaacagcctgcaagtagtttgggcaacattataaattatggtatttgtaaactctcctacctccacattgcaagtctgtaagcatccctgaaactctaggaatatcttaagtcatcaacttcagcagggaaacatcttcagaggaatgtattcaagagatatatttaaaaatcttggccaggacagtgccctaaattgtctgggcctgcctagtctaattataaggagaactgactcagaactacgaacatcctctttctagttctaaagagaaatgagtggatggactctactggccgtgggtagtaagtgtattcccagctgggatgcctttgtggctattcttccatgtttctgacctcttgctcttggggtggggtgacagctaccggaagatttctggggacacttgtagcggaggagatgttgaagcgcgactggaaggagagctggtcccctgtcccctggcaggtaagagaggtggtttcttccctttcatttcttgagacatggttgaagcagtatcacgatctcacccaagtccgggcttgtggctcctttaattgagtggagaaaaacaatggccgtcacaagcatcacagggcttcctcttttccctaaggttggtttccacactgaacttgtacatagccatacccgtttttaggaatggaaagtactttgtgtcagctcagtttctttgagggaaatccctttgttaattgaaaaatatttattcagcatccactggggtagaaagatccccacaggcttttgtgtgttccttaatctgtttgtcaaagttgagtataaagaggtgtgtgacttcttaggaagtagctaagtagtctatgttaattttataataaaactaactgtaactaaaattttaatggaattttatagatttcagtgtactttttatgtgttgccagtttaacccttttaacaactcagggaagcagatattatcaattttgttttttactttttcacgaggaagcatgttcagaggaggttaaatggcttaaggtcacacatctagtaagtgacaaagttgaaattcagactctaagccccatgctcttcattggacattgcccaaatggcaaataaatatcattctcactattttagataatcattatgcatgctaattaagaaaaacttctctgaaatgattcacatgctataaaggtatagtgtgttctaaaacacgtttctgctagatttagtggtgatgtaacatggggtctttaccacagagacatgaaattatgatactttgaaaaataatctcttagttgcttttcttcactctgtttccagttcttattcatttaaagcttctttattccctctgtgccctctttcctgcccattacctcttggtgaaggtaaatggctggagttaacttccgtctgtggtgggtggtggtgtcttacgtggacagccataagcaccgaatgaatcatgaaagaagtgtgtggtctccacaggcagggcagggcagccctctcttttgctcactgccgccagcttgccctggtgtttttcatgctaagttcgttagtcccttaatttaatctttcatcattaccagagtaattaacatacctcactatggaggcttgaaaagaaccaccacttcagcaaattccaacaaatgagcagataatattcaaatatttccctcacaagagctgttattgatgagggcgtgggttagtagggtttgagtgattgctcttgaggggctggagtgcctacttttgtaataaatatttctgaagataattcagcaagggacaaaacagtttgtttaaagccatctaaactggcaggaaagctattttctcttctactggaagatagaacagggaacgaagtggagaaatctcattccattgtgggccacctcctatgtaaaagagagaaaaaaaaaggcatggaataggaggcagggatataccaggaaagaaaaagatgctttcacaggactaatgggggccgtaatatctttgcaaagatgaggtaatctgggcatctggaaggattttttaaatgcaagaatttttcttcctttacaattactatgaaaacacacattccttggccaggaccagccaagaattccattccttttccaggttaagcattgcgcgctggaatgccgcatgctgctctgaacataatcctaaaacacgtatttctggattcaggttctactttatgggtattagtttcttagaggaaaaaaaagcccagagtgacagaatgaggtttatagatgctggagagagatgtggggcaaaagccttgctgctgcaaatgtagctttcatgtccctataccttagctggccccctccctgggaatgacagcgggaaggtttccttgacaaccaaaaggggaggtaggttaccatgtgatggtaacatagatacttctaaagtgacctggaaccaaaggaaaagaaggaaaacttaccttattaaaaattgtaggtagatttattttttgatgcattatctatattacagcttttataaagaaggtgagtggtacatgttaagtcactgagtgtatggaatcaggaagtgggcaggaatggctaacccaggcatgcagcaaaagaattccgatttgcatcttggtcccatatgcaacacactgtcaagatgcacactttagacacagatgctggtgtgctgcttgtgtccactcctggggaagaatctggatgtttcccaagccgttccctaagtggacaagacagtgtactgggtcttcctatttccagttgtctgacattaggtaagtatcttcagcactcaggaccttcatttctacatcttaaaaatcatccacggtagcgtctgtatcataacaggcagcacagtgtagtggttaaagcatagactctggatccagagtgcctgggttccaatcttggttctgccacttgctagttgtgtgaccttgggtgagttacttaacctctctggtctcagttttctcatttgtaaaatttggttaacaagagttctaccatcaggcagttgttgtgggtcttaaacaatacccgatacgtagtaagcacattatacacaatatgtacacaatttatatttgttgagtagaaacagaatttttgtggtgattatgttgtggaacattttgtaaatagccaagaacaaatgcattattagtattattttggagatctaagaggttcatagaattgccatatggtgttgtgaacaatatgaataagtgagcaaattgattagagagcttagttacaaagcttcagtgactaatggtctctcgtcaacaagatgatgatgctgtggtgatacagtcacgtgaggagggagaacagggcgattggtgtaattaggttggcaagtgtgacttgaagactggcaggcttagcccagaagtatggttgttgaagcatgcatattgggagatttagaataaagaaaaacataacaagtaaaacacttgcagatgaagaaacagattcactggagtttaagtaacttgcctgaggcagaaatgtgattccattacacacctcctgagtcttgatttctgtgctcttcacttggtccacaccacatgccaatgaatttgaggtttgtgtatgagaaacaaataggtcagatgtgctaggacctcttcagcatcccctgggtccaacctcccacgtgtcttgtgtgtctggcagaagagaacgagttcattctgtatgctgtgaggaaatccatctaccgctatgacctggcctcgggagccaccgagcagttgcctctcaccgggctacgggcagcagtggccctggactttgactatgagcacaactgtttgtattggtccgacctggccttggacgtcatccaggtgagtcagcgcttggtctgactgtgggagctgtgcatcgtgactgccctgtcctgataagctgcatgcagaatggcctatggaaatgggcagttagaagtttgtaagtgttactcatctcagggctgacaggtgaaagtttccagtcttctgtgttagtatttttctttctctgtcttcatctgttcatataggaaggataaagaaagccctaaatccacagacctgcttgaaagtgaggtcttgcttttcctgctgggaaggtgttgggactagtaatgtaggatgattagttgcccccctattgtgccaactgcctcttgagcatctttcttcccaagccatgatacagtaacacttgacttacccatagctcacataattatccacttcagctgttctgaacacaggtaagaaccaggaagtaagcattaaagagccctggacaggccaggtggatagccatacgctcacacccatgcatttaaaggagagctctttgatctttattcattgtctacttaatccttttagaaaagcaattccaacaaatttttatctagattccaacccaacagaaatttcacagtgcctgggtatttgaggggcttggggtgggggatggcggtgatgctgaatggagctgtccaacaatagcacttgatggctaagagcctcacagggaagaaagagtataaaagcagacacaagaactgaaatgtaacagcagtctggtttcacttattttaaaagcaaacagactcatacaatctcagtaatctctgactttattattgccatacagcataatttagtaaccagtgttcataatgataatgcagagtaatatatatgattaaattctctttattctgctttaaaaaacaaaaatgtagtatattttagaaatgctttcatgaaaacctggcttcatgtgtctggaaagtttactaacgtaaaacatctcatcccttgccagtcctgccagttgaataaagggttacccttcatgggactgacttggcagggggtcgtttgaacagttcctagcatttattattacttttctctcttaagcgcctctgtttgaatggaagcacagggcaagaggtgatcatcaattctggcctggagacagtagaagctttggcttttgaacccctcagccagctgctttactgggtagatgcaggcttcaaaaagattgaggtatgtgtattttcgtgctgttcttaattaagggagcaggcggggcacctgggctttgagccacatttgacacagaggcaagggccagtgtgtcagattactcaggaaatttactgcgagtttccagagaatggaccagctgagcctctggagaggagagaaaagggggtaagtacctgtgagttgatcttttggctagcagaagcttagctaataacaataaatggtaatatttttattttatttatatatgtacttacttattttatttatatattatttttgttttattttactacttttattaaacatgatggcaaaaactacaatcacttttgcatcagcctaatatcatggtattattataatgctataacaataatcgtctagtattattttattcgattagagtgatagcaacaatatcatcatcatcatcatcattgccactgttattaatccccatttctctgcaacttagctacctagtaacctgtcccaccttatatacccaaggcaaggatgatgagtgacctctaaactgccaaatctttgtctgggggaatgtagtgtgctcagctcactgcctcagcacctctttatactgactctgcatggagagacggcatgtgggtgaagtgggaagtgcagtagaagcagggagatgcagagggctaagaggagttgcaagacgaaagacacagactcgagagatagacccagatgtaggcttgactccactagctcagcgacatggggcaaggtgcttatgctttctaaacttcagttgcttcatgcgttagatggagattcatatattcgcacaaccatttgacaggggttctctgcatgatacatgtggtttaggttctgatgataaagcagtgggcaggacacacacgttcttgttccagtagagcttagattttagtggaggaagcaaaataataaatcagttctgttggtggtacatgctgcaaagactctgaagcagtgcagtgtgattgcgcttttggagagtggggcaacattagaataggcagacagagcaggcaacttgaggttgatgtcttagctgagccctggctgagaagaggatgatcttttgtccacctcctggggatgctgatagaagtgaactggcatctactgaatgctgcctcggtggttatgttattgctctttctctcctttctttaattgcgtgtggtcagcacttggctaggggctaaaagaatgcaggtgatgcacaagcacccaccttttcacaggctgtggggcgaccactgcacaactcaaatactgttggtgcaaaatggtgtcagatgagccaaggtgcagagctactgatgcttattggtccaggtgggtcagaagagttaggaaagtaggcaggcctggcagtgaggtttgaaggagagttatgccttgattagattaagcagtggggcaggtaggcccaggatgggatgtggcaagagcagacagcagtgagtccgcatcaggcttggagaagcaagagatgaccagcctggctgacgggaaggagcaagaatatgagtcccacctgtggactcttcattgcaaggctgtgacattgagaatttgttttatgggagtgtggagtcatcgattgccttggaacgtggagtgacacgggatggtgaaataagtaaatgctcatttgcttatttacttatttgagtaatttacttattgatactgctttgtccagatcatcatgccctggaaactggggcttacatggttctagctcctctttcagaccacttgaaaattgtcccatgagtcagaggaaggaacagcgcattgtgactagaagttggggcaggtttcgcagatgggtcaggtcagggaaataggcaggcatggagggggcatgtctgtagcagaagctgagtagccatctttggcaatgggggtctttaaggagctccgatccatctcagcctcttttccccctgtttttgtcaggtagctaatccagatggcgacttccgactcacaatcgtcaattcctctgtgcttgatcgtcccagggctctggtcctcgtgccccaagaggggtaagtgttgccccaaaaggaaatcagtcttgcgtccaatgctacactaatagattctcatggaaacacagactgcgggacaaaaactctgtttctcatgatggtggttgaaatggtctattaactgagaagtttgagaccacagcttagtcatcgtggtcaggtaactccgttcgctttttgttagccagtgtcagagtctctttaggcatccagatgtcttgcatctgtgggttgtttctctagaaaagttgatgttaaaagagagcttctgtagacatagacaggcctgcttggatattgtgagaactttctcttgagtttcatgcatggtacaaacatttaattcattccatctttcccctgccttcccagcatgtgtaggttttcttacgtacaatcagtgtgcacttggggaaggcaaaggtgctttttattaactcattaactgaaggaaacataattaagagggaaattctggatttgacattctggcttttcctctctcgtagcatttatgatagagaattggcacaatttttttcaaggaaaattctaagagtaatgtatgtacttggttgacaatatttagagagaacagcactttatgaaaaaaatttgcattcttccttttcattcttaaccctttaccctcacacttcctagtggtaatcattgttaataatgtcttgtgtatctttcatgattgcttttacttatgtacaagtattatctttaaaacacacacatatacacacacatgcacgccaaataggattgtagtgtagttactattctgtacctttttaaacaaacttaatatgtattgaaaatagttctgtgtgagcatatatagatttttaggtttcacagtattctattatatgtaccataatgtgtcacttcctctgctgattaacatttagtttaatatacatacatatacatttctttgtatattatctttgcataatttgattttatctatagataaattctagtaaaggaatttccaggtgaaggaatttaagtagtttcaggtgttgtcattacatattgttataataatgctgaaataaccagccggatcattcgaaaggagtttctgaccttttctggagtagtatttgagctcccatttctctagtattgatgaggtatgtgttctgtccccattttcgctagggtgatgttctggacagactggggagacctgaagcctgggatttatcggagcaatatggatggttctgctgcctatcacctggtgtctgaggatgtgaagtggcccaatggcatctctgtggacgaccagtggatttactggacggatgcctacctggagtgcatagagcggatcacgttcagtggccagcagcgctctgtcattctggacaacctcccgcacccctatgccattgctgtctttaaggtgagtccatttgttgctgccggacagtctgctagagcgggtgaggagcatatgagatcaggagcctgcatccctgggctttgcagagaagctgtttaacttcttaaaggttgccttttttccaaatttgagataacttattttcagcctatggagggatgccaggcagaggcgccaagggtccaggctcccctgctgttcacatttcaaaaggttaaaagtgaaggctcttcccatgaacattcccagtttgcccctcagtgtcagtagcctcatttcagggtggtgtcttcattttttgtgcgctttgctcactttattctctgatgacttccggtgagctctgcaccacctatagtgccttgcagttctttttcgactctggagagcaacatggctcttcccaactctgggaaacagatttcaaactgagggggttgggtttgtgtcataaacttgaatgcttatcagatagtttcttttgggcagtttcttctgtggggttatatggtgaggtttggataaaattgctgtcctttgcatttaagtagaatcttgatcaggctagtcattcagccaataaatgttagttgtctcctgcctgggggaactcttacccttagagagaaccagaataaagaacgaaagagctggactaatgggcaaaggttttctttttagaatgaaatctactgggatgactggtcacagctcagcatattccgagcttccaaatacagtgggtcccagatggagattctggcaaaccagctcacggggctcatggacatgaagattttctacaaggggaagaacactggtaagccagagtctcttcttttgtctctgtagagttgatctcaagaaaggggctgcgtgtggccaatctctgctcagagtaggagctggcagcctgcatctttgttgtcacgacaacatgcacattatttaatttcttcctaatgacatcttaatttcttttctaatgatacacaaacagctggaagacagcatgcttttgcctgcctagagtgttggtgcttggtgggtaattacaccctcctcctgcccttggcccctgactgattggtggcgcggcttctgttgcagctgggagagtcctaacatgtgcttaatccctgtttggcatgcttgcaggaagagactctgtgctgggtgctcagatagttgttgcttcctgacagggcctcttgcttgttctctggttgcccagatgacctattgctcattgaccgtacctacctctgctggaatggcactgtgtagttaggtgttgttttaattaacttttcccaccatgaaaccctaaaccccatgaagaaagagatggtcttttttattccccgatagttttaccagtgtctagcactttgtaggtgctcaattcatatttgttgaaagaataagggatgaaaagggaggggaagaattgcagtgggtgcagacagtagctgtcttagagatctactgggtgaggcttcaagaactgctatgaggctttgacctgctagtcctggagtctgagactattcagtggaaagcctttatcatttcatgactgctctttgattttgcttatctcccagccatactattgattctagaggagaaagatcagaggattaccaggaagaatagtccctttaagaatttccctctttatctcagcaggattaaatggcatcctgggtttgctgattctcctttattgacaaactgctaagttttctgttcttaactggaatgttgatattgttttatggttcttggctgaccctatactaggagaaaattgacaggggaaataatactgttatagatatcattgttatcctcttgggattgtgaagatagcatgagaacaccctgggaaaactataaagtgtcttacaaatgtaagacgatattatttgttatgtcttcaccactgacctgtgaggtagggaaggctggtattatgatccatggtttatagattagggaattaaatctcagatatgaattagctttcccaaaatatcctcactagtttaggggctggccttttgttgcaattctgccgctaaatggagaagtcacattctttcttagaggaggcacctgttttagaatcaggagagttgaaggaatcttgcttctcagctccagtgactgaaatcttcagacctttgtttaatggaggacatccacccctactgatctgacttgctagctagcagagtggatttttagtatttctccaagtggatttttagcatttctccatgttaccacttagtccagaagagtgggtcttcatttttacaagtgcttgtatgcatgtgcttgtttgatttgcacacaggagcttctgaaacactgtgtgcagatgaagccagtggctacccggtcacaacttacttcccagtcttgactgtccacttcatcccaagaacttgggcacagctgacatgcagtcacacctgtgactgaggagcagtgcgggaggagagagtttgtggtctcagcacatgcaaacgtggtgtcttggtgccagtcagacaggtctgcaatcctcaccttaggtgtagtttccctttcatgcctcaaagagtcatcttcatttaagttagccagagtcattttggggcccagagtgaggtctggatagatgacaggctggtttaaaagggagatatgtattagcagggcatagtggcacatgcctgtagtctcagctcctcaggaggcggaggtgggagcatcacctgagctcgggaggttgaggctgcagttagccaaggtcgtgctgctgcactccatcctgggtgacagagtgagaccctgtcaccgaaaaaaaaaaaaaaaaaggctgggggagatctgtgttggtgagtagaacacagacctggacctgtgcatgggcggctgtgactgtccctttggccatggccagttgtcgcctctctgctcctttctgtttgcctttgggattttctcttgctgtcctttggttgtgagcaggatacttccaggagacctactgcctccaaacacagggctggagaaagacgtttttgtctttctctgcagcccagtttgggtcaaatcaaagcttttgcagtggtgtctggctgtcagcactgtctatgagcactccgcacctcttggccttgaacttgtttgctctaacctgcttgctttttttggacactgataggacacttgcttttttggacattgtattacagatccacggtgtgtgttggatctagcacttggagaaatgctaaaaatccactctgctagctagcaagtcagatcagtaggggtggatgtcctccatcaagcaagggcctgaatatttcagtcactggagctgagaagcaagattccttcaactctccttattttaaaacaggtgactcctctaagaaagaatgtgactcctgtccatctttattatttttgttgtctcctcctaacacattcgggactttctacagtagtctcctgcttatttgccattttgctttctgtgatttcagctacctgcggtcaaccactgtccaaaaatatatatggaagattccagaaataaacaatgtataagatttaaattgcttgctgttctgaatagtgtgatgaaatcttgtactgtctcctccctgtcccacctgggatgtgaatcctccctttgtccagcgtctcatgctgttgatgctgccggctcattagtccctttaggagccggctgggttatcagggtgtcaaagtactgcagttcttgtacgcaaggaacccttattttacttcatgatgaccctacacctcaagagtagtgattccagtaatttggatatgccaaagggaggttgtaaagtgcttcctttagggaaagggtgaaagttctagacttaataagggaggaaaaaaaatcttacaccgagtttgctaagatctgctgtaagaacgaaccttctatctctgaaattgtaaagaaagaaaaagaaattcatgcacagtataggtttggtcctatctgcagtttcaggtgtcagctaggggtcttggaattgggggttttggaataagaggggactactatattaaccaagtgttaaataataataattgatagtaactacatgtattgaggggttgctgtgttataagtaccacagtaatgtgctttgtgggcttgtataacctcacttcgtcttcccaaagacttctatatgtactatcaatatttccattttataggtgagaatatgaaagtctggtttagtaacttgtgtaggtcacacttttagtaagtggtaagaatttgcactgtggcccgttgacttcaaagcctgaacttcgataaaaccacccggctctgctccctctgtcatgtgttgctagaatagcagtgccctggtagtatgacagcagttcagaagtactgttctagattttgattgatgatggttcataataaaaatgttgttcagttgcaacatttatcaatttgaaatatttggtcctttatagctagctggtttttattttttatttgtttagttttttggagacagagtctcgttctgttaccccggctggagtgcagtgatgtgatcttggctcactgcaacctctgcctcctgggttcaagcaattctcatgcctcagcctcctaagtagctgggactaaaggcatgtgccaccatgcctggctaattttttgtattttagtagagattgggtttcaccatgttgcccaggctggtcttgaactcctgagctcaggcaatctgcacgccccggcctcccaaagtgctaggatttacaggtgtgagccactgtgtctggccactagctggtttttaaatggtataactggaatttattctttgtaaagtgtgttttttctttaaagaggttactttacaagattgttgatgtattcagttgctcctgcgatggctcttggagctttggaattcttttgcagttttggaattctcctttagagcctgcagtaagtatgtgcttttaagtatctataatgagggcacatatttattatttgaggtagatttgattttgataattgccaagtgtatagatacttgagatgatgacatttttggctcctaaagtattcctggaggaattttccaaacaggaaatgtgaaaatgttctgaacatgcccagtgaagacatcacggggctatgtgtttgatcttctaagggaatgtctttgaagatgattgtccactcttcacattgagataacggttttcatattgcctggtccactcaagacaattgtcatcctgtataaagggtctgtggctgtggtagaactgccatcataggagttggtgaattacccttccatcttcttccagcttctctctgatgcagctctcccattttccattctctggcttcagactagcctagacattcctgcccctgcctacctcttaggatcagtgacttggttagcttgttttgcagtttgcccctggttactgcctcagagtacagtttcatacatttctgcctagatcagcctcctgaaatatgataccccattttgagttctctactcttagctcttcttgcttgtttggataggaatatttgctctgcatatgaaaaggttagtgaaatgattttacagacatgatccctgtgaaaaaaatcatcctgtaatagagtagttttttttatttgttcgttttgtttgtttgtttgtttttgagacaggctctggctctgttacccaggctggagtgcagtggcgccatctcagctaactgcagcctctgtctcctgggcttaagcaatcttcccacttcagcctctgaagtggctgggatcacagatgtgtacccggctaattttgcttattttttttttgtggaggcggtcttcactatgttgctcagggtggtctcgaactcctgggctcgagtgatcctcccacctcggcctcccaaactgctgggattacagatgtgagccactgcacccagccggtaatagagtattttaaaataacatcatattccattattgttcaggatcttggaacattgagtgatatattgttctttgaatacaaaacacatgttcccacatccttgtttgagttgtttctcatgagtggtggctctatgtcaattctgcattccctcttgtagccagtggcctgtacctttgaactaaaggagccatctgtgcccactaatggatcagagtgaagggatgtctgggacttctgctctagtcagctggttagtctgctatggtaattaagctgttatgattgattatttactgaaccttttggactgtttcatcatgtggacttcccttcctctggaggtgtatgttttctctctatttactgaatcttttggaatgtttcatcatatgaacctcccttcctctggatgtgtgtgttttctctttggtaatacctcttactcttttccttggcatcataataacgttgttgccatagcattgtgatttttatttttatttgtaatgtaaattaaccaatgatgtgcccacacacccaaagctactgcgtatattatccatatcgacactgattatcattcatgaacttcgtctaacctgtaggccaggataggcatggcttagatgaatgcttggctgggtggcaacagatgatttggatatggtgctgaagtgtgggagggcatctctgtccatgacatagcacgaatgaagaattagcaattgagttttatctaagtttttatgttcatttttcccattttcatgattaataattgcagtcaaaagaaaaaacatgatttcatagtttctgtgaccccatagttgtatcatgtttcagattgttataaaatggtttatgcatcttcttacctgccatccccggaacgatgtaggggataggatggcacttttgccatcctcgttcatccacaaaggctccttctcaagagtgcagtggtggattttacgaactctctccggtgctgcctttagtaagctgaaccagagaaaagattggcaggagtgggctagatcagcatgaactagtccttacctgaacacattgcacagcagtggctgatgagtactgtggttggctcctcctttagctcttgaggggcactctggcacaaaggaattgagaaggggaggcctggatttttgtcctgggcccaccattaaccaggtgtatgttctaattaaggcctttggggccctaaggagcagaaacccactcaagctagctcaagtgaatggttttatggaatgaataaaggagcccaaagatgaaagtctaggagagcctcatggggactggagctgttctttctctttccctctcattaggcctcttctctctgtaagcctctttctttttaaaaaaaaaattattcggaattttgaaggcaatgttcaactatattatagccactagtgttgtaattgagaagtccaaagacattctggttcttttttaaattaaaaaaaaaaattttttttaagggataggatcttgctatattgcccaggctggattcgagctaccaggctcaagtgatcctcctgcctcagcctcctgagtagctggggctacaggtgcgtgctgccatgcctggcctccttaagtctcttttagtctcctgacggtctgcagactgagcttatctgcatacccagagttttgacttccacacggttttggcttgccatgtgccacttcaacacccatgctctgtgaccctttccctggctccagctccttggttgctttcttgtctttcagtgacccaattacaaattcccaggaggaaccctgctgcctggcttggctctggggcagtctgatctggctgaagacaggatgcaagtcactggttatactgagcagaagttttcagcacagtaggcgccccaaagcttgccacttgacccttgagagcttctcgctgtcctttccgtaagacgaggaggttgcagtgggtctccttcttgtattcagtacctccctcatggtgtgtattaacctacctgctgctgtttgtcttccctccaggaagcaatgcctgtgtgcccaggccatgcagcctgctgtgcctgcccaaggccaacaacagtagaagctgcaggtgtccagaggatgtgtccagcagtgtgcttccatcaggggacctgatgtgtgactgccctcagggctatcagctcaagaacaatacctgtgtcaaacaaggtacttccctttttcttttttgcctgtcatcctccttcctttgtttcctgctccccgccaggggagggagggatagctctctgtttcctaaccttttcgtgttattggaaaaagtccaaggtaaaaatcaaacctaccagatactcataagaatactggtttgggttctaagtcctggtaagggtcaaagaggcccttcagtcctcactcagaacaggcctatgctgtacctttctaagtagtagctgtggtttttggtttcatgtcagatggcacaggctttcttcagggtctccctttttattcttttgcttcttcctctcctcacccatccctcacatccaggtttcttacctgctcctgttttgcataagttggaccaacctgattgggaaaaataaccagtgtgactccttccgcgtttactctcacctaacggttgtccatcctctcaccgtagcctagcccagtgtgtcctgaactttcagaccaatgtttgcaaagcactttgagtctagaccttatgccatgaccaagcagcaagagcagccttacacccactccccctctgaatttgaatatagagatttaacatttctttcctccgaaatttaaaaagtttttccttcctgtgtaatttttactgtcaccacttcccccgcctccagcatcacgtttctgtgagtgaggtgaacccctgcaagggcaccttgccatgaagtgcatggattgatggccagaatttctgcttttccttatctgtgattctatttgcctttttttttatatatattttaaagagacaagaaagagacagggtcttgctgtattgcccaggctggcacattcacggctcactgcagcttcaactcaaactcctgggctcaagggatcctcctgtctcagcttcccatgaagctaggactacaggcacgagcccagctaatttcttttatagggacgaggtctcactttgttgcccagtctggtcttgaacatctgggctcaagggatcctccctcctctgcctcccaaggagctgggatcacaggcatgagccactgtgcctactctatttgctttgtaatcctaaccctgcttctcacagcggcccaagtccaaggcagtgaaacacacaatacaagccttttagtcaatcttccttaagaaatataaacagaaaaaagatgagcctttctttcttagaaacaagagactttctttcaggctatggatacaatcttaaaactgtttggaaagaaatagaatcaacactaaattccaagagaaggggaagaaagctactccatatttcccattagaatgcctttgattatccaaatatgagaccaatcatcgcatgtccttgatgcagtttgccaaactatacattttttttctgtaaggaattttaattgcttgctttaaagtagtcatggggcagaaaaatttctcagagtattgagaaaatcttcataactcatttgcttgatagatagaatatatatggatatatataactatgtatataaaaacatacctatagatatattgaatctgtatgttttaattctgtgtagacacagtccattaaggagttctgtgtgtaattagtattttataatgttgatgtactgtattcactacccaatagactcaactggtattgtggttatccttcttaaagcattgtatctgcttctaaatatttcttccagcctcctcctctcttttgattttaactaaaagaggaaagcaagaggctagtatgggacatttccttccctgtagacacgtgtgcttggcattcctcctccccctttaccatcatgttacttgttgtgggaagtccgggaccccgaacggagggaccagctgaagccatggcagaagaacgtggattgtgaagattttatggacatttattagttccccaaattaatacttttataatttcttatgcctgtctttactgcagtctctgaacataaattgtgaagatttcacggacacttatcacttccccaatcaatacccttgtgatttcctatgcctgtctttactttaatctcttaatcccgtcatcttcgtaagctgaggaggatgtatgtcgcctcaggaccctgtgatgattgcattaactgcacaaattgtagagcatgtgtgtttgaacaatatgaaatctgggcaccttgaaaaaagaacaggataacagcaatgttcagggaacaagacagataaccttaaactctgactgccggtgagccgggcggaacagagccacatttctcttctttcaaaaggaaatgggagaaatatcgctgaattctttttcccagcaaggaacatccctgagaaagagaatgcgtccctgagggtaggcttctaaaatggccgcttcgaggggcggccatcttttatggtcgaagctgtagggatgaaataaaccccagtctcctgtagtgctcctaggcttattaggatgaggaaattcctgcctaataaattttggtcagactggttgtctgctctcaaactctgtctcctgataagatgttatcagtgacaatgcgtgcccaaaacttcattagcaattttaatttcgccccgtcctgtggtcctgtgatcttgccctgcctccatttgccttgtgatattctattaccttgtgaagcacatgatctctgtgacccacaccttattcgtacactccctccccttttgaaatcactaataaaaacttggtggttttacggctcagggggcatcacggaacctgccgacatgtgatgtctccccagacacccagctttaaaatttctctctttttttacgctgtccctttatttctcagaccggccgacacttagggaaaatagaaaagaacctatgtgaaatatcgggggtgaatttcacccgatatctggctgaatttcccccgatagttactaaagggagggaaactcaaaagagaaagacctgtggtccagcagtaagaataatattggtttcatttcctcccctgccgcactctgatgggtagagaacacctgtcttcgcaaccagtatcgctgcagcaacgggaactgtatcaacagcatttggtggtgtgactttgacaacgactgtggagacatgagcgatgagagaaactgccgtgagtcttctggattggacgttaagcacttaccattactcagaagcctggttggctcttcccaggctgagggcctaaggtctagggcgagggccacccatgattggtgatgcccatctaagttgatggggcttagatgacagagaaaacatatttccatacacaggtagatattagatatataggattaatattatatacataatatttttttaaccaccccagaagtaccactcgttacaagagatttataaataaacgtcacatggctgaaactgaattgatttggcaatctgggctctaatcttggctgtggctctgtaataaagctggtgacttggggcgagtaaacaggtgatattctttgatttggaaattcaatattcagcctttttagggatgggaaatgagtatttactccagttggttgatgttggctacctaccaggctcaagagagattgttttcattggttagtaatgcatagcttggcctacagtgtggggccattggtgtacatgccatgtaagtgtcatctttaggctgtataatttttaagatctgacttctaaagtataagactgtggttagcagaagttaaaaccaaacaaccacaaataacagatagtttattaaccatgaattttcactatcttttcttcacttaatttttaatagcttcgacattatcttataaggagatgatttgcccttttgtcagtcatgcactcactcaacaagcagttgctatacaccctgtgttccaggctctgtgctgggcctgcatatatattgccgatcaaggcagaaacggagttcacagtctgaagtaggagtcagaaaaataggcagttacagtagagtgacgggcactgcgatgcggaagtgtcatatgcatgtaggatgggcacccaaagcaaacttgggcaggccctagcaaagagctctggagagtgtctggggtgaaccaagcagaggtggagggaatcaattcacaggcaagggagcagcatgtggggaagctggcatggccaggaaactggtttgagttatggagaatgggcatgggcacaggggccaaggtgaagttagatgagtgggcagcgcccaggacagcaagggctttgtggactttatcggagaagcagttgggaaccactgatgtcatgtgatgaaagttcatctttggaaggataagtagtgggcagaatgcgtttgatggagagagaccagaagcaggaaccaagtcagaggcttctcttttatatattttacctttggcaacccaggggctcatttacccatttgtactgtaagaacagattaatgggaagctctagatactcatttagccagtcatccgtggggcctgtgcccggctcccctgccacttcacccagaaagcaacttgtgaaatatccagctcattaaacacatctgggccctgcaatcctatagactcccccttttggctgatagagggttatttacaaagcctttccttaatcgttttcccttggattcagagggtgcctttcacaccgagggagtagagcttatttgctgaatggcagatttgggaaagcactagcctctctgtgtcttttctgcaaaaaataaggcctataaagcctcctttatcagagttgcaggaaggtgtgatatttgtgggggaatagccaaagctctttaaaaacattaatgcttattaacagcattgaagcagataatggaaaggagtttattacatatctgggtgggatagaagatgcttcttagaattaacaagttacaaggaaattgcccagacataattaggcacagtggaagcagggagatacaaaccagatgacctcatatccaagagtgagggacacaggtggcagagcattcctccttgtgcccttgggcttggtttctactaaatggacaagctgaatcttgtattggctccgagttttgagaggaatgaagacctgcatcttttgggaggcacctgctgcctccaatggcttcctcccacccagcccctgagctctgttgcagactgcacagttgtgcatgaaggatggagctggccctgccctcctcccagcttggcgtgaatgtcagctgggattcactttccagagaccccgagacctactttctgctccgtcgtctccctgtttcacctggctcaggtctacacatgtcagatggagctgaggcgtggagaggaggaaccagaaggatttaaaactcagagactgggagtcaagagagaggggcttatctgtgcctgcatgtgtgtctccctcatcaaggaggttgcgtgtggaggagagaggttccctgtttctaagcagggctgcaggagctggaccgcagtgactgagtactgccatgtggggagttaagtgaggcaccctgccagctgccagggagcagtggaggaggggggacaccgggatgcaggagggtgttgtcagtgggtttccctccctcttacacagattcctctagctgggtgactgtcaggcactcagggttttgacgcgaatccctgcagtcttgtcattttgcattcatcccctgcctcccaccacgagctcaattacagagaagaaatggagcctcaaataagagctgccaggatgtctaacggcagcattgctatttggcatttcgtgcacgacaacccctcccccgtgccagcattctgttctgccacattttacctcctgggtcagcctttcactctcctgagagcagcctgccttcccctcgcctttcctggagggtgtttcacggggtgccagggattgtgcttaagcacaggaaatatctacttaggagaggaagaaaaatctaattctgtatccattctaatgccagaaggacatgaggaatgatgaggaagagaagtgacatttgtttagagcccattatatttacatcctatttaataggctctggttccaaacttgttccctggtttatcttcataataatgctaccaagtaaaggcaggttaagtaagttgtaggttgcagactcaattcaaatctagtctttctggctgggcgtggtggctcatgcctgtaatcctagcactttgggaggctgaggcaggcagatcacttgaggccaggagttcaagaccatcctggccaacatggcaaaaccccatctgtactaaaaatacaaaaattaactggggctggtggtgggtgcctgtaatcccagctactcaggaggctgaggctggagaaatcgcttgaacctgggaggcggaggttgcagtgagccgagattgcgccactgcactccagcctgggcaacagagcgagactccatctcaaaaaacagaaaaacaaatctagtctctctgactgtgatctcaagcactaggacacattatcttacccagttttactgttgagaaaacagccgtagggagattaaaattaatttccccaggaagaggtagagccacgatttggtacccagtcttgactgactgcagacagagcctatgttcctactgtagaattctacctccatgctgcctttaccatctgtacaatgaagtgctaacttcttgtgtgaaattgagcttctctaatcgtagtttcatagataaaggtatttctgtcacttatttaggaagacacttttcgcgtctgaagggatcttaggaggtcacctagcctgtcactctctctcgccaacagatgacagtttctcacttttccccgtcctgttccgatctggaagctgtccacagaaagatatgcccttatctctcttggttgtaaatttcaagctctcatgtaatttatgtcttctgtaagtctaggtttaatttctgttgctacaattaatacctgctttcttctattttttaattggttttccagtaggatgtttacatttgtgggaaatcaattgtacctaaggaatatgttgtctttctatcccattttagctaccaccatctgtgacctggacacccagtttcgttgccaggagtctgggacttgtatcccactgtcctataaatgtgaccttgaggatgactgtggagacaacagtgatgaaagtcattgtggtaaggggacatcacatcctgaaaccctgctctggagaggggggtcattgtgctccctcacagggctgtactggtatgtactggttttctgatagccgtctcaggatttatgatattctagctgaatggctttctccatccacatggtggggttgagtcatttctctgtccattcttaaagagtttgtttgctgcttttcacgaggattcagttcgctggagacacttgcgaactgggaccctagattcccattaactctggatgggaccctagattcccattaactctggatcaagtgtctccagcagaactgaatcctcatgattcatggtcagaaaagatggagcctggactcagctcctgtcacttactcttagattagcctttgttttctagtctgaaaaatggggaaatggaccctgctttgccttggagagatgctataaggatgaaaggtgatggtaaggaagtaaatttctgaatgaattcagggggttattaacagctctacaggcttggcccacatgtctcagtgggtgtgagattagcctgctgaagacacaaatctgcacctctgtgaactgttcttttttttttaaccaatttaattcattcaactctgttattattagaagttagcagatggtataggcattgagtgagcatctgttttctgaatggacatttttatatttagaaaaacagtgggttacaattccaaggaatgatagagattctctggtccaatccttttaatttctactttctaaagtgactgaggtctgtagaggtcagggggcttattcaaggtgacacaattagtttgtgtcagaatggggaactggaatccatgtctcccattttctaatcctccactatttctgttgcacagtacctccttgtcagtttcatgagacccatcttagttaacagtccctggtcccagactcatagttgctgacctccgaaggagacattatgcaatcagcatggtgtgccagattgaggcatgagagggaagtgagagtggaggtcagacgctgacccagacgtggtgatgagttggcggggccctactgtgccctctctccctgtccacggggggcaggtccagccacgctgtgcttacgcacatggacacagcctgcttgattatgagcaggtggtttgactcacagcagctgaaataaggggagcaagggcagcttgtaaatcatctcaatgcaagttaaccagcagagcagagcctaggccatttccacacagaaaatacccctagcctggctcttggaaggtttttaaaaaattcccagttttccttcttcaagtgcctgaaaacatgtccttggaatgtgcaactatttccccttcatccctgccatttccttcccagcactcttagaaggttgaaatgtgtagctagttttgccctagtaagaaggaaacttcacgtggttccctctttctggtatcattgagctcacgtactgggtacatgtttgactgtgaagcagtttcagccccctgatcctctgttcatggctcattcttactagtttgtcctgaattcatcccagggtcccggttagccccttcctctgatgcaggtcctcttcgtaagtttccacactcttcctcaaaaatatctgatttactagctttgccatcaacaagcctcttggcgagaatgactgagacggctgccttgggccccacgcttggctgctcctgttttctgacgctctgtaaactccatgtgaaagttctatgccacagtctatttgggctgtgataacaaaatacttagtgtaggtaatttataaacaatagtattttgtttctcacagtactggagactgggaggtccaagactgaggtgccagcagacttattgtctagtgagggcctgttcctcatagatggtaccttcactgcagcgtcagatggcacctctgcttctggaaggactgcagggaaatgcttctatctgtacgcaagcgtggcagaaggagtgaacagctccctcccacctctttcttaaggacactaatcctattcatgagggctctgcccccatgacttaattacctcacaggggtcccatctcttaataatatcacattggtgattaagtttcaacatacaaatttgaagtttcaacatatgaagtataaacatttgaattttcctagcctccagaaccgagagaaataaattgctattgtttataagctcagcctatagcattctgtcttcatgatctccccaggagctttgaaggctattgccagggcagcctccttccccttcttggtcaagctctgctggttggttcttaccaggcccccacccttctagagacagcgcatccacccgtgtccctggagctctgcccacagaaagtcccgagttatgtttcctccgttttgggagctcagcactgattttactctctctgactgagcatctcacggtgatcagctcatgcagacctctcggcactccttttctcaaaccacaggctgtgtctgtaggagtcctctgtttcttgaaagttctacttcctggcctcctctatcactgcttcctaaccttcttcccatcatagcaagcatagaaaataatatatgtggagagcactgggatgaatggacaaggatgctgttgtcaagaggcaagcagctctaagggtctgagggtctcagaatctcagcccacctgtaacccatttgcagcacactgactggaagctgttaaatgaccttttgtccctggtaaaagtctcttcgttcatggtctctgtggatcattggtgatcacgggtccatctccatcctttatgagagctttgacaccagagacaaaattctgaacaagcttttgtcctcacctctctgtttatggtctcacctgcagaaatgcaccagtgccggagtgacgagtacaactgcagttccggcatgtgcatccgctcctcctgggtatgtgacggggacaacgactgcagggactggtctgatgaagccaactgtaccggtcagtacttcctggactcagttgacagcactcatccgttcatgcagtggttaacattatagctttaaacgatcggaaaatctaggctctgagaattagcttggaccttagaaatcagcgagtttcatgcttctcaaagagctggtctttgatgagataaggaacctgtgccagaatgtaaatcaacaccctgctttcaactgattaaacagtgttctgagtgatatcgttgatttatgttctggctcaagcttcttattcattcaggaccagtgttaaacagttttcagaccagcccctcggctggggtccatactttgagtaagcactgaactagctcatgttttttaaaatggagcatcagggggttccccagacaaggaaaatgtaaactgtgtttgtacccgttttgggtaagattttattaaaagtaaagatggaaacaacatgaatgtgctaggtgctataaggtaggggtagtgttctcattcttttgttgggttcgcttatgttcattacattatttttatgaatgagtggatgaatggtggccagatatattatgatggggcagggcagactgggggtgataggcagtgggtagtgcaaggagttgagaagcttgtggagaaatgaaaacaaattccattttataatcatcactttgtaccccattgtaatttgtccaaaaaacaaaaattaaggaatttttgttccagattttattactcattgagtaaatttgctctacagcctccttgagaagctgttattcagttctgtcttgaacccctctagtgattttggactagggagataaagatgtttcctttaaacatttcatggtaaggacagatctgtttttacactcggataattcagacttcattgtgtaattcattgttgagtcatcttctcaattatctgaagccagctattaatcttgtgaattattggacttttaaatctcatgtcttaacctcctctgcccccagagtatcccagcacttcctacactgcccggcatctggcggctcaaagcacgcctactaattggtaaaaggaaatacaaagaaggtacatctgttatatctcagacctaaggataaataactgtgcattatgctctggcttagacttgcttccccacggagagagatgacctcttcttttactcttttgtattctctgcagtgtccagcacataatagagtatgtgctcagagaacctttgtggattgagtaattttatgcaactgcttccctccattccttttagtttggaggtgacctcatatggccttaagggagtgaatagatctcttcaaatgccatatacatcacatgggatattctgtggtgttaccaaatcctgttcgcttgtaaagtccacccatgttctttctggcgcagcctctgtgtctgcacctctgcttctgaaaagactgcaggaaaatgcttctctctgtatattaaagcatggtctgcagaaggaggaagaaccgaggcccataaaggagctgccgttggcacaggaaacacgtgaatgctgtttggaagctttgggtttggatggatacttagttaatagattagaagggtgcacttggacattgcagtttgtaaattgcagtatgattgaacatcttgttaacacaactgccttactcaaatttgcatttcagcagcatgtgccggtcttacagaatgaattgattacttcatttctataggcaagcttgtataaactcctggttttttctctgattttcttccggcaaggcaaactggagaaaacttaagagtccttgctgctcagctgcagccttgttccaagggctgttcttccaaacctttcaaggatgatccaccttctctgtcatctcaaaatagttggaggtcagatgtgagctcatggtgatgtgtggcatgacacctcattttcagacctactaaattaagctgcgtacagtgccaaaagaaataggtcaaggtagctgacctcctgttggcatcagcttggatgcgcactctgctgtgcgtcctctttgcttttcttttcgccacttttactttccacgaggctgtttctttattcacctcaacccaccgctattgtttttaaacgtgtacatctgatttctgtgtgtttttttaggacaattacctgtagacattttatttgtattcttaacatctttcctctctcctagatatatggggactttagaatttgatccaaatctctgcctacagttccagtactaaaatacctagtattttaaacactaaatatttagtattttagttttatattaaaaaatcctaaacttcactgttactctttttaaataaccacacttctgcataggcacacaggtattaccaactacctctgtgtcttgttgctaatgcctcccaccaatgtacatccttcaggggttttgcagcaggagtctatgagtggcaaactctttcaaggttttgttattatagacatatatttaatcctcaatcttgaattcaaatgggtctgggtttctaggcttttagtaattttccgtattttcatagaattcttccatttcttcctggcctcttttgtgttgatttgaattctgctcttagttgtctgttcaaataataacagacactcttttctttctaattacctttaggttatattgctcttagttttacctacctaggtgtggaattatttttacttatcctgcttgagactttgtttgttttaagatctgagaatttttcgaaagacaactctgggaagttacagctactaactcttcaactatacctgttggctactttctctggtcttgtcttcagcagttactctaagccattcgttggactgcctcattctgttgttctcttccctcctgtttttatatttgctgtctctttatgactctgtgctagaatctgagcgacttctctagatttatcttccagttcaacaattctcttttcagctaactctaatctgctgtttcacatatacatggagctgttttttttatttccatgagtatacgttttgtatctagaatttctgtttggttctttttcaaatctgccttttatttttcagtgttctttttttaatactttatgttttttcttctctgtcattaatcattcaaattgtgatgatagtcatttttttcctcatgcacttacttttttttttttttttttgagacagggttttgtcttgtctcccaggctggagggtagtggcgcgatgacagctcactgtagccttgacctcctgggctcaatccatcttcccgccttagcctcttgagtagctggggctacagacatgtgccatcatgcctggctaatttttgtatgttttgtagagatggggttttgccatattgcccaggctggtctcgaactcctgggtgcaagtgatcctcttaccttgtcctctcaaagtgctgggattacaggtatgagctactgcacctggtccccttctcatacacttttttttttttttttgagacggggtctctgtcgcccaggctagagtacagtggtgcgatcttggcttactgcatcctctgtctcccaggttcaagcaattctcctgcctcagcctcacgagtagctgggactacagatgtgtgccagcaggcctggctagttttgtgtttttagtagagatgagtttttaccatgttggccaagcttgtctctaactcctgatctcaaagtgatccaccctcctcggcctcccaaagtgctgggattacaggtatgagctaccacgcctcatgcgtttctttatagtctagcgctttgtaagaaataaggcagtactttccctgttatactacttatttcatccattctactctgctcatgtttggttaatgcttttaatcaggcattccagcaggtcttgatgaatcaggaaagttctgcctgagtcaaagattaagttgtaggatattgacctatattagaaactgatgttagatttccacgattgtttaccacacgaacttcaccattcttatagttacaatgaatcctaccatgcagaggattctttttcttccctaaattcttcagtctggattaaagtccatctcttccatccttgtaattaaaaaaaaaatatgtattaagcatgcagtatttaccgggcactcaaaatcagagctcataagttactaagaagatagaaaaatctagaaaaagataatgcgttatgtattccagccatacctggccacttgaatgcaaactgattactctttctgagctcagcttctgtgatagaatctggagatctcagccatgcctcccagaattgtcatttggaaacttcactagcactctgaaatggttttcaattaaaaatgaaatgcagaggctgaataataactagattagtatggcaattggtttaggcaactttatattttatgaatgtgagcaaggtgtcggtgagggatgttttgaaaggctgtcagacttgtgacacgaataaatcaaaagtattccaggcgatggctgttactggggcagaaactcatgtaacatgcatgatacatttattcctcttatcagaaataagtatagtttttaaagatgtttaatggattctgagtgccaaaggttgtaaatattgaaacttcttatagttgtatatacatgctgccaaatacagccttggtccttggagagatgggaagacatagataatgagctaccacttgttttaaagtggtttgaaaaatcaggttctttggatttctgaccattgcaaaaaatagcctcaaatgcagtaaaattcctgaggacatcataaaccaattttcccagtccttgggcagcttactgccaactgtctcagttgaatagaaaactatagtttgctctcagcaacccacttctgtgtgttttgtttctttccgttgtggtgtcatcctctccacacagttaaactaacagagagtccgtctatctaggttctattatcttatgctggttgtaaacaaggccagtcctggcttgcattcagcaatgaacagacacaaacagctttctgtttcagaggaggaagaggaaatcagatggagaggaccgttaggagtgttggttgggttggaggcacatattacgcatttgaactagtgtttgactgagtttttgaggtggttctaaatgacttccaggtggcctcagcccatgtgtgcagaggaggctgttcatgtttaacagtgactctctttcactagcttcttttttgcttctagtgattatagtggacaccacatattattggctggtagatgttcctctcaactctacagaaagacaatttcaagttcttaggcctgctttctttgtgattttggatgactcttttatattcctctggcctgaggtttttcacacttgaaattggattttttttttaaagaattgtaatgtatggccttccagaacttagcagggcccttaggtttcactgtaaggatggtgaatttgagatcaccacacagtggctgcaccaggtccaggactccgtctcctgagcacaggctgccgctccttatttctcagcatctggatgagtaagaggacttaggtgagaaggcaaactaccagggtatagcagaagaagtgcaggcttgggccttggactgccttggtgttactacttaatgatctctaattttcctattctctctaagcctgttctcatttgtgaaaggggaataatccttaccttgtaggttgtcgtgaagagcaagtgattttttaacgtgtgcatctgtccctgggcaatggcctgggtcatgtttataaatccataggctcaagtccaccgagggagctgcccaaggtcagcccaagtgcccaattctcagccaaggagaaacccagatgctcccacagttcagaccttattcctacctcatgcaaacctcttttcagcccacccccttggacagttggtgggggatggagatgaggggtgtgcgactgtgtctctcttctctgttacagccatctatcacacctgtgaggcctccaacttccagtgccgaaacgggcactgcatcccccagcggtgggcgtgtgacggggatacggactgccaggatggttccgatgaggatccagtcaactgtggtaaatgcaaattccccagctccctccctgagcctccccagtgtctgctgttcaggaagagaggccacagagagccaggggatgaaatgctgttctcctatgcctgtatttacactctgaaaccaaataagcccatctactttctatgttatattgccatatgatgtatcagattatattatatagtcttaagagttgcaggcaagcagtttgccccacacacaaactatataaaatgctgccacgtaaacaaaatatataaaatgttttttgaaaccaaatatgtttaaggttctctatccttttgccaaacattccaagttttcaggggatgttagttgtctacatgttgttatacattctactccttaagtaaagatgtttatgcaactctgtttttgtgtagtaagcattttcatggaggatgcatattcactttatgctaccataacctagtttacatggttgcttcctggttgggtgtttgaggtttttagatttatactgttatgctagtaccactattcgtgtctttggaaatggcctgatttttctttgagatattttctgagaggcgttcttcagtatggagttgtaaggtgaaaggttctgaccagtttttgagtctctctgttaccaaattgggtttccaagggattacatcaaatgtgtctctaccagtaaaacgttgcatgtttccccaagtctccttgatattagatttgtatctttttagttgcttccactaatgtaatatgtgtgtttgcctcatgtagttttgatttatacctcttttaaaatactttttctacctagtgacattaaccatttctccaaatagtggtgcttgtttactgtttctgtttgatatcctttggctaatttcccagaaatgattactttttacaggattaaaacacattttcatacttatacctaatcctcaaggaactattctacacagagctcagtttgcaaaggctatctatgactgcctcattagaagtgattttcttttttttttttgagatagggtctcactctgtcacccaggctggagtatagtagtatgattgtggctcactgcagctttgacctcctgggcgcaaggcatcttcctacttcagcctcctgagtagctgggaccacaggggttggccaccacgcccagctaatttttgtatttttttgtagagatgaggttttcgccatgtggctcaggctggtctcaaactcctgggttcaagtgatctgcccaccttggcctcccaaagtgctgcgattataggcacgagccactgcgcctggccagaactgattttcaagtccaatgcctggcaataactttttgctcaggagaaagggtgacctagtactaaagattctgatcaagataccttagttgtagtttaatttcccctggaactgttgtgaaacctcaggctcttagcatttctaggcaaactttctccaaaacaactttgctttagaattcctccagaattaaggtggtgagtgatttaaatagctttataaaactaggatttcatactcaagattcatattgtgctttttctattcattgaagcttttctttttcttctaaaaaatatacttagatcaggtatggtggctcacgcctgtaatcccagcactttaggaggctgaggcgggaggatggcttgagcccaggaatttgagatcagcctgggcaacatagcaagaccccatctctacaaaaatacaaaaattagccaggcacagtggcgcacgcctgtggtcccagctactcaggaggctgaggtggcaggattgcttgagcacgggaggtggaggctgcagtgaactgtgatcacgccgctgcactccaggttgggtgacagagcaagactctgccttaaaaaaaaaaatgtatatacacacacacacacacacacacacacacacacacacacttatcaaaatggaaatgttcaaaatagaaaagatacaaaaagatataatctctcaggtgtaggttgatctcctcacctgcccagttcccactttttcctaataggaaaccaagttgtatattttttcagaatatttttgtgcatatataaacaaatttaagtatactctgtattattgtcctatttcatacccataatgtttaactttgcgtattgttttgcaccttgtttttttcacagaactgtttatctagggcataatttttatagagcacttcttgcatctctttatagctgtctgtgttccagtgtacagtaatttattaaacagtctgttattgatggactgttttcaatctattacacagttttgcaatgcaacacttgtacttgtgggcggttttcaacctgttacaaacagtgttgtaatgcaacccttgtacttatattaagta[450 bp omitted]ctgagttgatccctgagtacttggctaggactcctggaggctgatcgtggcagagagacagggtttggttaaaggagagcaggaaggaagaaagcagggttgggggcgatggtgggattagatcgaacttcagtgaaagttattgtttagttgaaatatgttctattaattgaccagttgttttgaatcggccacttatttctacttgattggttttgttagtgttgctgagtatcactgggggtagagtgggggggggggcggggggggggcatttttaggccagatgaccctttttatcttcagttttctttagccccagaaagattgccttgggtcactggtgctcatccttgattatatattggaatcacctggggagctttaaaaccacctggtgcctggaccttacccccagagattctgatttaattagcgtaggtgtggctgggacttgggacatttatggtgctcctggtgattctactgtgcagtccgggttgagagctaatgttatcagtgcagggagtggcaaactagcctgtgggcaaaatccagtccctaacctgctctattaaatgaagtttgatttgcatacagtaactactatttgtttacatattgtatatggctgctctcatgctgtagtggtggacttgagcagttgtgacagagtctgtatgacctgaaaaccctgcaatagttgctttctagttgtgttagttggggttagttggggttctccagaggaataggaccaataggatatgcatatgtatatatatagatttactttaaggaaccatcatgcaattttggaggctggcaagtcccaaatttgctaggtgagccagcaggctggagacccagggacacactgaggctatatagttcaagtccaaaggctgtcaggctgcaaaccttggagagagccagttgcagttcaagtacgaaggtcttgctgtgtcctcacatggccctttctctgtgtgggcattcctggtgtctctctcttctcaaaggacacgaattcttttgagtttaggccccattcttatggtttcatttaacctccattacctttttaaaggccctatctccaaatacagtcaaattggggatcagggcttcaacatacaaattttgggggaacacagtgcattccataatattagttccttacagaaaaatttgcctacccccgtattagagagtcagtatctattaatcatgcttgagattgggggtttgatgccagacagctctggatttcacttttggcttcatcttcatcagctgtgtactcttggcaaaatacttaatgctactgcccttgttttctcattttgaattagcgacaataaaatctctcctaatgttgtcttgagggtttaatgatgcactttatgtcaaatgctttagctctaggcttggcagaaaacaagtgctcaataaattgtggcttttactgttgcttcctgaagccacatctgtactcgtgtgcacttgcccagggctagagggcccagccagccgcagtgctcatggcctcttcccttctctggatcccttacagagcccctctgtacgcacttcatggactttgtgtgtaagaaccgccagcagtgcctgttccactccatggtctgtgacggaatcatccagtgccgcgacgggtccgatgaggatgcggcgtttgcaggatgctgtgagttggggcaggcaggggaggtgactcacggtcactaaagaacttgcatgggggtttggccaccctggggttgtgtctctatttaataactgacaggtcttggttgagtgtcgagggtttgaccaccctggagttgcacctctatttagcttacatgtctaggttgagcatccaagcttgccttttctgagaaagactttcttttgttgcttaaggaatcctgcttttcagttgtgggtgtatgtataaggggcaggatggcgagtgaccagggtcttggctcaagggtcgctgaaagtgagaggcctttcttgccagtactgtatcagatggcactcccagcgtgccgtagccccttaccctgcttcgatgatcctgtcacaacttgccccaatttggacctgtctgttcattttgctgcctgagctttacaggagcaggggcttgttttgtgcattgctatggccctctcctaaaatagtgcccttcttggagcagctcttatatttgtttcctgggactgctgtagcagagtaccacagaccagatggctcaaacaacagaaatttatttcttgcaagcctggaagctagcagtccaagatcaaggtgtcggcagggttgggttcctccgaggcctctctccctggcctcatagacggctgcctggctgccttctccctggctcttcacacggtctttcctctgtacacatctgtgtctaaatttcctcttctgtaaggacaccaggcctattagattcgggccacccagatcacctcattctaacgtttcctctttcaagcccttatctctaaatacagtcctgtttctgagagactagaggttgggacttaaacacatgatttttgggaggataaactcagctcataacacgactcggtaaagattcatggaatggattaattaacaaagtgtgtgctctgtttagattaggtttggcttttgctttcaaggcatggtttagccagacagtcctttgccagaactcactgctgttcccccttgcttctgggcaccactgctgcttcgacccctcagcatggaagttcctggacttcatggatgtttgttccctctgtagcccaagatcctgagttccacaaggtatgtgatgagttcggtttccagtgtcagaatggagtgtgcatcagtttgatttggaagtgcgacgggatggatgattgcggcgattattctgatgaagccaactgcggtaagatgtccagtctgcctcctcacatcctaatcctctagttaacagtgatgcctgcagttacagggacactcaccggcaaccccactgcagacttggccttcccgtaactcagcagcagttgctgccagttcctgaatactcatacgagttgagtcttgaagggggcagctggcacccagcaggtgctagggaaaagtttatttgatctcctttcctttctgtggttgggaagaccacattatgtataaggaaggtggtagataaggaattatggtaaatattatggagtgacctccccctaaaagtgacaggccacaatgtaatagttattgtcatgattggattaccatcaatagttgttttattcctttggtaaaatgtcagaattaaaattcaggtgattgttctcaggatattgtagtatagatcagaggaacatgggttaggggctgggaagatggggttttgtttagtttgtaggtgtattttttgttccccattgggtccatgaagctgccttatctctttatgggtgggaagtgtgggttgccctggaacttgggtctggaggaggatgcctagagttggagccctgtgttcacactgatgcagggaaagcaactgatgatgtggttgatctctgcagaaaaccccacagaagccccaaactgctcccgctacttccagtttcggtgtgagaatggccactgcatccccaacagatggaaatgtgacagggagaacgactgtggggactggtctgatgagaaggattgtggaggtaagaggcccctggggcctgggttagccccataaccaagacacaccagaatagttccaccagctatgcaggatgtgcctggctgattccgtgttttggggggcatatttttgtgagaggagtgactcaaattttttctgttcctctttctcattttgaaataagtgtggttggtttctcctattttcaggctatttattccgtatttgcagggcagagtgagaagtctagagccttcctactcaaagtatggtttgcaaccagtagcatctgcatctccttggaacttgttagaaatgtagaatctctgacctcaccccagacctacagagtcagaatctgcatgctaataagcccccaggtcctgtgtgctccacaatgcatttgaggagcactcatgtggaatgcagacttgcccctttcctttctggcattctcatctctgaaccaggtcgtggagtagttgcggttgaattaactagaacacaatgctttgcctcagtaggaattctcttagccaccctgtgcctcctcagccacctgtttctttcaccagcccctgcaaaagcaaacttatctgaatattaaccgaaatcaaatatagtaagggaaatctactccccaaaagggaaaagaatattgcctcttctgacaacccattatacatgatttctagattagccgctgctcagagctgtgccagtcactggcctccctcagcaggtacagctaaaactgggacatccgcactaggtttgggacatatttggtctaagatcaagctgcttctaatgttttgggtttccgtgcttggtgtttttctcagattcacatattcttcccttctcgactcctgggccctccacgtgtctgcccaattactaccgctgcagcagtgggacctgcgtgatggacacctgggtgtgcgacgggtaccgagattgtgcagatggctctgacgaggaagcctgccccttgcttggtgagttctggcccaggtcctctcctgtggtacctgctattgtggagaggaccttctgggggtgtgctctgggcacaatccaaccgggccccatgccctgctgtctgggactctgctgtgtggccaggttgcctgttactaatggtgtacctccagggaaggctgatttctagcattttttcctggatcatagatgcataggaaattggaatgggagcatctcatcctctataactggcctctgaccttcctgcaagatgccagccaccctgatttccacccaggctatggttatgccacctttgctgccttcttagtgggaaagtacaaattggaattaatgtggaactttttgtgtgtgtattaaactctggggagagagcccaattcagcttgctagttggccggcctgtccaactaaaagaagggtaagcactgccatctagtggctaaactcaaagaggcagctgaaggtctgtagtcaccatattgttggaggtggggtagaacttgaaatcccatttcgtgtgtgctcctaacagcaggcggaacagaggtgaggatcctgtgttctttcctaagcaggagtctacttcaaactcagttataataggagaacaaataattttttgcatgctttgcatgatcttttcccttcttctgtgagcatgttctttccattgcttccttgtttaaaaacatcaaaatcccaaactttagtgaacctaaagcatgtagggatctcctgggttccacccagaaattctgattctatgttttttataaaacattataaaaatgatgtttttactagggtggtctttttgccatattgagtttcctcttgttctcctgtctagaagatcaatttttgacaatttctattttccaggccctctgtgagctgattcctccttgcctccctggattccttacatcagccaagctagattcctgatcttcttcagatagacttgcttctttcctgcctgtgcacctgcagcaaggttttgccctcagcaggaactcctgtaccctcaaccttgtcttcctactttccttatcactgaaacccaccatccatcagtgcaaacagaagcatggattttatagcaaaagagaccttgatatattcatatcatcagaacttctcaaaatgtgatgcaaagaccaccctaatggaatcgcctggggtgtttataaaaaaatgtagaatcagaatttctgggtggagcccaggagatccccatatgattcttaggttcacaaaagtttgggatttctgctttgaacaagtagggtattattctcctttcaagctccacctctgtggcgctttcactgattcctttaaatgatttccatctcttttccagtctcattaaacttacccattgaccttttgattcttaactatgatctgccatatattgcttcctaattatttcatgcgtgttgatctttgcttccatagccattgtgtggacttcctgtttgggaatcatgctgtctactactttgagtcctgctctgtgtctcctacaataataggcaaatagtcagtatcccctaaaatgcttctcaaattaaaatgaattgtaaaagagaaaacaaaactttgtgtctgtcctttctcctcaaggcctacatatttattgaataacttgattatcctcttcaagttgtttttgcttattgaaactctgaccaggacattaatagactctagcaaattctgactaatccagtgatcagatctctgtttatatatcctgttcagcttttgtactttcttttttgtgcgcagtgctgggacaaatttaaactcattgttatctgtagctcgtggatcttctttgtttagtgtagaagtcttctaactggcttattaacctcatatttctccccctttcagtttttcttctgataaggcccatactgatgaatgctcatgtcctccccagtattggagccctctgatgcctcccttattgtccagggcatgatttgccttggcctggcattctccccctttttattttttatcacctgtctccatgtaccttgtgtttctgcagagtggttctgagatatagggaaagcccctttgaaaatccaatgaaaactatagaatatgcacaatatcctgaagttaataattgcttttttcatttgtttgcttaggttgttttgtaccatttgccaatgctttctgcctttcagtcgccactcaggataactttccacaggtcaacatgtccagggatttatcaagtccagtttttctcttggagatactccttctaacaacgtggattctcctttcgggacagattgttctctagtcctgctgtgtgcctgttacccagggactttcactgcctccttggaattctctttgcctttctcccagtttagattccttgtttcctggatcttgtgtgttgctttttcttggtttactcccttgtttgggtggagtgcatccttcagtagccttgtcaggtgaatatgatgacgcagtggccaaggacactgtgatgacagctctcaggtgtttgtctcttgaattttgctgctctggtttgtattggttgccctgtatacctggggcacaactgccttttaggacgttgcaccatcatcatcttcaggatttcctttacctccatctcctgttggaactcctgttttctgtgtcccagtttttctctttttagtttaatcccatgtttcagtagagcacgttttctggaaaatgcctgagaaaatgtatgtgggaggcctgtgtgaggtcttgcttgtcttaaagtgttttaattctgtcttcagacttaattgatagttgggctgggtttggcgtgctagattgtaagtaattttccttcagagttttgaaggttttgttccactgccttcaagcagcttttcggaaatccaaaagccattttgattctgatttttttttttttgtatgtaacctgtttttaatcctctagaagcttgtagaatcttccctttggcaccagtgttttaaaatttcacaatgatgtgctttgctctgagaccctttccatccaacatagcggacacttgcatgctttttgatatggaagtttatatattttagttcaaggaatttttcttgaagtttttattaatgatatttccctctctgttttctcttatttcctggaactcttgtcattcatatattgtctcctgatctggtcttcttccttatttttttgtttaatcttttatagttttgaaaattcccttcccccacccccccaattttctaggagatttactcaactttatatttcaactctttgctgagtttttcatctttgttgtcatggttttaactttaagagcttctccatttttaccactgtccctttttatggtatcctgttttctttttttcttggataaataatatattctttctttctgaacgtattaaggatatttgtttttgaagttttcttcttgcaaagcctctatttcctccaaatggcctttttgggggttagggctctgtttggctttctgcctttcatgtcaaagccttttctcagatagttcttggttgctgcttgtatttaaggctggggactaaagtgctggtaagtaattctgagcacatgggtgggcttgtcaacttcgaggttcatggctgggaaccatgggggaactctgaatcttggttacttcagggttagtctctgaagctggtcattttccccagagaagattattagatctcctgcctagacaataattaccttattgctaggatcctcggagaagaggactgggacttccatatgtaggtttaatcccccttttatcagtaggatatacttgctgtcaactacgcctatctaaacaactctctgtttttactttctccaaataacaaccctccattcttctattggggtgacgtatgggttggttgcctcgtgggactgataggaggggatataaggaatgtagctgcgtcttaaacatcattcagtcagttcccttattttaactccttcttcacttccagttagatgccagtttctgaacttttggaggactgtgtgttgttgatctgattggttctgagctttctcctgtgacggcttagggtaggacgcagccttcgctggcctctttagtcacataccgctatctgtcttctttccagctcccaaatctcattatccatgtcctcgtggatttaggtctttgaaaacaatctcttgactgtggctttagtgggatcctgtggggaagcaacattagatgtctgtatctactctgctctctatccggaactcgcatttgtcttcaggttcccattgtaatttctaaagcaccgtaatctcctagcatattgattggttgctgttattggccagctccctcaatattaaaaagtaaattttaaaaatcttttattttagcaaacgtcactgctgcctccactcccacccaacttgggcgatgtgaccgatttgagttcgaatgccaccaaccgaagacgtgtattcccaactggaagcgctgtgacggccaccaagattgccaggatggccgggacgaggccaattgccgtgagtagtcagagagcccttcaccccctgggcacgtttctgcagagagcacagttctggtgcttctgcttcatttctggatcagcacacgcctgtgtgtgagtctgtgtacttgcgtaaccatgctcttactgcattctccacaagcgctttgccacgtgcacccataccattgcgttagtcaccttctttttaataagttgactgcgttttaaataccaggagcgtgtccaataaaaatactttctgaatgactaagataaatattttaaataggtttcataagcatgtttaactctttaaaaacgcccttggggaaagccacaactcttctgtatgtacattcattcttctggaagtatttagtgagcacttactgggcgtagaagctgtgttattagagggtttgcctctagcaccccattaagaaaattcattctcagtccttagggtaattatggttggtgagatagtgtgccgagccacatggggaataatcacagggccatctgagcccagtgtgaggtgatgcatgcattctctacgggtttggagttggtgggtcctggtgtttggtcctctgatgaacccagggaggatctttgcagtgagtgatggagggagacactggcttctgcaagcgtttatcctcatgtgaccagtcagcgcttttcagtccctggctgcacgctaatgccgccgttggctggtctgtcctactgtagcagacttgggagggcatggctggacggtgcttatgcagccccccaccggcctgcctctctgacggttgggtgctgctctggctcggggatccctgctttgcgggcctcccctccatccagtctcctgctggctgcagacagcagacgtcctagccagtcacactcccttccttgccaggataagggcttcgtccgtgcttgcctgattcctgtcctggtgaatgtagaagacgcccctctcactctctgctgagagcctccctgccgccaagccctaaccctaagcagcaaacgcctcagttcctccactttgatccctgttctggtcccattttttttttaatcttaaaataatgacttcctcaaccaatgaaaaactgagcctcacttggaatcctaccaagtcttaccatttagagatggaatagaatctgaggtggaggttagtcatctcttaattcctctaattcagtatttacaaaatttatgggacttagcaggatcatgtggaagtgcttataagagatgtgaatttggtgatctcacctcagaccactgaatcaagagcaatggtggaggagatgctcgggaacccaagccttttcagaggtgccctgtctgattcttagcatcagacaagattggcaaatactgctctgtcctaaatagttcacccagtaaggctcagggggaaagggaagagggagtcggccgtcccttctctgtctgtagcgttgttctccacagggtgcccgactgggctctccctggagaggcttggttaagaggaaggagtgtggatccagtaacatcttcagtttggttggacaaatttttgttgatcatgcacagcgtggcaggcattgatcaggtttctggcaatacaaattctttgtgttttttttctggcaggcattgatcaggtttctggcaatacaaattctttgtgtgtttgtttgttttttttttttttcttttgagatgtcatctcgctctgttgcccaggctggagtgcaggggcgggtgggatctcagctcactgcagcttccgcctttcgagctcaagtgattctcttgcctcagcctcccgagtagctgggacgacaggcatgcggcaccatgcctggctaattttatgttttcagtacagacaggttttgccatgttggccaggctggtctcgaactcctgacctcaagtgatctgcccaccttggcctcccaaagtgctgggattacaggcctgagccaccacgcccggtgactggcaatacagattctagtgggagggacatcaagtcagcagctatcctacagtgtggtgtaggcagtagcagaagttatccaaggaactggcatagtttgcaggtgggctagcttcctggagaggtggggacaggccaggagaggcagccccattgatggtgcctggacaacggtgggacaaggtggcagatgatgggcattctagacacaagggacagcatgtatattccaaggctcagaggcataagaaaacagacctgtagagtggctgtgggtgggacaaaggtgagtgcagagaggtaggcatgaggtagatagggcgacccctgtgcttggagtttatttttctggtcctaaggagcccttgaagatttcagagatggggtgtttatatcttagatcacttggacttcatcatggggggaatgggttatagaagaaggctgaggtgagattggaagccaggtgcccattaggaggctaatttgatgggactgtgaagatgaaaaaggaagagtgacctctttgtatattggaggtactattaacagcatccagtgagtttttttggctgtggtaataaggaaaaaggaagaatgagggttttccccaggatgacagtgaaagctgatgctaccagctatgtgggggttactgaggatgaggagtcgcagctttccctgggtggggctagcacgatggtgggttcattgattgacatcagcatctgaggtagtgcaagtcatcctggaagaaactgaaaaggggaggtcagaaaccggggcattcttgtcttccttttcattttactgcattaattgtccatgcaagtgatcttcgcttgcctgttgcaatgagtctttgccagttttcacacttttgttgttccttgtgatgatctctacggtgatggacttctggagacgaatttcattctaggccttgatgtgctctgacttgagagaaaaatcatcttggccaagtccttaacttgaaatatgaaactaatttatttccaccatgcataggtttttctcctaacacttggcttttcggaggggtcccaggacccccatcgttgatgcgtcctttcctctccaggaatgtcacttttgcttttgtttcggctgcctgaagggtcttttctttgactaaaagtcaaggaattggataagttgctacctagaggtctttttttcaagaaacaccctttgagtctttccaattcttcaatttccaaggtagggtgatttctttttgttttgtttatttatttgtttgtttattttagtttaggaaaatcataaggaatctttcattactaaactattcctgttggaactcagatccattttggggttggatttctctctgtccagaacatgccacttgttatctggaacccaagaaccaaaaagattaagataatttgatatctcttgatacttgtgtataaatccatataaataaataaatgaatctatataaataaaccaaataggccaggcgcggtggctcacacctgtaatcccagcactttgggaggccaaggcgggtggatcacctgaggtcgggagtttgagaccagcctgaccaatatggagaaaccccatctctactaaaaatgtaaaattagctgggcatggcggcgcatgcctgtaatcctagctatttgggaggctgaggcaggagaattgcttgaacccgggaggcggaggttgcagtgagctgagatcgggccattgcactccagcctgggcaacaagagcgaaactgtcaaataaataaaaaaataaaccaaataaattcagatggtgggggatattttaatctccttggttaacatttccatattacatctctttctcatttctttgtcatgtctttcagttgtaaggttgagctttgtcatttactttcaaagttaatgcaagtttgcacaaataagtgtttggatttgctgatggagtttgtcttcaatataattaattctcctgctgtgtacttttttttttttgaagttcttcggtgtttagcaggatgcggcagcctttgataaaccttaaaagattcttatttctctttctgtcgccttatgcctgtttgctttcctgcattttggctgttttgtttttcactttgctttatcataagtggtctttttcaggctgcttctgctttactctttctatttgctgtggtaatattttctgatgctttttaaagtggccctatcttctttacaaagtcattaatgaccagatgaaaacttggaaggcatgcctgtcatacttgcaagtaatacagagttacccagatagcttattttctggcaaaacactcaggatttacaaagggaagctaaactttggtggtgggttttaatgtgctattcattattctcaagcaaatcatgtattcgtttcacttaattctcaaaataactgcgattttggtcttatctcctttgtggagataggagaattaaggtcccaagaggatcacctagccagtaccagattgggttatttatttaggttgaaagccatgttgaaagttctcatcagggaagaatacaccaaaactaacacagatgaactgagtagggattagtgtacagttctacacttacattaaaggaatgaacaaagtagactcctagagtgttaaaccaacagggacaggttgatcccacactcaccaaaatgacagtaggaacatctgaggcgaataagcaaccacataataagatgaacattggagataattaagaaagagaaaagaaatgggacctccctcctgggtgatattaattcattaattggcattctttaaatcagtgttttcagcctgtttccaatctggcttattcacagggatgttgcctggtaaagggtcttaaaatcaagatgtgttatatccacggtttttttccaacattaatttgataaccttatctaaaaatgaaatgagattagtgtggtgcgattctttttagagaacctgtcccctgaaggcgactaagttctattctaagtgcctgttaatcatcggttaattatcagtttaagaattttcagagttaatgacaactttattcccagattctattgtttttttgttttaatttaaggctctttttttttattatactttaagttttagggtacatgtgcacattgtgcacgttagttacatatgtatacatgtgccatgctagtgtgctgcacccactaactcgtcatctaacattaggtatatctcccagtgctatccctcccccctccccccaccccacaacagtccccagagtgtgatattccccttcctgtgtccatgtgatctcattgttcagttcccacctatgagtgagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttccagatccctgaggaatcgccacactgacttccacaatggttgaactagtttacagtcccaccaacagtgtaaaagtgttcctatttctccacctcctctccagcacctgttgtttcctgactttttaatgattgtttttttttttttttttaagaaacagggtctggttatgttacccaggctggtctcagactcctggactcaagcaatccagcctcagcctcccaagtagctgggattacaggtgcacactaccgcacccagcttacttccagagtctaaagcccatgcttttttgctcttaaaattttgagacatactttataaagaaacctccaacgtcctcagctctactgcttagctgttgtttgattatatttgaccacattgttacccagtagaatacttctgtgatgggggttttggtatttttcaaaataatcccctctgggcatagtctctccctggcaatcctatataaaatggcataacctgatcagattaatgtacttgtttgcagtttctctcaatagaagataactccctgaggacaggtccttcatctgttttacatatccccatatttttaacatctggagcagtgcccgagtcatggtaggacctccatgaatgttcacagaattccatcttgggcttctgagactattacagtagtggttctcaaacctttctctaattcttgaatacacgtttatttgtcatgagcttccccccaccatggcaaaccaatttcagctcagtatataatagaattctgaaatgcaatgatcttcctggagaatgggggattatagtttgtgaaaagcctcataagtggttttgatagttcccttctattgacaattttttatcaggattgtttttgaataagtagtgaactgaagtctgtacctccatcctagagactcgtgcaaagaagtcttaattcttctttctcatgaaaactcatcagtggagaacacttgtcagagtggtctgcatgtcttctcaccacctcccccatccttgtatcttttcacctctaggaaaatatccctggatcctttatccattcctcttgaccatcctggttgctctcatgggaacattatccagtttctctacctatatctcaaagtgtggttgtttatgttaggaggaaggagaagagggagggggtcgaggtcaagaggtgacccatgaccacatgcctgggtctgaagtggggcgtatgaagcttccttgctcaggtcacaatgctcatatcacctttaacataactttgttacttgtgtgtacactctctttatttcctcagggcttagtttcaggaagggactattatcatccttgctttaaaattaaactataaacaaaattccttccatagttagcttggcctacgtgcagagataggcagaggccgttaacctacaagatgtcaccatgggcagggggcagggtgcggggagcagaatggagccactcatgttcagcctccttttgtctgttataatttccccattttcaaagccagtgatgttgcatgtctctcacctgtcttctgtattctctctgtctctcaccacaaccagaaaagggtctctgcttttaaggacccatgtcattagacagagcccacctggataatccaggctgaactctcctacctatgggtccttaatctaatcacacctgcaaagttgctttgttacataaggtaacatattacaggttccagggattaggatgtggacgtctttgacttggaggagcaagattgattttagaccctcatcactggtgggattggatttctgatgtagcccttccttgtccaggactgggcaggcaggtgtgaatctgtataaggaaggcctcaagttactgttcctgggctcaaccagctacatagcagatttgtaccacccaggtacacagcctgcatagcagatttgctgtctacagccattctcaccttttctcttttcaggagcatttgcaattatacggtcattgctttctttttggagcctcccgtgcagttttaatctactttcagaactggagagcacatcacattttggtcaatagcctagacatacagttgcataacccttaacttaccagtgctcattatttgcattatttcattttctgttcaagtactttgaaaagccaaacaactttaaatactacataaagtatgcatgcctcttaatattgttgggattcatctcattgttatttctgttactcaaaccagaaatcagctcctctttctagattgcaaactaataatagtagcagaataattaatagtactatagagtaatagctacagtttgttgatgccggccaggagccaggcagtgttccaggtgtgtgatctcattagatccttgcagacatgatagtgatggaattgttacttccattttttatagggcaactgaactcaggtgatattaagctgtttgctcaagctcatgcagatctaggatttaaactctagtttgtttgactccaaagtgctcactcttcccgaatgcagattccagttgttaatgttagatgagatggcaccttagtgccggtatagattccaccactggtcattccagaggtgtgttttgaagcagaagccaattagtactttgcctaaatgggaataaacttgggcccagcctttagtaccatacggcccctccccgtggacttaagaagcctctctgtgtttcagccacacacagcaccttgacttgcatgagcagggagttccagtgcgaggacggggaggcctgcattgtgctctcggagcgctgcgacggcttcctggactgctcggacgagagcgatgaaaaggcctgcagtggtgagtgccggtccacgggctgggctgggctgggctgggctgggaggctcgcttaccccagggcccctcctgtgtagaccttgagctaggacccttttgaactgttgctcaatctaaggataaaacagatttgtgcctagttttggagccccaagtgaggtgagccttggccagactctgatacaacatgcagctgtctcctccctgttagtgaaatgctagtcttggatttttttttttttatggacttcccacctcatgcccatacaccatggctctcacagtctcaatctgctggtgggattaactcagttcttatctctggagtgtctagtaatggaccctatgacatggtccttggacttgtagcattctctatggagaaataggcttaaattgtcataggcaggaggaagatgaaattcgagggaaaatatcacgaccggaaaagtaggagaccctaggagggattgtatagggaggtttcaactacattttctgagatttcttttcagataatgattatggcctcctgataatctagatcatggtagttctgtttaaaagcaggagtcctttgaaatctaaggatttgtaagatgtaacttttttttttttgtatttttagtagagacggggtttagccacattgcccaggccagtctcgaactcctgagctcaggcaatttgcccgcctcggcctcccaaagtgctaggattacaggcgtgagccaccacgcccagccaagatgtaactttgtttgtctttttctcctttatctctctagatgagttgactgtgtacaaagtacagaatcttcagtggacagctgacttctctggggatgtgactttgacctggatgaggcccaaaaaaatgccctctgcttcttgtgtatataatgtctactacaggtaggtcccatctttgtcatgggagatgaaaatgatgtcttcattgccccaggatgttctgtaaactctctagtggcatgcaccatgctattaacggagtcagacatctcagccccccatgctgctccagtgtgacaatatctttatttttttttgggccagggtggttggagagagcatatggaagactctggagacccacagcaataagacaaacactgtattaaaagtcttgaaaccagataccacgtatcaggttaaagtacaggttcagtgtctcagcaaggcacacaacaccaatgactttgtgaccctgaggaccccagagggatgtaagtgtttcagttaatttttatggcatgggtaagacctcaggtcggggtttgtgagggtctttctgagtattctcaggaatgtgggaacatatgtgtgcctcacatgtacagaagtatggtggctaagctttatagtcttgccagagttgtcaaacatctgttcttcttactgcatcagagactgttcttgtaccttaagttaatttaagattctctccaccattgccctcttgcattttttgtctagtttctacctctacgttcctcctctagatatttcctagtacttggtacttaggaggaggtcatcgtcattaaaatatgaggcatatcagcaattttgtggctaagtttttttctttttggagacaaggtctcactctgacacccacactggagtgcagtggaggcgcaatcactgctcaccacctcagtcttcccaggctcaggtggtcctcccgcctcagcctctcgcatagctgagactataggtgtgtgccaccatgctcagctagctttttgtatttttgtacagaaagggttttgccgtgttacctaggctggtcttgagctactgagctcaagcaatccacctacttcagcctcccaaaatgttgggattacaggtgtgagccactgcacctggctttgtggctaagtttttaagaaatttaccaaatttatgtgtctaagagagttcctcgcctcctccctacttcaaagtagttgacatgagcaactgtctgcttgaatgtcatcttttttcattgcctaaagtatcctgaatatgctagcgctaaactcattaaggagcctgctttgaagatgatcaaattcatttggatatagaaattctgtgatgttacaaaattagtcttattttttggtagtcatgcccacagtacagtttttgttgtacaagaagcagaggcagcaggtgctgtcattgacaattaagatctcagcatggaagtctcagggtcagtggtgactcagcctgcccaagtgattctatcctgcagcccttatgagccacaaatttaccacacactcaactgagccatgatgtgatgtgtggacggcacaccttgctttttggaagaagaggaaaagtgtcttttcaatgtgacgaccaagctagcagcctttctagtggatagtctcaatgccggctgtggagtcgttcttgtccttgttctaagcccaggaaaattcctctggttggctgctatgcagatgggttttaaccttgagttgactctttttctagtgccagatgcccctcgaaatctccagctgtcactccccagggaagcagaaggtgtgattgtaggccactgggctcctcccatccacacccatggcctcatccgtgagtacattgtaagtaccttccatgagttggctgtatgtgtgttgggggtgctaggagatttctgggtattctgtatgacgagggggttgatttggtttagctttgtaggtgatgacccatccgtcagaacattttgctcctcaccatcttttctctcctccagcctccttgcaagatattaggatgccctggacctttggttccctttactcacattttttttcttctccctttaggtagaatacagcaggagtggttccaagatgtgggcctcccagagggctgctagtaactttacagaaatcaagaacttattggtcaacactctatacaccgtcagagtgagtgtcgtcatccattccagccatccatgcagtcttagaactgagcgaaattgctgctgttttgtgagaactctctactcacctttgtgagatgcatattagtaatctgcaaaatacccaacttcttgccctgggacgggggagctcagagtttctttcagtctcttaaatggacaccacaaagagcttgacatcagagtttctgtagataaccgggcgtttatgggaatgccgctttccctgcttttaactccggtattctgctagctttccagctcctatacttttgcagtcagctctttcctgcttatctttagctgcaggatgatgcagagctatgataagtagtctttctaaactgattttatgaggttcttatgaaatatatttttagtatttttagcagaaagagatagattttgtgaacaacatgtttgctgagaccattaagtgtgcacattcatgactctcacactgataattttgtcagtaccctttttgtatatgtgtgtatttatgaacacacccccccatacacctgccctttagaagaaccttgatatttgtggatcaatagaaattttctgatctcaggactgtcataatgccctttacccaagctccttcccttggcttttttgccctcttatttcagatgctggggcctctgaatattctggatcactctgtataaaatttttccagcctcactgccaaaatctcacccctttagctcattcagtattcttactgtatggtgtatggtgtattgcctttatttcatattaattcaccctctgatttgaaaaggtggctgcggtgactagtcgtggaataggaaactggagcgattctaaatccattaccaccataaaaggaaaaggtaaatgatcccagcatttgcagatttagagaaaatattatacaaaccctttcaaatgactttcagtatgaccggaaaatggagaaacgtagtttagaaaaacatcacacaactttcttctccccaacacacgcacatttttgggtgtctctgtagtgctttagatagagtctttttggggtgactgagtgtctttttcctcctagtattgagcatttcttctaatgcagacatacaaagggatttccaaaggccatcatgcgcagccctttgtgagtagtcaaaatatctaaaatagaaggagtccttccttctcaccaaagctgaagatgattttgtgcatgttcacttacggggttttaaagaaagcaccatgctgactcttgttattctcccagtggcactggcaaactgtgtgtaggtggttttttatcttgtactagagctgatattagtaataactgatggcttgccaagggcaggacactctagagtgttcactgctttgcgtacatcagctcatctaattgaacagtcagaacaactacaagaaaggataaggaactggaatgaggttatgtcacttgtcccaggccacacaatcagtaagtgacagagctggccctggaacctgatctgcctgactccaaagcctgtgctcttaaccactgtgctccacgcttctctctgggctgagacacatgcggcctactggaccgccctgcttgccgggggtggcgggctcagcatcttgcacgagtgcctcatgagggcagagatctggtctgtttttctctactctatcacgggcatctagtagagactaaggaaataattgatgattgagtgaatcgaagcagttaaatgaagggttctggcatactttgggagatggactacaactcattttccagagtggttttcctgaccttagccttgacactggggacttgcatttctggacttccaggtattaaaaccagatggacactgtggcatgcaataggactggaagattttactttaacctaagcctgtgaggaataggctctgggtcatggagagtcactatctagtcccctctaaaatctggagcctttgagatcagggcccaaggcggccaaacgtagtgccaccagatggtctttggagctgaatgcttgcaggtattagagaaagcctgctgaattcacactctcctagaatttttattgttgtatctcttctctctacaaagtctgtttcaaaacactgaccacacataccaagaagggatgttggaagagcaaccaaatacatgtaccttgaattccgaaggcacaagtcacaactgcatttgaaaatctcagtggatggttggttctctttaacttcttttctgtgattttgatgaatctcagctgcttgcatatatttgggctaggatttgtacagaaggcagctgtgtgccacatccaaaaagtgtttgttgtaaaatatctgtgacatagtatcataataacgttttaagataaaggacaaagacagcagaggcatcagccagacgcgccaggttaattggtgaatgtagtggattagtaatgacaatgagaaaagccaccattccctgagcacttcttatacactaagcaccatgctattgttgctcgtgaatggatcccttattaatccttatgaatcctatgagataagtatccttatcctcattgtgtagctgaggaaatgggtttggagtggattgtgacttgtccctggttgccatgattataattcaagtcagctttaccatatgcagcactcgcactgttttgctctgtgttggccgcctgaagcttccaatatcctttcttcttccggttattgcattttcctgaagcctagttttattacatgattgatcatctggacagacctcttcagactttgacacatctcttttgccaccaaatcttatctgctcctttgagtctctcttgcccagtctatagaaggggcatatgtgtggagagtctaatatgcaagttgttgtttaaataatattttctgataatattgatccattgagctcttttagatcatgctgggccaagcactgtcagccatctggtgggaagaccttccagatgacaagcatggcgctcattggttgaactgagaggggtcttttccttggccacttctccttgccccctcgactcttagcttgagctccagtctttttgagagcaccagtggtttctagttgtttagttggccatatgtgacgctatattggaaaggaagagaaagagagtatcagttgagtgctaggcatcacacatacattattttagttaaccttcccagctctgtgaaatgcagataacatctctaggctccaggaagatcagtaacttgcctaggttacacagatgccagaacaggaattcgaactcaagtttgccagcttccagaggccacattctttccattttgccacacgcacgtttaccatttacgatttactccattgtcagccttccgaaaggacttgagattggtgggactttgttagtgccaatcaagatgccactcgcagtgaatgatccctgttcctttaagaaccaggctgaagctgggctgttttgggacctttacaaaatggaacttttctgcctgacctaattgccaggatagccgactgagccaagatagttttgtgttcaccaagcaactgtggaccaaccttagcttcaggaaaacagtggtaaaaaaagatcgatgaggaacactgccaaagaaataccctttcttccccgactgaaagatggctttgtccgttgagttgaaaactattaagtcctgccttcctcacttttcatcacgtggcttctgtttttgaattcctttttgttttcagtgatcccaccaccagatatccacattgacagctatggtgaaaattatctaagcttcaccctgaccatggagagtgatatcaaggtaatgtgggaatttcaagccagcagctggatggggctttattttgtatgggaactgaaaggacatagcacagtaagactggaaaaaaacaaaaaacaaaaaacaaaaaaaacgaacggctagatctagtgaagctaaaataccaggactagggtggttccttcccccatgaagaacaacttgagtcttcacatgtaattattctgcctcagcctggtgcctttttatccttaaccatataattaaatggttcacagctacagtgcaaataaagagttggtgttaacagaatatgtatgccctgtaattttcagctttattggatttcctggtgctaagcgctaatgctgaggcgctcacagtggaagaacaaccttcttgtgggagagttggataccttggaaacatattcactttccatccacctaagatcttcctcttccagcaccgccatcccctctactggccctctgcatagccgacttcatcattgttacctgtgcccatgtggttcctcaagctgagatccgctttccatagtgttccttcttatctgtccctcctcacagcctctccattgatgaatttgtgttgggacaagttgggacaagcaaccttcagagtctttctgccatttacttaactgccatttagtgtcatgaccttggcttcagaatgggttgatataagaaatggcctcggccgggcatggtggctcacgcctgtaatcccagcactttgggaggctgagatgggtggatcacctgaggtcgggagttcgagaccagcctggccaacatggtgaaaccccgtctctactaaaaatacaaaaattagccaggtgtggtggtgcatgcctgtaatcccagctacttggaggctggggcaggagaatcgcttgaacctgggacgcagaggctacagtgagtcaagatcatgccactgcagtccagcctgggcaacagagtgagactctgtctcaaaaaaaagaaaaaaagaaaagaaagaaaaaagaagtgggcttatatgcttcttgtcttgtagtctttgatcttgaaaatatttttgttcgttgtcccatatttaacgatcttcagatcaaatctttttatgagctcaggacttggaaaaggtagtctttcctgatgggtggatgtattttctgtagttagacaatgagatctaaccagcctgttttgtatggattgtcttcttggccttgactgcaaggatttatccttaatttccatggcctaattatctttccagtgtttcctctttctacctttattaattggttctcgtccttttattcttcattcacttttttgtttcattgaatctataaattaaatatggtctcgtttgtttttagaagtaggtggagtacaactaaatattagctaatggtagcacaagtagaacctgtttaaaatttttaaaaaacaacctgttcactgtaagaatgagatacccaaggaaagaacaggaaagaggtgtatttttaatcctgccttttgtatttagtgtgccccatgactagctgttcatctaacatgcttcttggttctcggcaggtgaatggctatgtggtgaaccttttctgggcatttgacacccacaagcaagagaggagaactttgaacttccgaggaagcatattgtcacacaaaggtaacactttggtgctggtcagtgtgtgtgcaggaaggggtaaggctggaccaatgctttcccgctgtagagcttgactgggggtgccagggaaggggaggtattctctggaagctgttctgtgttgacaggttcttgtgcattgaggatcctataagtgtgctgctgattctaggcagagggattcactcagtggcccctcgagccctcctccaacctcatgacccttagtggaagttgggggccataaggaggaaaattggacagaggcaagactaattctctgcagatgagttttgatttccaaaagaaagagttcttagatatagacagttacctgtctgtcctttctagtctggttcactctcccgttgctaatgagagacagcagaaggccttatgcataactggtgttcagtaaatacatgttgactggagaaatggacaacaaactaagggaggagtggtccagtccctgttacgtatgtaccagcagcaagtctcagctaaaattcctctatctaagcacgtgctaaaggatggattttaatttatttctaagtggcgaaagctgcctgtaactgttgagaatgacttgggagcttcttcctgtctcctccttctaggctgtgaagcactttcagtcatgtttttattgagtccttgtcatagccttataaagtagagactacaaatgttctattgttactttttttttttaactgaaagtctacaaggtgcccgaggaggctgttattttgacttttgcacattgagcacctaccatgtacaggcatttacacaggcattctacgcatattatttacataaccccaagtataattccgtgagatatgcccgctttacagaggcaaaactgaagttgaaagaataagtcatacgctcagacggtggcagagccaggattggaacccacatctttctaactccacagcctatgatctcattgccttagtgttgccccagtagaaactggcagagtcaggagcagaagccttaactagctgttgtttgaaatctattagggctagtgcgatgctaggcattatgccaagcacttcctaagcattttctttttttctccctgccagccagcagctgctgtaagtgctgttatttttttctccatcttacaaacaaggaaatagagagtttaaatactttacccaaggttatacaaccacaaagtatagagtcaggccttaaaccccagtccttctgattccaaaggctatcttgttagcgtaacctcccccttctcacttttctttttcttagttttaatagcatttcctctgatcagaaaggggatacatatttgtttcagaaaattgagagaacaaaaagagtgtaatgaaaattaaaattgcctataatttcacttttacatttcagatatcttctaatatatttttccatggattgatctctttatatcttttttctaaaatcagaataatgccataggtagtattgtatcctgcccttttcacttcacataaaattgtgagaattttccagtgtcatcaaatatttttgaaacaacctttagtgcctgcacagtagttgatggaatgcacattatttaattattatcctgttactagacaatcaaattacattcagttttttcctgctgtaacactgtgatggggatccttgttaaacacacttttgagtctttctctgacttcatgggataactggattgaagggtatgatttccaaggttcttgttatacaaggccaaatggcttccaggagcgttgtaccaactcctatccgcggatgggcagctttaaagaaattacccagtgcttgtgcagtgtgttacgtaccgtcatcatcagtacataaacgttgaatgaatttgtcatctaatgacagtcctacagcacatgggactcatttaagtcaagagattactatttttttttaaaaaagtgcatgtaccaagacacgttcttgactaacacccccaacttcctcctggaatctccttttcctgttttcacagttggcaatctgacagctcatacatcctatgagatttctgcctgggccaagactgacttgggggatagccctctggcatttgagcatgttatgaccagaggggttcgcccacctgcacctagcctcaaggccaaagccatcaaccagactgcagtggaatgtacctggaccggcccccggaatgtggtgagtcagccagaatgaccatcacaaagtgagtgtggactgtcccctaatgctacgccaccacacaactccagggcttttctctcttttgcaaatgttccggtgcccctgctgctcttggatataggcctttctttttcctttgttttcatacgtgcattatgattcactatgatcagatctgtgctcctttttgagtctactgttttactttccactcctccccagtgtgtcccctttgcttttagatcaaccgtcccaaggctcttggcacattcgtccccctcttgcctctgtacttggcttatgccctttctcctccttggtgtccttccctcctcttgctatgcaagaaaatcctcccttctatagttgatctctctccctatgaactcctaatatatttatagttggttccatatagcatgatatttcattgaatacagctttaccctatttgataatttttgtctgttactcttaccttcctaactagtttgtaagttccttgaagggaaggattgttttctggattttctcaatggaaaagcatacagaagtaaatttataataaggaattagtaaatccttagtgatgagcggaggaactagcctaggtctggtcttctgaggatatcttcagcgtgcatttgtcacagggctgagtcatagggaaataaccaaagtttgcaagtagctgtctgtaaaatcagtgaagaagaaggaagaagtaagatttactgagcagccagtaagtgccaggaacaatataaaatccgataaacccctgttcccccttattcctttcattggttctgtgggtaaatattcccattttgccagcaaggaaactaaggctcagtgaggcgaagtaacttgccagagttaaagctctcacaagcagtagactgagtttcagctcaggtctggctaatttaacagcctctgctcttttgtgtgtcccagcacctgacgctgaggcagggacagtgatgagaagccctgacctatccccggagctctcttttacctggaagttgagtctactcataaagaaccctttctttccatttatatacctggcagcacatgaccgcctcatcacccccaactatctctccagagtagggcaattgcacagaacactgaagcctgacttgatttagggtctccaattgtgcatgaagttggaggaggcttcctgcacctcatctcagctcatgcactggtcacactaaaggtggctttcagaggtgagagcgcaaatgagatcacctgtaggaagctctctgcttctgcccctctttagttcattgaggaccctggcagctctcatgattttcctgtctactgtgagaagtgccattgtcactgtgcatgtggggaacctctcatcccttggctcccgtggctctgtggacccctttcctctccagagacaccccatccctggcggtcaccagccttgtcctcggtgatgtcatcctccctctgtactctaagccccgacttggcctactcccatctcatgctttgcagctccacctgcatttgctttgggacccctttgagtccctcagcgcttctctttcctacatcctcccaggcgatcacccccttcggggcttcccttcctgtttctctgtctgtgttctcccatctgtctgtcctttctcatctgtcaacaaaaagagtcaaactctgtaaaatatatgaaaagatttattctgagccaaataggagtgaccatggcccgtgacacagccctcaggaggtcctgagaacatgtgcccaaggtggccgggatgcagcttggttttatacattttagggaggcatgagacatccatcaaatacatttaggaaatacactggtttggtccagaaaggcaggacaactcaaagtgggcatggggaagcaggggtttccaggctatagggaaatttaaacattttctggttgtcaattggttgagtttgtctaaagacctgagattgacggaaaggagatgttcaggttaagataaaagattgtggagaccaaggttcttttgacgtcttttagtggctgcctttaggggaaatagatgacagatgtttcctatccagatctttaaaaggtgcaagacttttagctaatgtctttaggattgggagggcctggaagaaaaagatctagctatgttaatagagattctttacagatgcgaaggttcccccacaaaggacagcttttcagggccatttcaagatatgacaaagaaacatgttttagggtaaaatattttgattttcttccttgtctcataatgttatgccagagtcaacttggaaagtaagtcacgatatataggattaaataaaacccatctgatgagaatttatggtttgtaggacatgactccccagaccccttagatagggatttgggcaagatttaaaaaatcagagcttagtcctcacagctgctgagcagtgctggagaaagtcaccctgttgcctgggacttggaaatccctttgtggatccccgctcagttcctgctcatcccatggatcctgcagctcctacagtcctcgtcaagcccatgtcttacatgtgcacataactcttggagaaaatgctctttgattgtgccttacaaagaaagcttcctcagctcccaccctccagttataaactccctcggcttccactttctgctgtaaacttcatcccattcccacttccctgcttgaaactccctcagtttccaacgtttaccagttaggactaagcagggatgcatagagcagaggaagtgacagtaacagtggcttcgaacagtttatttcctcttgtaattaaaacaagtttagagttgagcagtgcagggcttctgtcgtggcagcacgatttgattgggcacctgagccctgtcatctccagcctgtggcatgtgtcttcaagctcacctcatggtacaagaggcctcctgggcctgcagtcatgatctgtattccaggcgaccagagggcaggaagaagggctcctccctctgttgtaatgagccctcctaaagcttttcctgcgacacttctgcatctcaatggctggaagctctttgtctagcctcttctagcttagggaggttcgcagtttagactttttccaggcagcaattctcaatcagaaccagagttctgaggaagaaagggaggatgggtacctgttggacagccagccgtgtctgctctccttccctccctccacatacttcctggggtgttcgcatccactgtgcaagctcccatggctttccttcccactcagcacatccccttggagcccacgtctgtgctgccaatggtagaatgacaccccctctttaataaccccccgttccctggctcatcatgtgggtttctggtgtagcatctaacactctatgtttgccacttgttatttataattatgtatgtttttcttctctgcccgcctctcctccagaaggagcgctttgaggacagagaccacatcatatttatttttgtagctctacatacagtgcctggcccaagtgccttctctgtaaatgctgtaaatgtaataaatgttgaatgaagacttctctgtgagctcttttgaagcagttccagggtcttaaattggggatttcaaggaaatgagatcatcggcccatgagctgatgtcctcttccattctctgcttttaccaggtttatggtattttctatgccacgtcctttcttgacctctatcgcaacccgaagagcttgactacttcactccacaacaagacggtcattgtcagtaaggatgagcagtatttgtttctggtaagtttcccataccgtttcagttttttaagggatgtcttaagtcctgggctctggtctcaacccaggacctggggagcttgcatacctggactccaggattgatgtgtgtgacgagaggcaacttcctcttcttcataagcatcatcaggttcttgcttgaaatacagaatgaacggccactttcaccaactgcagctccgttatggaggactgataacttggcagatgatcacaagtatagataaatcaaaaatttttatcaggttccacttctaggaatttagcctacatacttttatgtgtgtgccaagatatatggagaaagatacatggtacgttattattcttatgatagcaaaagatgtgaagcaacttaaatgtctatgaagagaggactggttaaacatatcatggtttattcatgcaatggaatgcaggacagccgttcataagaagtatgacaactctaaatgtactgatatggaaaaatctctacgctatattattatataaaagaagccaagagcataatatgtgtgccattttctcagttgtataaaaaatatttgaggaagataggcttcatatacacgtgcatatatgtgtaaggatacacgtacatacatatccttccttatatatgcataggggatttctggaaggaagcacaaaaactcttaccagtggtacctcttggaaaatgatttggggtaggtgggaaattattttatattttatggttttttgtactaactgaattttaattgttgtcattattttgttgaaaaaatactttaataaagattgcataaggccatgatgtattttttttcctacgtgtgtgcttgggcttcaggtccgtgtagtggtaccctaccaggggccatcctctgactacgttgtagtgaagatgatcccggacagcaggcttccaccccgtcacctgcatgtggttcatacgggcaaaacctccgtggtcatcaagtgggaatcaccgtatgactctcctgaccaggacttggtgagtgggttgggcttccaggcctctttgtttattcctggcctggttagggtggggtgggatggaaggggatcctctaatggggcaagaaacacaggcctggtttctggcgctcagcaggaggtctctctcccatttcagtctgaccaaagatggggtccgtacagggacctcttcttagttggcacttctccattattcctagctaccattttggtttgtccctctttctcctccgctgctgatatttccttccctgaccctctcacacagggattagcaaacaaaggcctgcaggccaaacacagcccattgcctatttttttaaaataaagttttattggaaccaagtcatgcctatttgtttatatattatatctgaccactttcatgcaatgatcagcagagttgttgtggtggagactatctggccctcaacacctacagtattactgtgtgtggacccttacaaaaagtttctgacccctctttaaaaggagcattgatcctaaacaaaacaaaaaaactgccattttttccttgctctgggttgctcttccctctctcctctctccactccccttcatccagcggtggttggtttaaaatgcttggttgctaatactcctctcaactctccacttccttgtcatgattgaatttcctgtgcttactatatgccctgttattttccccttgcccccctatacccagaagcagcctgggagaaagtaagtagagccttgccctttagagccaggattgaacactttggttcattctctctccaccaacaacatccatgaactattgcagtggtggagatgtggaagttgagtactgagtttggatgtgcttgcttgttccaacctacctgctgatgtcacgataaatgtggccctccctagagggttaaaaaaattttagttgataactctatgtgcaattctatgagtgaatagttattttaagattggatctggtcactccaaaggccttccaaagaatggagtcagatttcgggactcaaactcttgttgctgtgggtcccagctattaatatactacattgtccaccattgaactacaaagagtgaaaaatgtcaactttctgattatcattcacttgttcttttttggtcctagttgtatgcagttgcagtcaaagatctcataagaaagactgacaggagctacaaagtaaaatcccgtaacagcactgtggaatacacccttaacaagttggagcctggcgggaaataccacatcattgtccaactggggaacatgagcaaagattccagcataaaaattaccacaggtaagcaggagagaggttagaggtcttctcacacagcctgccctcagtgctgtgccgctagacctccagagacagacttttcattaggcgtttgtttcacagggagtgcaaacgctgcccttcaatattcctacaggggcagagtagtgcagaggctccagggtctgagccgtggcgtggtggccagggcacagtgggctggggagtggctatcgttttctttattttctaagtctttttaactcccctcgctggttttgatattactaaaggaaaagaggagggatgcccaagagaggaaataaaactgaatagttgccactaagaccaagtgctgtatctgagaatctggatgacaggttctcagtggtccattgtggcaatctgacatgttgaaatggagggagacccacagctgggcagtagatcaaagggcagtcaggctcaagttcagagagctggtagtaagctccgttgctcagacagcagcaggtattattgggagttttgatattgggtaatggaggcccagccccatttatgctggtggcgtgcagtgggcctgggccatgtgccattgtcactccagtgtcctgtcttcagatggaactccttatcccatcccattccttcctcaccacccttctacccaaccccatttgtttttgtacacacttggttacaagggctattaagtactgtccaaatttcttggctaaagatgttataacaacaataaaagagatgccaataaagaatatctaccatgtgctaggttctgtactcagcaatctatgtgttttattttttctgtaacccagccctccaaggctagcattatttaatctctctttgatagacaagaaaatagagtttcaaatgtatatccactaaccgcatcccatctcatctttaattttcagtttcattatcagcacctgatgccttaaaaatcataacagaaaatgatcatgttcttctgttttggaaaagcctggctttaaaggaaaagcattttaatgaaagcagggtaagttcctccctcattctcaatgactttggaaatttaattgaaatgctgtttcagagatgagcttgttgacagcatgctggcatagatagtgtaaaaaaaaagaaagaaaaagaataggacatggacatgaacttgagaattaaaggaccattttcagtgggattgctaattagcgaaatgcttatactgcccgttaaagatgagaatctctgcactaagcacttttcaatcctgacttgtcttcccctgaagaaagacaaatgggctggaggccatgctgtgcttcccgcagaagctgcagctgggctggggctcagggtgttaaaccaggagcctattccacactcgctgagggtgggactgtggcttcagtaccaggagttgagctgcactctcagcctggcatctcagcactctcttcccagataaattacagggagcaggaggcacttgaagatactgtgctaacttatgaagaacaccttgattttgtttggttttgctattggtaggccaatatggtattcacagcaaaagacaggggaagaggagtgagacctgggagtagatttaccacccaagggtggacagattcttgagtaaagctgggttggccccagagacagcaaagcctttgctaaataggaatgtgatgaatcaactatggctacctggagatgcagcataggcaaagagccatgggttctaaatagtcaccgtgcaataccaaagcaaagtgaaattaaaattggaaaattctcaccacacactctgtgagaattctcataactcttgtaactatgacatctaaatggctaatatccttaaatagaaggaaagctttcaagtaagttcaaaatggaaatattctaattttgaagaagggacatgtaacaaagcggaaaattccagcagcagtaagcaaaaggagaaaagttcaacctcaccggtaatctaaataacaaagaggtaaccctctcatgttaaattggtaaagatttgcagggaagagtataactggtatgaatagtagttggggaagtaaacgttctgggaatatgaattggttcaaactcaagtaaggttcttgggtaatacctatcaaaaacgttgaaagtgttcacacccattgatccagcagttgtaggattttactctaaagcagcaacgtgcatgaagaatttgtgtgtagtatttatgacagcaagaaagaggaaacagccgagatgccgaacagaagaggatgggttaaataacgtatgggtggttgatgttgtgtaatctcaattattttctttataacctttgtgtattttacaaatgatcgacaccagatatctattaggtggaaggtaataactgctggcttataggaaagaatgcggggatgagattccaggcaggtattgggaatcccagttcggcagccagtcgccattaggggatccttcctgggtggctggagcccggctcttaggttaagattctaggttagtatttcgttcctagtggagggtctggcataggcatagcatgtccttcttcccttcccctgacaaggagttcaaagaattgtattagtccgtttccacagtgccaataaagacatacccaagcctgggtaatttataaaggaaggaggtttaattgactcacagttccacatggctgcggaggcctctccatcatggtggaaggcaaagaggagcaaagccacatcttacatggcggcagacaaagagagaatgagagccaagtgaaaggggaaacttcttataaaaccatcagatcttgtgagactattcactaccatgagaacagtataggggaagccgcacccatgatccagtgatctctcaccgggtccctcccacagcacaggagaattataggagctagaattcaagatgagatttgggtggggacacagccaaaccacatcaagaatagatgggtcagtggtattgggatcaagagactgtgattatgcaagggggcccaatatgtggctagagaaaagtgatggagtcttttcagggggatggtggagagtgtcagtagctttgacactggaatagttggggatcagcagagaagtcaggttgtcagccctcatcccagctagtatcctgggccagggctgtccccaggatggctttttccagcaccagagtccagggctgtaactaggaagacatttcatcctctcctccagtgaacaggggcctgagctggcttcagtgcttctgatttcaaggccaggttgttggggggctgagatcggctcagaaggagctagagagcagggagacaggaagtgagccgacaaggtcattcctacatattgttctggggacaaatgtcttgtcttttctaattgcaagttctcctttctcaccccattgctggagtccactgcgacctggatttattattagtcaaattccattatggcaaactgttcagattcttggtggcatttaatattgcttgagacaggcagactgctgagcaaatctctgagtgtggctttggtaaaatgactttcctgagggccacagttttcatttccacgatatagcttgttgtgggggggtggtgtggcagttatttgagatattggagatgagaaaaattttcattttctgaatccagtatctcagtggtaatgtaaaaagaacaaggagaaacccagggcgctttcgcgtctgtagcagcccacagtgaggagctcacataaagatggaaccagtaatagaggctgtcagtttccatattcgacttcctgagcaatctcttgtgtttgttttcagggctatgagatacacatgtttgatagtgccatgaatatcacagcttaccttgggaatactactgacaatttctttaaaatttccaacctgaagatgggtcataattacacgttcaccgtccaagcaagatgcctttttggcaaccagatctgtggggagcctgccatcctgctgtacgatgagctggggtctggtgagttgcgattgctgcccgtttctgtcttcagttctagggaaatagcaagaatgtcatatggtttcatgaccatgtgtctttctaaaacacatggaagatattctcagcttaaaagaaaatcatttatatatcagtttggtcaggtagtgatgtatttaacaaatacttcctgagctgaacatggtacaggaagctgagattacagggggaccggattctgaacataaagtgcaagaaaggcaaggctttgtttaaaaagggaaactctaggttcacaagagtttcatttgttttttgtgggacttctcagcacctctaacatgctaatatatcctgtggatctccaagccagtagatcatctccttgtcatggattttacatgtaaaatcatataactgattttacagtgcacacctctgccccgccccggcttcatcttagctctcagcataagcttaggactggaatttgtcctgggatctctgtcttatgtcttatgctgggccatgctagtgatggaagagaggacccttccgttcatacagaaagtctgcttacattatagtagtttggccaggatttcaacaaatgttttgccactggtcttttttagttccatttactctcagccaagaactaaccagtgctcaagccaaaatcttgtgttagagttgttaaatgttccgtctcatagtgtttctcagggtgagatcttgtgcaatatttatccttggcaccccccactaagagagggaaacactgcctgccacttcccttgggagaatcttaacatattagaggttctaagaaggtcctacaaaaaccagcccaactcttgttgacctagtatttcctcaacagagccccatttttaggcaaaactaattggcaacctgtgaaatatgctttgggaaaaattcctgtgcagacccctcccggccacctttatggaaccaaggttgtcaggcagaagggctcttggccaacatcttgccccttcacgttcaccttccccttggaagtggggtgggggagggagggcactccttcctggagctcccagccttcattgtgccgacttcctcttcactgctccagccgcacacacccccttcattaaccactgcacagttggaataggttggaacatattaaataagatgttgctagagtttttttttttttctggcaaggaaataatgaaagaaatgtaaatacagacacgaatattgaattgttagattaggtttgcaagaaacaattgttctctggcccatcttgatgaataccctgtcagggtgaatgcctggggagtgacagagctttctagtgaagcagagacctggcctgcgccacctctcccgacaccagggagcaaccctgagcctgttgaggctcctcatggagacctagactgagggaagtccagtctgtttcctttgccaaaaactgattcctaggtttcattttcaagttcagacttaccctgggatttttaacatgaaaagtctaccgttttcaaggagactggcccctaccccagcaggatgggacgtggggcatggctttgccctagagccctggtggtacaaatctattagtgaatcatcacagagcctgtttgtttaagtcaataggaaggggccatgtttgttaggttataaatgccgaaacggctttgcaaataactttaaaaaatgttaaatgtatatggaaagttgtttttctccctcactctctttttcacttaagtgaaaaacctcataaaacttcatgagctgttaagtctgtattgtggtgtaggaatctcgtttgtatcacttaatggagcttcaggtaattgcagttcagagtgactttggtgccaagtagggggaaataattgcaatctcgttaattagtggtctgatttcacatcctcttatgtaaggcaagcaagtggtcttaagtaataatgctaatgaaatcaatgttgataccccaacaaaggtctcccttccaagagattatctaaataaccaacaaggcagtgattaggagtctaatgtaattaccatatttgcatgcacaaggcccttggtctatcagctcatggcaagtagtggggaagcaatcaggcatcacgcacatgcagaaacgtctcacaccagacaggcagtttgtgtagctgtggctatcgcccagctttttttggtgggtggggccttgaggagtcatctggtctgttctcctgccctcaggtgggcttattggtgggaactttgccttggcaggtgcagatgcatctgcaacgcaggctgccagatctacggatgttgctgctgtggtggtgcccatcttattcctgatactgctgagcctgggggtggggtttgccatcctgtacacgaagcaccggaggctgcagagcagcttcaccgccttcgccaacagccactacagctccaggctggggtccgcaatcttctcctctggggatgacctgggtaagtggggcagggagagtcggttcttcctcccagggctgacccccacgcagccaatgacttgattaggaaacacccaccttcagctcctcttttgaccctggaggagctcttcatcagccagcgatttgattccatgagttttggttaaaccattcagagccctcactttttaacttttaagttaaattaaaatgttgtattctctttgattgtgtagttctggcctgaaacagggagcttgccccaggccttgagactcccaaagtatcggaaaatcctcaagaatatctgacccctgtctcatccttcactgagctggaggtctgacatctctggagatcctaactcaagataaaaaataatgctttcccaatcagcttctatcaaaggagaccctttccatcttgctgtttctctttctggttgctagtgtaacctcaccagccattcttttatgtaccttaacacagtggtccccaaccttttttgcaccagggaccagttttgtggaagataattcttttttcactggaccagcggtggagggggaagggttgggggatgatttcaggatgagactgttccacctcagatcagcaggcattagattctcatagggagcgctcagtctggatcccttgcacgctcagttcacgatagggtttgtgctcctgtgagaatctaatgctgccctgatctgacaggaggcgaggctcaggctgtaatgctctgactcaccactcacagcctgctgtgcggccccccattcctaacaggccatgtactggtactgatggccctcggcccgggcattggggatccctgtcttaacacatagcaagggaaaaagtaagaagtttcccgttttgaaatctttgcacaatgaaaaccctaaatgctaatagagatagtaagatagtaatataataaagtgggtgtgttacgaggcttccccaaacttagactaatcactgtgaatgtacaagtttatttctttccgttaactagttacaattatatatctatgtttataaagacatttgtatattccccttcactgatcatatgatgttagctctgttccctttccttgtcagtttcctttcttgcctaataagccggcacctggactgccttgtgtgaatggggcggcttctttgcttctgccgttggaggcaacaggagtggacccatcagcataccctgcgatagtcactgagtgtcggtccacacttggtgacacaggattataccgggcgtcacaaggggacagctgttagtctgggaagctgtcctcaaaatgcttaaactcctcccagatccttttcctcagagcactttgggttcagaagagaaagcagacactgaagttcactgtgctagtgtagggtatagataactcaaactggggaacccaaactacccacttagcttttgagtaggtaataagagtcttctcctgagaagctttgttttcctaatttggctacgttcaaacgaccactaaaataaatgtgaggatccatcgatgggtagaaggtggccaggagggacagtgggaagctgggctaggtttcacagctgattatggtggctgcctggctatggcattgaccttctcagctagagggttgtggtagggttgaggggtgggtagagtggtgggatatggggtcaggtgaaaatgtgttggaactcaccaaggcctgactgttttgtctctaggggaagatgatgaagatgcccctatgataactggattttcagatgacgtccccatggtgatagcctgaaagagctttcctcactagaaaccaaatggtgtaaatattttatttgataaagatagttgatggtttattttaaaagatgcactttgagttgcaatatgttatttttatatgggccaaaaacaaaaaacaaaaaaaaaaaaaaggaaagaaaggaatgaataaactttgtagtaatcaactgtgaacttcaaaccaggttgattttagtaacccaattgctttgatttgacattaatgtagtcttacagggctgtgcttgctgggcatgcttttacgtctgtgagataatttcggttcagtaaattggccaatctttttatttttctaagacacagaaatgtatttaataaaaacctcgagagagtgatgggtggaaccccttctccttgaaagtgtgtacagatattccattttgtttggatatagtttataggaaagtgtgtggatgtattatggcggaaggtttctttatgttattttgttaatttattgggactctgtgtaaggccaggctttagtggtcattagacaccacatgtgttatgagccccttacccatagggttgggggtgggaagagaagcatatttttttgccattccggaagcaatccatttttattcacttgtgtgtcatgtaatggtctttggcaggagagagcactgagtcattgctggagttcagttcaacagagctgcagcttgggaagccctgtaagcccacagcttcctctcttatattaattgatggaattttactgtatgtgcctctgtacaagatgtagctttgagagctacaaaatgataacactgctttattacacactggtttcattgtcattgcaaaaacttaccctggttgtgggggagagttctagatctgtgccatgatccatacactggctaatagagtacataatttttccattttccattttttgtttttacttactactgaaggatctcagatgtaaaattatgtatttggtttgagatggccacttattgtccttaaaaatccatactgatatatgcagtcattttgaattggacagtgccttctctttttttttctcctcttcttccatctccctcacccatgcccccacccaatctaaagagacagtgctgtacattctcatagagatagagaagatctaaaaagttgagactactcaatccagttaacaacagcaggagcactagagtttgttcatttattctctctgtaaaacaagctgtgctttttttcttctgcctttaaaatgccacccgtgtattcaaaccatggccacttgatacttatgtagaatccatcgtgggctgatgcaagccctttatttaggcttagtgttgtgggcaccaatgtcgagcatcgttgtgacttgtgctgtatgattctcactgaagaatttcctttcagccaagaagcagtgaggtctgggaatattccaaagtcatgtctctgaatatgtgtccttgacgtgcaagctttgtaaaaccccatccccgcttaggtgcgaggcatcaccttctcacaagtgtttagtttcttttaaccacaagtatcattcttgggtgataatatagtttcattctacttagggattgtttagaaaacaaagaaagagccaattaaattttttagtttttgaaatttttatttatatgtatacttagatgagtattttaagctgtcgacctttagtttgccatacgggtaggactgtatttcatgttaacaactggtggtaatgataagccttcttctagcgtattttctcttctttcctgtcactttcctaagtttttttttttaaagactggaattttttttggctttatcttgtcttaccgtagagatttgttcaaaactctaagccctaccacctcccctttaataagctctttaaatagttgaatcattaacaacctggtgggaggcaagtcatttaattgaaccactaggaagtgtattttcttttctttttctgccaactttttggtggcatttgtaaaagctgatataaaaggctctgagatgttattttcagttattccataggcaagcctttttacagagcatatgtctccagttggcagcttgagatatttccgagcatccggttctagctaccagtgcctcccaatgcttagtgcacagtactgtagactggccatcacccctctccttggaaaatgccactgtgctgtttgaaaaaaagcagccttttagggctagagtattttatataaacagaagagctaagttcctgaagactaagctagatagctgcagctatatgtaaattgtatatttttatgaacttttgaagcacacactcctgtttccctctgtgtagctttgtggggatttcatgtatatatgctgtctgaaagaatccagaggttggagtgccaatagaaaatgaaaacaaatgccttgtactacaggcagcctctgaaggtgaccacataactgtcttcactgtgaccaatcggagtccctgcttgcttgtgaagaaggggcttttgtaccttgttggagatgccacctcagaagttcacactgtgcaggaaaaaggttttattctctcctggcatacattagaatgtcagatgcttgcatccatgtggaccacgatgggcctctaaaaattggtgggcagggggtttgcttatgagttttctctggaaaccgattttactcctggatgtattgaatgccccttgagctttatgagatacgagtccacatggataaaatgttagagagtggagttctacagaggattccaggaagaggccatgtctgtgcagtcctagttccagacaggtgagaagctccaggaactactggctaccttgacaagctgggtaaatagttatcattctgggtaactggttgaaactctgacttttggacaagtaattcctggggttctgtctttggtagcatcaccagggatatttgggtgggacagacagaagacacacagctgcctgttctctcctgcccatcatgtttggcccactagatgaagctgtactcagcaatttagggaatgtaacccttctcagaactggccattttcaggggaagcttgggagagcaatagtatggtgagccccttagagatgagcgcctactccttcttggcgaatgctgccttcagatgcttaccaagtggtcactgcatctagtaagattatatttccagtacacttccttagggcagaaacaccatcctatcaggtttggtcagtcccttcttcatgaagggagtcatggggaattcctgaaaattttcttccttctgcagacagttggatgagtcccttagagaaggcatccagagacataactaaactgaatatcatcccatattgattttaggaattgactctaaaactctgtgcagaatcttgtgttgggattgtatcttgacattcctgttgtgttatttttcttaactggagtgtgtgctgcctttcaggtacaatttttgtgtaataaaagccagtgcattaagtttatatagactactttctatgcaagactgagatatggaatagataggaagagatatgtactgctgggtacatggacagtaagtgtgttttcagatggagtaccagcaccgaaaatgggttgagggaggatgggttgtatgtatgtttctgcccactaattttgagcagccatattatgaattaaatcgtcacagccaagtaataacccaagaatggtatgagtttcatgtgtaatagctcaaatggaataagcatgaatgctggagtggaccattatcctcaaatattctatgtcacttctcatttaaagactcttgttatgaactattagaaactttaggcaaaatcaaaagtatttgcggcaaaataaaggcctattctactcttatttaaagtgaaacactgtatacttgtttctctccaaagcgaaattaagtatttataatttcaattgcctcgataagtttccaagtcactgaaatctgctgaaggttttactgtattgttgcacaactttaagataatttttgtctcaatgtcaacttttttcactgaataaaaatttaactgggtcaagaaaacacctctttgaaaatccactgtctctgtgtgtctcgagctgttctttagagcgcaataaagatggctgacgcagtctccaaacccc

SEQ ID NO: 1394 - DNA, 140524 bp, Homo sapiens
tcttggccctggtgatttatttaaaagtcatagactttattcttcttacactgtttcagtttgcagactagaaaacctctccctctgcacactgagaattcccactgcagtgaatggaaggtcaatgtatgtaaagcccacgtgagcagtggcggttcaagcccagagaaagaaggtgttgagttgccttggtaaagaatttatacaccatgtgttcacagcttcttgacaggtataattatcagtgttgtcttttactatgtgctgggattctgaagcacggtttcaaatttgtgactatcggatgtttgatcaagtagctttccctcaagggcctgaaagagaaaaagagtgaagagaaatcagtgattagtattcatttgtcaactacaatatgctaaaaatatcaaaagagcatatgctatgtgagaacagcaaggattattttgggtgctatcattcatgcaccatcttctacatatgaaaaaattcgtttgatgtttgcaaaggaagtaattatcaaatgaggatggaaaagccacagttgttccctaaaatgaaataaagaacaccagtttggaaacatttcaaatgtaaaacatttccttcttccatttccagatgattctatttttcctcatgaaggcaaagaataaccaacatttatgttacgactcttagggcttttagtagtgcttttgttgaggtagaagccagcaaaacctctctctgctaggctgggagcaccaatattccttctctgacgtggacattaaatctgtctctcttcataaggtcagcctgacaccacatgaaacagagtaggcaattacctctatggtcagagtttggggagcagtcttgccagatactacccccatacctgccactcttccactattagagggtcatttctttcagagagaacagtgatttttacatcttcgttctcaaagctgcagatatttttatttcaatgaatgccaagcaccatattgaaaacagattttaacaaaattgttctgtttactttgcgtcaacactctccagctgtcatgctttaaagagatgtgcccaacctcccctggggcctactgagtggattgaaaaccgtgcataaacccattgtgtttcctcaggagtcaccaacgagatattatataacaacacataagcattaacattttaactattataatatcatcattctgactactacttctatcactaatgaaaatttattgagtgctcactaagtgtcacatattttgctaagagtttcacatttttttttcatatttaatctccacaacagaccattttactgaatcttagattgaataacttcctaaaggtcatttagctacaaagtgaccagagatctagactgagttcttttttttttttttgagttgaagtaaatcttcacttcccagactcaagcgattcttctgcctcagcctcctgagtagctgggactacaggcatgtgccaccacctccagctaatttttgtatttttagtagagatggggtttcctcatgtgagccagtctggtctcaaactcctgaccgcaggtaatctgcctgccttggcctccaaagtgctgggattacaggtgtgagccaccgtgcctggcctagaggctgagttcttaatgaattaaatgataatataactacatgtcctgaaggaatgggactcagaacaggtgaattttagtaagtcttggatctcttcatctatccagggcaggagtcagcctgagagagagcactgggcattcaacatgtgggccactgacatacctgttgggaagaaccagctgcaacaaatgttagtattgccctcagtcatgatttataatttaactgattaacaatttatttttaagaaaagcttcttttccatattagtgtgtcttgttgatcaaattgcctactaactcttaaaagagccattgtggtaggcagaatagtgcctcctcgtccactaaatgttaagtccacatcctaatctccataaactataaatatgtttgattacatgataaagggcagttaaggttgtaaatgaaattaaggttgctaagaagcctatgttaaaatagggaaataaccctggattatttagttcaatccaatgtaattaaaagtggaagagggatgagtcaaagaaaaaaaatcacaagagaaatttaagaatattttgaaccaagtaaaaataaaaaataaaaatgttttgataagttgtgggaaccaaaaaatcaatcatctatgcttcttccttaggaaactagaaaaagggcaaattatatccaaagtaagcagaagaaaacaaataataaacattaatgaagattaatttttcattaataaaaattaatgtggaagaaatcaatgaaattgaaaataggaaattaatagagaaaatcaatgaaatcaaaagctgattatttaaaatgatcaataaaaaccaagcactgtggtgcatgcctgtagtcccagctacttaggagactgagatggaagaactatgtgagcccaggaatttaagtccagcctaggcaacatagcaagacccttcatctcgaaaaaaataaaataaaaagacggataaaatcaataaacttctagccaagctaacaaaaaggaagagaagacacaaattattacttctattagaaatgaaagtggtcacatcactacaaataccatggacattaaaagcatagtaaaaaaatactatgaacaactttatatccaccattttgataacctagatgaaatggacaattccttgaaagacacagtctgggccgggtacggtggctcacacctgtaatcccagcattttgggaggccgaggctggcggatcatctgaggtcgggagtttgagaccagtctgaccaacatggagaaaactggtctctactaaaaatacaaaattagctgggtgtggtggcgcatgcctctaatcccaactactcggaaggctgaggcaggagaattgcttgaacccgggaggtggaggttgcagtgagctgcgatcgtgccattgcactccagcctgggcagcaagagtgaaactccgtctcaaaaaaaaaaaaaaaaaaaaaaaaaaaaaagacacaatctgctaaaactcacatgagaagaaatagacaatttgaataggtctatatttataaaagaaatcgaatcaatacttagtagccttccaaagcaggaagcacccgaccctgataggttcactggagaattctaccaaaatttaagaaataagttataccaattgtctataattgctttcagcatatcagatagaagcagagcgaatatttcctaactcattctatatggccagcattacattaataccaaagccagacgaagacactagaagaaaaaaaaaccaactacagaccaatatctctcaagaacataaatttaaaaaccctcaacaaaagttagcaaatcaaatccaacaagatttaaaaatgttaatgaccttaatgtccattcagaagagattgattattgtatacctagaaattaaaactttacacagatatttaaaatgtagacctaagtctactaatgttaaccatattgtttaatttttaaaaatcaggttataatttagcatgtaaaatatgagtgaaaataagcatatatatatatatataaacatacatataaacatacatatatagaaataacatttctggagaaaaaactgtgtactaaaatgaagtgagattatagctgaaaagttaatttattctttatacttctctactgtctaaaaattttgcaatgaaaaagtgtcactttcatacacaaacatcaaatgtaaatcaatagaaataaattaacagttttgcaagcaccaagacaacaacaaaagtgaaagagggggacagaaaacagcgttgtgatgaaggcagaggtcagagaaatgcaatgtgagaaggattccactaccgctactcgttttgaagatggaggaagggcccaggaagcaatgaattttcccctagagcctcctaaagcccagtaaaactgtgttggacttctatcctacagaattacaagatatatttttaaaattgtatattcaattggcaaataataattgtatacatttgtgatgtacaaatttgtgatgtacaaataaatttgtgatgtataaatatattgaattgatgttttgatatgtttaaaatgtgaaatgattaaaccagataaaataattaacacattttatcaccacacatacttattttttgtggtggaaatatttaaaagctatccttttaacaattttgaaatagatattattatttaactcatcattctgtgcaatagatcactaaagcttattcctcctgtctaactgaaactttataccctttggtcaacttctcccctttctttccccgatcacccttctcctctacctctgataatcactattctactctctacttctatgagtctaactttttttttttttttttgagacagtgtcttcctccgttgcccaagctggagtgcagtggtgcgatctcggctcactgcaacctccacctcctgggttcaatctattcttttgcctcagcctcctgagtagctgggattagaggtgcaccaccacacctggctaatttttgtatttttagtagagacagggtttcaccatattggccaggctggtctcaaactcctgacctcgtgatccacccacttcggcctcccaaagtgctggaattacaggtgtgagccaccgcacctggccgagtctaactttttaagattccgcttataagtgagacatgtggtatttgttcttctgtgcctggcttatttcatttagcacaatgtcttccaggttcatccatgttgttgcaaatgaaagatttccctcccttttaaggctgaatagtattctgttatgtatgtctatttagctgaagctggacacctacgttgctcccttatcttagctattgtgaacaatgctgcaatctacatgtactgcaggtatccttttaacatgctaatttcaattcatttggatatatccccagaagtgagattgctggatcatatggtggttctaattttagtttttgaggaccctcctccatattattttccaaaatggctgtattaatttacattcccaccactggtgcacaaggattcctcttactccatacgtttgcaaacacttgttatcttttttcttttttaaaatttaaaattttactttttttttttttttagagatgggggtctcactatgttgcctagggtggactcaaattcctggactcaggcaatcctcctgcctcaccctcctcctcctgtgtagccgggactacaggtgcttgctaccacatctggctttgtctttttttgataacagccattctaacaggtgtgaggtgaaacctcactgtggttttaatttgcattaccctgattattagtgacaatgagcatttttcatgcatctgttagctataccttaggcttcttttgagaaatgtctattaagtcatttccccatttttgattgggttatttgttttcttgctattgagttgtttaagttccatacatattttggatattagtcctttatcagatgtatggtttgcaaatattttcttctaatccatgggttatttcttcaatctgttgtttcctttgctgtgaagaagctgtttagttgggtagaatcctgtatgtctatttttacttttgttgcctgtgattttgggaaggtatccaataaatctttgcccaaaccaatgttgtggagcgtttctttcattttcgtctagtagtttcacagtttcaagtcttacagttaagtttccaatcattttaagttggttttgttatggggtgagataagggtccaatttcattcttctgctttggatatccagttttcccaacaccattgattgaagagattgtcctttatccattgcatgtttttgatacctttgtcaaaaatcaattaactgtaaatatgtggatttatttctgggttctctagcttgttccattggtctatgtgtctgtctttatgtcaacagcatgttgttttgattaccatagctttgtaatagaccctgaggtcaggtagtgtgaggccttcagtctggttctttatgctcaaagttgatttggctatttgatgtcttttgtggttccatgcaaattttgggatttttttttcctacttctgtgaaaaatgacattggaattttgatagtaagagcattgaattctacagcattataggaaacaataaatttgtgttattttaagctactatatttgtggtaatttttatggtagccatggaaagctaatgcatctttgaggatgaagtaatttgaagtatggggtactattttaaaggtaatcgataagggtgatttggataactgcataagactgaatccccagacagttcacaaatatgtctgtgaagtggggtcaggaaaagtaagggtggcaatatgaataagagcaagaggctttaaagcccatgttcctgtgtttgaatcgtggccctattacttgttataatagctgtgaaatgttaggtacatttaaaaaactcctatatgcttcagtttccactttatttttaaatttttttaatttttaatttttgtgggtacatgatatatatatttatggggtccatgagatgttttgatacagacatgcaatgtgtcataatcacatcatggaaagtggggtatgcatcctcttaagtatttatcctttgtgttacaaacaatccagttgtactcatttagttatttttaagggtatagctaaattattattgactatagtcaccctgttgtgctgtcaaatactaggccttatgcattcattgtgtttttgtacccgttaaccatccccacctccctccccactcctccactatccttcccagcctctggtaaccatccttctaccctctatctccatgggctcaattgctttgatttttagttcccacaaataagtgagaatatgtgatgtttgtctttctgtgcttggcttatttcactgaaaataatgatctccatgttattgcaaattactgaattttttttttttttctgagacagagtcttgatctgccatcaaggctggagtgcagtggcatgaacctggctcactgcaacctccagctcctgtgttcaaatgattcttgtgcctcagactccaaagtagctgggattataggcgtgtgtcaccagctctggctaatttttttttttcttttttttgtatttttactagagatggggttttgccatgttggccaggctggtctcaaactcctggtctcaagtgatccagccgctttggcctcccaaaatattgggattacaggtgtgagccaccgtgcctggcatgaatctcattctcttttattgctgaatagtactccattgtgtacaagtaccacattttctttatccattcatctgttgatggacacttaggttgcttctaaatcttggctaatgtgaacagagctgcagcaaacatgggagtgcagatatctgcagtgggaacctccaaactgttctccatagtggttgtactaattagtttactctttaaaacaagattaaacatagtacctaatctgcataaggctattgtaaagattaagtaatttaatatatatgaggcacttaaaagagttcttggcacacactaattgtttaataagtgttagtcagctttatgattatttctgtccggtgttctgcttggaaactctgggttccttgcattcgattttattggagtcatcccctggaacttggttttcttagtgactaggcggatagttttcgtaataattccctggattagatcatcaggatcatgcatgtggtaatgctagaagaaggtagagaagggttttaaaggtaggcaaaataaagaaaatggggggtctttagagtgggaggaaaaagagatttggtgaggctactgtcaaatgccagcaactttgtaaatttaataagatacaggctggttttgactggaatgaattctccaccctagatctagccatggaggtcagggacacgattttggtcttgacttcctcagaatgttgatatctccagagatattcctctttcttcttatttttattttttgagaatctgggtgaaatattatatacatggagtcacaataaaaaactgaggtgcttcaagctgaataaatataacactctgatatggtttgactgtgtccccacccaaatctcaacttgagttgtatctcccagaattcccgtgttgtggaagggacccagggggaggtaattgaatcatggtggctggtctttcctgtgctgttcttgtgatagtgaataagtctcacgagatctgatgggtttatcaggggtttctgcttgtgtttattcctcatttttctcttgctgagaccatgtaagacgtgcctttcagtctgggcatggtggctcacatctgtaatcccagctacttgggaggctgaggtaggagaatcgcttgaacccaggaggcagaggttgcagtgagctgagatcgcaccacggcactgtagcctgggtgacagagagagactctgtattaaaaaaacaaaaaacaaacaaaaaatagtggctttcccctccagccatgattctgtggccatgtggaactgtaagtccaattaagtctctttttgttcccggttttgggtacatttttatcggcagcgtgaaaatgaactaatacaactctttctcaaaaaaagtgggtatagcacgaataaaacccgaattcatattctctgttaacatttctagcatattattgtgcagcaataatttttttacattttagaaaatgtaatgtgtatccttcaatattatcaaatatagaagttaggggaaaagactattgatttttactttaagagagtttacaattaaaagtaagcataagagaaaatttcctgcacagtacttgcattaaatcttttttccacttgtattcactatttaccattgccaggtgctttataacttttaccatctcagataaaaaaacatattatttctaatttcagagtagaaattgcatttcatttgataaacaataagataatatcagacaagtattttgattttacttggtttttgcttgactggttaaattttataaaaacctgagatgcttaaagtctaatagttcaaattagcttcaaacttttctcagaagcaactgtagtaagaattagcaagtgtgacaatcccatttagtccttaaaaatcaaattaattaaaatgtaattaagagctaatgtaagtctctttgactgaagtcaccataaaatccatgaatgacatgacttggatgtattttatttgtacctgaaatggtcactacagttttatctcaatgtgtgtgtattgcaagtgccatcttggcaggcacaaatacaaatttcatgttcacttaaatcgaactctactatatctcatgccagaaataacatagtttgtataataaatgctttttactaaaaatactagtctgtggtggtgaaaccataggaaatttaatgaagatggagttttttttttttttttttttttttttttgacggagtctcgctctgtcacccaggctggagtgcagtggcgcgatcttggctcactgcaagctccgcctcttgggttcacaccattctcctgcctcagcctcctgagtagctgggactacaggcgcccgccaccacgcccagctaatttttttatttttagtagagacggggtttcaccgaattagccaggatggtctcgatctcctgaccttgtgatccacctgccttggcctcccaaagtgctgggattacaggcatgagccaccgcacctggcccgaagatggagatttaattaagatggatggaactgagaaatggaattgagtaatatggctgagcaaataattctggccaagtcgtatacttttaaagatgattgaatgagcataatattggaagtctttagtaagacctcagaaatctgaataggaacatatttctttcaaaatacttgcacaattttactatggaccaatgtggcaaatcaattaggagaattggtataagtctatattatcaaggatgagagaaaaatgagttagcaaaaagagtgtaaatgtttaactaaggaataatgcgttgtcattaccacaaaagagatctttaagagttctaaaagtacaaatgtaaagtggctttacatttggaatggataacagagaagaaggatgtggacaaaatgactcgtccttgtctgtctatagacttctgtctcaactacatcatcctagaccaagtcaccatatttcctgcctggactactacacattagcctcctaattggtctctgcttccactctcagtctgcaataatctattctcacagcagccagagcaatctttttaataaatccaaccatgtctctcctgtgcttaaaaacctttagtggcttccggtgcaataaaatctaacttccctcagtggctcacaaagctctctgtgacctggtccccagctatcctattgaccccatagccaccaccactgttcttctgactcactattctctaactactctggctttctttctgttcctcaaacatgcctgtcatagagctactgcattggctatttctttctcgttttagtctcttttcctggcttcttgtgattcagtctcatctgcaatgttacctcctttgagagatcttccctgatcacacagtcaagttgctaccaagcagttctctatttaaaccccctatttttactctgcaaagtactggtcccaataggatatttttatttacttgtttatttgtttattaactatctcctgcaaccagaatgtaggcatgagggcaaaaactttgcattattcatgccatttttgcagctcattaaacagtgcctcgcttgtaacagtgtcaaataaataatgtgcaataaatgtatttcttttttcttttttcttttttttttttttttgagatagagtctcgctctgtcacccaggctggagtgcagtgacgcgatctcggcttactgccagctccacctcccaggttcacgccattctcctgcctcagcctcctgagtagctgggactacaggcgcccgccaccacgcccggctaattttttgtatttttagtagagacgaggtttcaccatgttagccaggatggtcttgatctcccgatctcgtgatccacctgcctcggcctcccaaagtgctgggattacaggcgtgagccaccacgcttggctcccaataaatgtattttttaggatagaatgcaattttagataaagatactaaaatatggtacatataataaaaatagcagcctatgaaagatagatagattgttgaattcccaggattgttgtaggacaaatccctatcttttccccccttttctgtgtagcttcttcttttcatttttttttttttgtggtttttttgagacagagtttcactcttgttgctcaggcttgagtgcaatggctcgatctcggcttactgcaatctccatctcctgggttcaagcaattctcctgcctcagcctcccaagtagctggggctacaggagctaatttttgaattttaatagagatgggatttgacgatgttggtcaggctggtctcaaactcctgacctcgtcatccacccacctcggcttcccaaagtgctgggattacaagcatgagacactgctcccagcctgtagcttcttcttttcacaagtgtcacaaacaattaaaagcctcatgttatatccaatatttctgtttgtgcaaatagtaatctgatgttgaatgacctaaaaccactattacccacaatcatttttccaagaatatttgaagttcacttcaaatacacattcacagacatcatagtgtaaaggtatctaacaatatgaactgtcttctccaaaggatagcaaggaaaatttatataactccagaatatctgatgttggcagatgaaaacctgatggagtaaaaaggaaaagaattctatgtttctgtaaatgcagtcatgggaaatccactgaagctattttagcttcatattttcatctaaaaaactatttattgatacttgccttgaaggtttttttctgaggattagggataaaatgtgataagggcatagggcatagtaggaacttctaagatggggtctcttaacattttttcttcaattctcttgataatatacagcaaaacctgatttagtgttctttgttacaaagtggaatttagaaaaaggcaggagaatcttagacacattttatttctactttacaactttttcaaaactcttaaagttttatttttcattgacaagtaataattttatatatttatggattataatgcgatatttcaatgcatgtatacattgtggaatgatcaaatcaggctaccaaagttgttaccacaaatacttattgtttctttgtggtgagaatatttacagtccattctctcagctattttgaaatatgcaatgtagtattattaactatagttaccaagttgtataatagatcatcttaacttattccccttctacctaactgaaacttgtaacctttagctaagaccttttcccttttctctgtctaccctcctcccccagcctcccagcctctggaaaccacattctactctctacttctatgaattaaagtttttcagattccacacataggtgagatcatgtggtatttgtctgcccatgcttggcttatttcacttagcatgatgttctctaggcccatccacgctgacaaaaatgacatttcctgctttttaaaggctaaatattaaatggtatacatctgtgtgtgtgtgtgtgtgtgtgtgtgtgtgtgtgtgtgtgtgtgtaggtagatatagatatctatcacatacttaccacatttaaaaaatgtattcatcccttgatagcacttcagttgttttcatatcttagctgttgtaataatgctgtattgaacatgggagtgtaaacatctctttgacatattgatttcaattcctttgaatatctccccagaagcagaattgctggatcatatggaattctatgaacttttttgaggaacctccatattgtctgtcaaattggctgtagcaatttatattcccaccaacggtgtacaagggttcccttttcttcacatcctcactagcacttgttatctttcctctttttgataatagccaaattaaaaggtatgaggtgatatctcattgtggttttaatttgcatttctctgatgattagagatgttgagcattttttcatatagctgttggccatttgtatgttagacacactttaaaggagcatccgcagagaacttcagaatctcttacagcatagacagtggcaggtctcagcttcattcttttcagtggggcacttttccaataaattgtatctcagtattctaaaggagatctttccagggtcagcactataaggttgtgcagttaatacactgtgtaaaggcaactggccaacagggtgagtgaggcctggaatccagcccacactcttctccttaggatctgggtttgcacagaggctgcattttcttaatttgtataaaagcatcctagagcctgtacttgcccctttcaaagtatatcattttccaaattatcttatatttgtggagaatatagctgaatggcacataaactatcttgcttatatacttttagatcactgtcttttgtttgattgattttgtttggattatttaaatctaatgattttgtttcagctaagaaaatatattttagaacatatctaaaatatattttaagtatattcatatatacatatatgtgtgtgtgtatatatatatatatactccttgtatagaataagtcacttctcacctatgacatgtggttttgttgtgtttgttgctgctgctgctgttgctgctgctgaattagcaattgctgctgctgccgacgcctggctgttcgtagcttttcaaagcgagcctccatttcttccagaacttttggggtgtatcgcaccaccagcttgacgctgtctttagcagccttgagtagttccacagctttctcatggtgttctccttccacactctgaaaatacaatgacacttcttaaagggaggaggttcaatgttcttttccctggagacaaatctgaaattaatatcacattaagaacccaaaatttaaaattttaagaaaacatggcaaatgagttatcttaccatcatcgttattatttattacattgtggttaaactataagcaggttaggctgcactaggtcacagaatggactgtgtggggattcaggtcataagggtgaaaagcaatgaagacctaaattataatgctaacattaggaatgaaatttccaaattttatctggaagagtaaatgcactagtcaacaaaattttgaaaaaaattaaaacatagtaacaaagagaaaatttctgtatcagatattaaaatttattaagaatctacaatgattaaagtggtgtcttattgtgtgtataaaagagatagtagaacatagcacagagtccagaaggagagtcatcacatggaaagctttatttattattaatgtggactttagaccaaaggagaaaaggactattaactaaattaaataatacaaaataatggagactcaatctcatacactatgctaaatataacagattaattaaaatttaaatgtaacataaaaacataaagtaactaaaataaaagaaaggtgaacattaatcatttttcaatagaaaaggaattcttaatttaaaatgccacaggaaaaataaccacgaaatcagatgtgcacagtgtaagtttctatgtctcaaacactgtaaaaaaaaaaaaaaaaaaaaaaaaaggcaaaccagaaaaacagtttcagtatgtgactgtcatatacttagtgcaaaagggttttttttctggtttatttgcccttttttgtttttttgagacagagtttcactcttgttggccaggctggtgtgcagtggcctgatctgggctcaccaccacctccgcctcctgggttcaagagattctcctgcctcagcctctcgagtagctgggattaaaggtgtgcaacaccacgcccggctaattttatatttttagtagagatggcgtttcactatgttggccaggctggtcttgaactcctgacctcaagcgatccacctccctcagcctctcaagctgctgggagtacaggcatgagccaccacacccagcctgcccttcattcttctaacaagtcaataaagatctaagcagaatgagcagttgacatgcatggacaaaaaataaaaaatataaatggacaatagacctcagaaaagatattcaaactccctagtaatcaaagaagtatagaccgacataaaaataaatatacagatatatttttttttgagacggagtcttgctctgttgcccaggctagagtgcaatggcgcgatcttggctcactgcaagctccgcctcccgggttcatgccattctcctgcctcagcctcccgagtagctgggactacaggtgcctgccaccacgcccagctaatttttttctatttttagtaaagacagggtttcaccatgttagccaggatggtcttgatctcctgaccttgtgatccgcccacctcggcctcccaaagtgctgggattacaggcgtaagccaccgtgcctggtcaatatttcatttttaacttaaaaatgataaatatatattttaaaatttggtgtacagacaaggatgtaggaaaattggactcagactgctaataacttaacaaaaactggtgaaatttttctggagggcactatcgttatgcattgaataagcccttattataagtgaataattttatattaagaaaaatctattcaggatacaatcaaataggcacacatacttataagatagatacagaaaacaaaaaacaaatcaattcttggcttttgagtttcaaaacagtcttttgaacatcatggcgtagacaatacttggagaaactatgcttcctctaagtaaacacaatgctgcttttttcccaatcttctgaagattctccaggttaggatgatggagaagcaaaaagaagaaagttgtaattagactttataggaccctacataaggaaaccctggctcctgcccctctgagcggatcaccagggcagatgacagaacccttaatttacaggattgaactgccaaggcctttttgccttgcttcttgggtaaagtacagagaaaaaaaatcactgtgcagtgtgatagatggagactgagataaggttaaagagtgtcagacgacctaggagtcacactgaagaggcagagaaggccaccctcaattgtttgacattacattttcacaatccaagcagaagggaaactcaaaaagatactaaattgagttacagaaaaataaaggaagtgaaatcttaagcacccttgaattataccttcagattcataatttctactgcagatttggagacttaagggatcatttgatcattggcttagccactcaactaatatgtttattaagcatttattttatgaattatagtctactacgtttcttgagaaaacatgaaaggaaggtaaactttgacagcatcgtgcaatataaaccctattttcagtatgtttgtaatttctttataactggtcccatgatgatttgttaatgcatataattttcctttgaaaggaaaacttggtgatttggttgtctacatacccttctctaatttcttttttaatattaaaacttacatgtttatgttttaataatggttcacccagtttctaggccagatcatcagtctgtagacttcttcgtggcttttgttctatttgcttttatttaatagggttggagattctaggccagacctttagaggcccattatctctgttttggcactgtgtctgcgattcagttgccacaggagggctgtggtactaatgtgtgtgggccattaggctctcacggtggtggtgaagagttgagagaaaaacggctggctggtgcaccacacaccaggccctgcaaaaccatcaaggttatcctcttccagtccctgctctgccctctcccacacagttaacaatgtatcaaaagcagactccacagttttcaattccagaaattttgccttcatgctttatcttcagtttagacaaggactcagattctctttaaggctcaacagagtcaacaggtctgttggtttggctctactgtctttcccaccaggacacagagccactatgagagatctgggcagtgtcacagttcctcatttgtactactgaaatgctttactaacatcctacaaattatataattaagcagctaagaagtgaattttagaaagatattaagaaatataagcatacttgaaaaatttttatttcaaacactcctcaactttgctttttaattgttttcagaagcatatcttgtcttaaggattatttttgtggcctttttttccccactagctttgcctactttgtaaatacttttgagtacatatgcttgtctccttaacctattatttatctctggagtgcttttagtccatcagtataactttgtaataagaataaggcagttttctcttcttctttctttcccttttaaggtaagaacaagaaatcaaaccatcttgccacagaagtcttgttgcatgaataaaaagaagccaaaagatctactcagttagggtataaatgttgatgtgcaagcccttcacaggtattccttgagccctgaaagttcagcatctattcttgcttttgacttagtctgtgtctcactcttaatgaaagtatgcatcatttctagctaaatatttaagacatattttgaaatgtgataggttatttataaacagttaagctatttttatcaaagctgtatatacaagcactcctgattcagagttgtcttttataagaaccagtgtaagtttgagcaatcactgaaaacttgtagcaccagcttcctacataggctgagaaggtggttcttatatgactttaagagctctaaaaagacttcttattttacagtgaaaccccctcctccatttaaaagctgaaattctatatttttaagttttatccccttgctttaagagttttgttgtacctattgcattagcataaattaatttaacaaggccttgcaatggacgtctggtaaaattggattttattaagaaggtgaggagtgatgagaacagcctgagggtatatagtaggtacccaggaaatattttgaccaaagagaagtatagcctaaaacagaaaaacccctaaaaagaaatgttacctaccccaaaattatgcctaggctggccatgagcatacttgaaatgaattaaaatgcactatgaagactgtacattcccatcctgaaaatgcttctatctttagctgataaatcttttaacaataaacataaagattaatatgaggtcaagcacagtggctcttgcctgtaatcccagccatttgggaggctgaggcaggaaggaagattgcctgagcctaggagttcaagaccaatctgagcaacatggcaagaccccatctctacaaagaatttttattttttaaatagctggggcgagtggcatgtgtctgtggtcccaactacttgggatgctgaaccaagagaatggcttgaacccaggaggtcggggctgtggggagccatgtttgtgtcactgcactctagcctaggcaacagagcaagactctgtctcaaaaaaaaaaagtgtatatatacacactcacacacacacactattatatacattagttattatatacaatagttatatatatatatggagccttcaaaaagttgtattacaataaacacaagctaataaaatactaaactgatataaaaaccatacaaactggatctcctataacattgatgtacaaagaaatatattttcatttaggaagctgggaaaaaaatagctcagtagataaccaaaggcatacttgtttcatcagcaacctcatacagcagtaagctctaggcagctttcaagttagttaatttgattgaagtttagcaaatcaatggctggtaaatgaaccaaggttttctttgcttcgttttgttttgagatgaagtcttactctgtcacccaggcaggagtgcaatggcacgatcttggcttactgcaacctccatctcccaggtccaagcgactcttgtgcctcagcctcccgagtagctgggactataggtgcctgccaccatgcccagctactttttgtatttttagtaaagacagggtttgccacattggccaggctgatctcgaactcctgggctcaagtgatgcgcctgcttcagcctcgcaaagtgctgggtttacaggaatgagccaccgtgcccagactcaaccaagttttaaacatggctgcattctgttcattcaatagttttactatttgtatacactgtgagatattaaaatggcagcttatttctggtatgctcgtatttctggtatgctcaacttcctggttgattaaggatcatcccttataagagagaatttgaattgcactacatacatgaatttgctcatgacatgtgctctctctctcccgcttccatagagggttaaattttgaccctggctagatctcagatggaagcaatgcctgccctgggaagcaatcatgtgatctgtgcactatcagtcatcaactggctaagtttttaggcaggtttttctctgtgggaattacatagatatcatcttgatccagttttctgatgtgtaagttacttaaacactttgttggacaacaagagttggctagaccttgtagttattcaaggcatatctacagccaggtttatgcatagactcctaaaaaacatcagtcattcctttagattaaaggccaaatgatgttatcatcatttggagtaaaggacatcaagggtattaggtaattataccttagtgaattagatagctcagaaacacagaacattatacctaaaaagacctttagaaataatctcatttatgtccttatatcttaatacttaaggaaacagacaccaagactggctatgacttactccattttataagtccgttagttgtaggtctggattagaactcatttttcttgatgactgctctttcaacaaccgtatgctaattttctagcttaactaatcccgaaatgaaatacatggagtgtcatttttgtgtgatgcaaaaggataggaactaatggcaagaaaaagatctggcaactcctagctcaaaagtgtgagctggagtgaaggaatagcatggggctacctgaaggactcactactactaggattagggggttatgattctcaactttgaaaaggcccagtataaccaagcaaagacctattcctttcccaaaaagataacagtgattatttttttcttatgatagttttacttttgttccatgaagttcttttgtttgtttgtttgtttgttttctttttgagatggagtctcgctctgtcccccaggctggagtgcagtggccggatcttggctcactgcaagctccgcctccccatgaagttctttcactatcattttattttaagagtgtgtgtgttcatacatataaatgtgtgtaaacatgcatgtgtgtatatgtatactgtagtttttattgaccatttattaagtaaaaggctgttttctgtgcattttatctaatccttgcaacatatctgttaaaaaggtaatgaaaaggttaagaaatgtgtcctaggtcaccagctagtaagtcgaacagatcaacctgaaatgagctttatctgtttctagagtcgaggctcttacctaccaatccttaatcttaaataaaataataaagaaaaagtaagtatcacattggcagttttgcttactgatagagatgtttaggccagtcattcttaaaccttgatgtacatagtagtcaactgaagaactttttaaatatagagacctaggctcttcccagccttgccatattaagatctgtagcaatatgacctaggaatatataaatacaaaactctgatccagccagtcagtctctgacatgtagatttgtgtttggacacactactctaaacccaaatagaactaaccaaaatagtaaaagtcatcttaagggtttctctacaaccttactacagaaaaaagtgttggttagatgagggaaatcttatgattttgccttgatttagctctatagttggcatttttgatcattaaagaaaaacaatgttgattgggtatttaattaagaaagaaatatcttttaataagctacaggatatacaataatgcctccttatgcacagtttcagttacccagggtcaatcaaggtccaaaaataggtgagtacagcacaatgggatattttgagagagagaatgagacatcacattcacataactttgattgcagtacattgttataattgttctattattgttgttaatctcttactgtgcctcatttataaattaaaccatcctaaatatgtatgcacagtaaaggaaaaaatgtagtatacattattcagaaaagaattttatgatgtttcatctttcccttttttcaaatgtgttaattttcctgttctaaatgtagtcttttttgattaagaaaagtggaaaatgtattaaaagtatcacatttatctcttggaaaaatatgctaatgatctcccatagtactttgttcttgctttatgctaatatctatcacaagtgcactataatttatcagttcaccatcattctgttgccaccagactgtccaagagcaggatgagtctaatttatttatgtgtgtgtccagcatttattatgaactcaataaatagtcaatgaatataacatcaatataaaatataaagtcttataggctaaggaaccagtattgcctgggtttgaatctgagcttcttccctcaccagctctgtgaacacagacaagctgcttaatatttcaaagcttcactttccttgtctgtaaattgggcatcatagtgtacttagtttataggattattatgagcattaaatttaacatacataaagcacttggaacagtgcctaggatttacaaagcgtccaacaaacattagttctttgttgaactattttcttgttaatggcgttgcttagggctttagatgtttacagacaacaacagcaacaaaatatgattttgcctttggtgtaagtagaagttttctttatattatttgggaagtaaaagtttaccaagtaaattaatagtgtatggggcttgttagaagaatgtttaaaactatctaggtgaatccactgctgttaatcatcctcaagtaatttagtggcatcatttccattcatacaattgatatgctaattacaaatgatcattagttattcattaaaactgttcctctcagtccctcaacaatgtcgcgctctgttaggtaaagaaggaacgtgcaggagatttacctgataggagcatgcataatgtgagggaacttgagaggggaaaatcatcaaataactaaacaccacaaaagagcaaggaggttaatggaaaaaaaagtgtatataattatacatattcttatcctgtgagagcagttagaaatagaagaatttttggaccatgaaagtggagaatgcagagcattatcagtaagcctgggggcagaaaactgaaaacgagcaaaaaagctttagaaaaagatcagtgccttctagcaatcagatattcacaaatctaacatttggttgacctcagcccacctttcagatctggagactaaaactggaaacaaatgcagctactacatcctggtggtaatgctttatagtaactgcttgatccttgatgtctgcaccaaaaggggggaaaagtcctgatggttgttggaatgaagattaaatacacacacacacacacacacacacacacccatcttcaggagtacaaacatgagctttagaggtctgaaaacagaacaaagctgcctgggaaaatattcctcgaaaatgatacctttaaatcagtctactaattcttgagtggtgggtttcacccaggaagcagggataatagagaacacttaccaactgtgattcacactggtttatctctgagatgcaggctgtgcacccccatgctctcccaacccatgacactctgtgacactacacccccaatgagcaaaggcttagaaatgtacatactcctaagcagagtgttgtgaccgccagttctcattgtttgcctccaggtctgcattaggatagggaaagggttatggaagtggtgatcaccaccatcccctacatatccgccaagaactacctcccccatactcaccccattacagttccacttacaaaatgcaaatacatcttagccactaaaattcactgtgacttcttaaaccaccaaagccttagcagagccagggtgccagggcagaaaggccagggattggggtcaggaggatctggatttgaatcttagacaagttgcttatattaacagtgtgacctctcccctctcagctagggactgttccagttttagcactgaaagtcccaggaaatgcatcaggcctgggcaaactaagataataagtcacccaagacacaagatgttgcacatgtgcacagtgcatagtagtgcctggtaaattttccttttttttttaattaaaaatactttattgttaacaatgctaatgatcatctgagccttcagtaaatcataatctttttgcggatggagggttttgtctttatatggatggctgttgactgatcacagtagtggttgctaaagattggggtggctgtggtaatttcttaaaataagacaacaatgcaaatacatgtgattgcagctgcagccagtctggagtggacactgcgaagacaccagctacagtgggggaggtgctgcagggctgtgggctttagggagccagtgggagccagcaacaggcggaaaccccaccccttccaaattggaggggcgagagccccaccctcttgggctcagctgcagttgcccagctgcaggtgcagacccaggcatctctgcattctcagggacccatgaaacccctctccccttgcaggctcagaagtgcctgctcctgttgcctggcctctcccagctgcctgtgcctgctcagatttcacagcaaagttgatactaagtgcaggcactgttgcaaccaggccagacgtgtgtgcactcaggggagcactgacaagccaaccccctgacacctcagccctctgtggactttgggcactaacgagcccaaagtattagtccgttttcacactgctaataaagagacacttgagactgggtagtttataaaggaaagaggtttaattgactcacagttccacatagctggggaggcctcacaatcatggcagaaagcaagaaggcgcaaagctacatggcagcaggcaaagagaatgagagccaagtgaaatgggaaactgcttataaaaccatcagatcttgtgagacttattcactaccacaagaacaatatgggggcgctgtgtgcagtggctcgtgtctgtaatcctagcactttgggaggctgaggtgggtggatcacctgaggtcaggagtttgcgaccagactggccaacatggtgaaaccccatttctactaaaaatacaaaaattagctgggtgtgatggcaggcgcctggaattccagctactcaggaggctgaggcaggagaattgcttgaacccagggggtggaggttgcagtgagccaagatcgcaccacttcactccagcctgggtgaaagagtgaaactctatcacacaagcacacaaaatataaataaaaataaaaggggtaactgccccagtgatttaattatctcccactgggacccttccacaacacatgggcattatgggagctacaattcaagatgagatttgggtggggacacagtcaaaccatatcaggaaggaaagccgagggggcctaagggtggctcggcacaggactgtaggtgtctctcagcacaaagagccagggtgccatgggcatcaaggatggcaggttaatggtggcaggaggcaggcagactcctgggtggaaaggggtggattgctggtgaagccccaccttcaagccagggacagcctgaagcccaggggctgggctgcctgttcaacggaccagagtgagaacttatggtgctttctcttggtctgcctatggaccaatcagcatgcacctactcccctctgaagcccatacaaaccccagattcagccagactcatgcagatgatgggtcgaccagtctgcagagaggagctacccactgtgggtctcttctgagctgttctgttgctcaataaagcacctcttcgctttgctcactctccacttgtctacctacctcattcttcctggacataggacaagaacttgggacctgccaaatggcagggctgaaagacctgtaacacaaacagggctcaaacatgccccttgctcataacgttgtgggtgatgagaaggagagaggagctacggccttttggggagcccagacctaagagctccccgagccagggttgtgacaccctctttggggctttgcagttcctggctactccaagcttccaggcaccactgcagtccctggtgccaggcatggaagctgtttgtggtacacctggtccagccacagccttctagggagccagcccctgtgccagcacctagagctgcccaccctgccacagccagcatgcctggctctgtgcagtggctggactccatgctcacttgctcacacactcctcaccactctgcatctgacttgcccctggtaggcacaggatccaggcgagtagcagaagctgagcacaacttgccaggctgaatgtgtggaacaagcccagcaggcccaagcaaaatttgggcaaaggcgtcactggacacagaggcttccagccagaaatgtgacaccccaaggattctgtgacacatggaaattaaataatctgcttctgaacgattgttgggtcaacaatgaaatcaagatggaaatttacaaatctttgaactgaataataatagtgacacaacctatcaaaacctctgggatacagcaaaagtggagctaagaagaaacttcatagcattaaatgcctacatcaaaaagtctgaaagagcacaaatagacaatctaaggtcagacctcacaaaactagagaaacaagaacaatccaaacccaaacccagcagaagaaaagaaataactaagatcagggcagaactaaatgaaatgaaacaaaaaatacaaaagataaatgaaacaagaagctgattatttgaaaagacaaataaaattgatagtcaattaatgagattaaccaaaaagagagaaaatccaaataagcttaattagaaatgaaacaggggatattacaactgataccacagaaatacaaaagattattcaaggctactgtgaacacctttatacacatagactagaaaacctagaggagatggataaattcctggaaatgtacaactttcctagattaaaccaggaaaatatagaatctctgaacagactaataacaagcagtaagacagaaatggtaataaaaaacattgccaacaaaaaaaaaagtccaggaccagatggattcacagctgaattctatcagacattcaaagaagaattggtaccaatcttattaacactattccacaagataaagaggaaatcctccctaaatcattctatgaagccagtatcaccttaataccaaaaccaggaaaggacataacaaaaaattaaaactacagaccaatatccttgatgaacatagatgcagaaatccttaacaaaatactagctaaccaaatccaacaacatatcaaaaagataatccaccatgatcaggtgggtttcttatcagggatgcagggatggtttaacatacataagtcaataaatgtgctacaccacataaacagaattaaaaacgaaaatcacatgatcatctcaatagatgcagaaaaagcttttgacaaaatccagcatcctttatgattaaaaccctcagcaaaatcggcatagaagggacataccttaaggtaataaaaaccattgacaacaaaccaccagccaacattatactgaatggggaaaagtagaaagcatttcctctgagaactgcaacaagacaaggatgcccactttcagcacttctattcaacatagtactggaagtcctcgccagagcaatcaaacgagaaagaaagggcatccaaatcagtcaagaggagctcaaactgctgcgatttgctgataatatgattgtatacctagaaaccctaaatgttatttctttataaattttttttaaaaatcaatagccaggaagggaaggggttttatcagagaatgcgtcattgccagcatgaagaaggggaaaggaaggagagatctgagtgataagaaaagtttgaaacagttaggttcgagggcagttaagtcatttttgcccactctgcaattctgccaagaccctaagggcagacctagtgccatggggcattatctccttctgccactgcagaatcccagggatgatacagcctggtttaaaatgtgaaactagcttagaaagagtacccataatcagatgaagactttaaaatgtttatgaagcagtgttgtgtactgggatactgattgagatccctcagaataagtaacaaggcccacacttcaaatcgttttccctgacttttatgacaggtgggctgttacagtgatggaaacagggctgaagctagggggttctataaaagatttgcaacctagaaaaaggcttagcctataggaagtttttgagaaatcttatttccctaagcaaggaatacatcatcctatctcctcttccaagatgacagcaagtatcatgggcaatgacatctcctagaattccgtcaatcagaatagatttttttttttctgtaagtatcttactctagtgagctcacagagatcatagtttttcaagtggtgtcatagagacaacaatagattgctgaaattattcaaccaaacccttcaaaagatatactttaaatatctagcctgttttataatcctagaagcccaggcaatttaatataaaacatcagggggaaatacagcaaatctgggcagaagttgtctgagcctggcactgtcaaatgtgtttcctataaagtgtaaaatggcatggacatttatgttgatgtgtaccatgaataataaaacattaataatagctataacatttaatttaattggagagattcaacattgcagatgctttcttgcaggagaagtcaaaatttaaaggctatttcaggtttattgtccaatatctctgtagctgtgcatataaatgtcttttccaattaaatgtacacccacagaatattctttgcttttgtcaccattgatttatactaagatcttttgcttattttaaatgctctaactggctctaacctccaaagattcttttcaaccctcttctctagttcctgctatcactagtcatgtagccacccaagttggaccctcctggggacatcttccctcaatctacatccaattaaccaccaatactggttgatattaatgcgtcaattaccacaattgcatctcatcctctcctccctcttatttcttatgatttcttgcctggatttcctctcttgtctaaatgcttctacctattccagccagagttactttactcctttttttttagatggagtctttctctgtggctcagcctagagtgcggtggcatggtcttggctcactgcaactttcccctcctgagttcaagctattctcctgcctccgcctcccgagtagctgggactataggcatgtgccaccatgcctggctaatttttgtatttttagtagagatgggatttcaccgtgttggccaggttggtctcgagctcctgacctcaagtgatcctactgtctcagtctcccaaagtgctgggattacaggcgtgagccaccacccctggctgagttgcttggtttttgcatgcccttgcttaaaatctattgatgagtagaaagaacacaactatgataggcactgtccttgagggcagggaccttgctacattgatggtttatccctgatacctagcacagtgcacagtactcatccagtgtttgtttagctaatctgaagagggctgactttaaagcttaggtcaaagattactgctgtaagaaggttatttcatttccctgagcctctcagttcccatatatgcaaaatggcattaataacatctccttcagggctggcacagtggctcaggtctgtaatcccagcactttgagaggccaaggtgagcagatcacgaggtcaggagattgagaccatcctggctaacacggtgaaaccccatctctactaaaaatacaaaaaattagctgggcgtggtggtgggtgcctgtagtcccagctactcgggaggctgaggcaggagaatggcgtgaacccgggaggcggagcttgcagtgagctgagatcctgccactgcactccaccctgggtgacagagtgagactctgtcacaaacaaacaaacaaacaaacaaaacatttccttcacagaagtcatttaggtttatatggactacccgtgtaaagtgccaagtactaaacctggctcacagaatgtacccaataaatgcattaccccatacatatttttcaattttctagaaatgaaaatgaaaacatcctgtatcatgcaaagcacttcccatgtacaggcaggtccaattatatttcctaatattaatcttcaacatagaagcaacactatgcttttgatttcagcatgtgttttcatgtttctataatctctcagttttattccctcagtgtagaatgtccttcctccactctgttttaataaccccccacccatcattcaaagcccatcccaaacagtacttattctctattatgtcactttcttgctcaaaataaatagcaaacactttatgatggtttacaaggaccttcactcttcactcccagctggcctctataaccttatgtctaatactctccccatcattcatattcaaatcattctggacgttttttttgttcttgcttatacctagttcattcctgccagaattttgtatgactagcttcttcacataaagttctcagctacgagatgctcaactctactatcagttagggagatgcagattaaatctaaaatgagatcaaaatcattcacatgcttaaaaaaagaatgtatccccaaggatttggtgaaatttatatcttcataaaacatagaagtataaattgatataggctttttgagtcaatttggcaatatctattaaaataaagtatatccatatcttcctatcctggcttgcatatattaggatctacctgagaaaaatagttactcatatacataaagattttcattcaagcagtactcaaaatagtgaaacaaaattaaacaaaaaaccatttggttaacaaactaaatgtccatcaacaggggaatagttaaatgcaccatatatagaatattatatagaagatttaaaaaggtctatgtacagatgaggcaaaatctccaagacattattaaccaagaaagcaagtcatagataatacgtatatgtaaaaatagcagtgcatttaagaaaattacatataataataataatagtagcttatattcattgagtatttactatcaggtactgtttcaagggctttaaatgtagcaaaatagtgacttctcataacaacactgcaagttatgtaatgttatcatcccaatttcatatatgaggaaactgagacacagaaaggttaagtaagtttccatggccacaccgttaatgggtaacaaatcattgtctggaggctgacctcttaatcacagccctgcattgtctcatatgtttgtatttaaaaataaataaataagtaaataaatgtggggtgtgtgtgtgtgtggtgtatgtgtgtgcttgaatacaaagagaaacgttcagatgcatgctcactacaatggtgtttctacacgtggagagagagaggggctggaacggattgaggaaaacagttaaagggactctttaaaaaatctgattttagtctttccacactgaattatttaaaaatttgctaagaatgcatttacatatttattgtatatttttaaatacaatagcccagtatcatcccataaggatcatgagaggaaaggtcattctagaacaaaccaaagaaggtgggacaaagcataattttgtttaaatagtactttcaggcagagctttcaagtagtttgggcaaaataagtcccccaaaacaaaagcaaaaatccctacaactataattctataattgcctgggtaactcaggtgaaatgaagggattttagcaaagttacctcaaaatttacagatgtagaagtatagtctgtgggagcttcaaaacctcagtcacaatgtaatgccaatgatattctgtttgaactatcatgactgaatggtttttctcccgacatcgttaatttgctgaaacccaagttttcctttcctatatttcctctcagttgtttatttgtcggggccagcatatcacttatacggcatggcagatcattcatggttcaatatataggctataaatccatgttttcaaggaataatgttcaatggaaaaatcataaggaaggattatgaaatacttcatgtttaaaattttgcttttcatctaatggctcctgagattaaaaacaaacaaacaaacttgcagtgatctcaatcttgatagatgtgagattccacagagagtaatcagttgacctaggaatttttctgaaaatgaaatgagttggctttgtctttcttctttggtacaattactgttgatcttatcccccttccccaaataataatgtgtcataacaaagaaacatcaatattctctacataatagatcataatgagatagatactaatgagatctgtgtttctctcactaaatattaacttacatccacatctggtggccctgcctttaattctggccacttctaaaccactcttcacattgcaatcatagtaatcattccaaaatgcactctcgtgcttaaaataattacatgtgcctgtattgcagatacaggctgaagtctttcagcctagtgtacctcaccctttgtgatctggcccctgtgtatattttcaccctcatttgctaatccatgaaggtccaaacaggagaacatgcaattttttcttgtctctgggcccttccttgtgatgtctctttcaccttcctcactgcctccgttcacctgcttgcttaaatcaatggcttgctgccttgattataaactagcaatgattataagcactaacatttatttagtacttactacatgttcaggaactgtgttatgccatttaaacactaaaatagaaaaactaagtagcttcttatattatcatcttttagcaatgagaaaactaaggttcagataagttagcaaattattcaccaaactccaccaatgacattgaatttgtgccctatagggatttactgagaactaaagggcccagtgcatttagagtgctctgcagacgcttggcttagaagccctggaaggaagtattttccattacttttgttaccaatgttgttactacatttgggggtgcttgctttatttctaaacttaatgtctggggatttaaaaattgccattttaacacaatggcacatataattgagtagaagatatattttttaaaagttgattttttttaattagaaaaaaactaaaaattgaaaatgaaagtgaattactaacactgaactcatttccttctcccctctactccaatccactccagtttcactggtttttcgttgcttctctcgaatgccagtgcccttcaaaccttaaagacttggtgttgacactttcctctgatggtcacaggagaatgatctgaatgttcttccctaggtgtggctcactcccttatctcctttgacctccaccttgaatatcaccccttaactgaggctactctgaccggcaccacactctccctgccatagcatcccctagcctccttacgctgtactgattaattttcttagcacttgccatctctaacactatatggatttccttatttattttgtttattgcttatctgccatactagaatgtgaactccacaaaggtaaggacttttttgtctcttttttttcattaaagaatcctgactgcttcaaattgtacaatgtagatgcctaataaatgcttattgagtgactgagtgaatgactattgaaactggccaagcaatgttatatagccttgtttggctacacaggtgctttagatacaagttcatgtatattttgtcgatttattgccctatctaacatctctcaaactaaggctttggtggagtcactgagcagttaatatattactgaaagcagatgaatgtgcttggatctaggcagagtaacaaaacaaagacagctaaagttaaaagtctgacccaaggtctcacattcctataaataattgataatgcatcaggggaattttaatgaatatatttgatttgttttatttacaaaatagacatactaaaagttgcacataattattaatccttttctagaagagtaaacaaatttattagagaccaagcagactgaaagtgattgggcttctttgtgaaacactgccaatatatgcaaaattatatccaatacaactgaaggaaaatatatttgaagcaattacaaatcctgtcccataacatgatgtgtggtgtgataaccaacatcatacaactttgcattatccctcctgccaatttcatctaataaaacacgactcatgtgaaatggtgtgtgccctaggttcctgtggtaattagctgtgtctaaattgctataacatgggcaatgatatttaaagttgctcttacattgcctaagagtgcatagcaaaataataattatcatgtaatttagattttcaaaatgtaaacagatcatggccacaaaaataaggggaatttcaggatgagtggctgtgcactgtctagcctggtggccagtctcatttcagatccattgtaaaactgagagacagacagcattcaggtaccctgcaggttttggttacagactttactgagtggtcaaatagatattgtgccttctagatttaggcaaaaaagaagagtggtgaggctttggcatatttctgttcatgacatattggcacaatatttctacaaatcactcaaagctaaagctaaggcaattaggagtagtgcatccatttctacttatgaaaaacttaacttggtgtttctaggataattagatcaaagtaagctcccttagggtatgatctacgttttctttaaactgttcctttcccagtgccagacatggtaccatggttaataaatcttattagcagtctgactgaagattttaaagtgatattcttacaataacgtttgcctgtagagacagattcaataccaaatttaataatggcaagctgtcaattgctttgcctttgtcatccatggtaattgggatcaactctggtgctcctccacacagaacattcaattgagatcaagccttggatgaaatctcttttccagaatgctcctcatttattgaatcagaaggagcctggacttaccatttgaaggtggtaggaaatggccaccttcaaatgggaagtctaggctccttatgatggcttatggtagcttccgtgacatggctccaggccatcccttcaactctactctttagctacaaacatgttgatgctatgatttggtagaagtccattctattcatatttatggcatagtgtacaatgtgtgcatttttcagattttaatattgtagctactatatggtttggaactgttttcatgaaaatgaactaatttagtttaagatagtgattctcaaccaaggatgattttgcttgttaggggacagttcaaaaggtctggggacattttttgttgtggtgactggatggggagggtgttactggccaggataaacattctacaatgcacagaatggcctcccccagaaagaattatcccattcaaaatatcagcaatttcaagggtgagaaatcctggttgacaaatgtaattgagtgaaaagtttacataatataatttttaagtgttctacttcgaaatgctgtcagtttgatagagctcagttaattaaatttacatcttggaaaaggcaaaactaaattaaaacctatgcccttgtttatgttcatatggctgagccatagacaacacaacctccaagtactcagctgctcactctcacctgaaccatcttttctgctgtgtcaacaagaggcaagatccttgtcagaaacccaagagttcttggtaactccctattcttcaccttgcatatccagtcaatcaccagttcttgtttatagtcccgttacatccaaagtcattttcaaatcttttcctttctctccaaattgcccctcttccagttaagacctccaccatgtccctccagaacttctaagagtgtcctggttgatcttccacctccggcttttcctccatgccttcacacaccctatgcccacatgttggcaattgccagaataacctataaaaattcatgtcattttggcaatttcctaccactttcaaatgttaagtccgggctccttgtgatggcttatggtgtcttccatgatgtggctcaagcccatcccttcaaccctactctttagctacaaacatgttgtttcttatatgtttctgtagatgttgtccctctgtctagaatgccctccatcaacctattcattctaacattccatagataactactattaatcctttaaaatgcttcttattatatataccatttcctctacaaaggcagaaggtgttgtttgcttgtttttaaattctgaattttcgctacactgtccacagtaccaaatggcaataaccggctagaattgtaatagggcatttctcctctagattgccatctttccctcttgattatctctgctcacttatctaatctccttctggaccctaaaatagtcaaatttaaccactcctacttcctggatagccttttgcaaaaccaaatctagtacaatgtcatgttcccttgactttcagaggtagaagctcagagactgcccagaatcctcaactcttctgatgtcacattttactcgatttttaagtatgtaaggactaccacatatatagtgattagttcagaatgaaaaatctatgttgaaatggtagtgctgggtgataagataggttcaggctgatgctagatcaaatcttgtatactacatatacagattttgacttcaggatctaaagtcttatgctttggttcttattcaaatttatattcttaaagcttaagatatgctatatatttacacagttggtgataataggcacctctgtaaatagaaaacatgacttctcttgagaagtgatttggtgtcactgaagggcaaggtcaataatttacaattcagagtaaggttggctgtgataaaattagcaactaatgattttgtatctatgagagaagagaaagaaacccaagtaggaaaggcctatgatcaaatgtgattcatttgcaaatttattgaaacagcccatacctcctggctgaacttagaaagatgtagttctaataccacaattgctgatactcatttcccatatctgagactcagcaaccaacatttgagttaaagtttggttatctcacatgaacctgtgagcaatcacatgtggcttgtgacatgtcatctgattgccatatgtatcagtgtcttctgtttttgagaatataattaaaaacagaacaagatataaatccattatggaaaattatataaacccttagacttacacttggcttgcatttcactaggtatactcatgtagctgtggcatattaacattccaaccttgctttaggctagtgccaacagtctgtagaccagcataaataagttagaagaatgttcctcccaagttaggattaaatcgaatcattggcttttcactaatgtttaaagcaatcactggtaattgggcttggtgagttccacaaaatataaatgatgcttttttggaccagcacaggatttcaagacaaatattctattcatttgagataaaccacacatttctcagctagaacagaagaaggaccattacttggtttacatattctgtttttgtaaattaaggaaaaatgttgcaataggaaacatggagagatgcatctggaagtttggtgaaaggctgtttaataataatatacagcaacaatgctgtgtaattgtggaagcataagtcttatcttttaatgctgtatttatcatttctcttttttatcctaattactattaggaaaggtagacaggacaggtgttgttacatcagtcctgcagatataaagacaccaaaaattccaatgacttgcccataatcaacccaccaatgacaaggatccaatttcctctgaaattagagtatttaatgggggacttttattgtctcttgaagataaacaaaaagcagaggagatgacttaaactgggcggagagtctaactctatagggagataaaattataagaaagaaaagactattatctgatttaaaagaaaaaatttatagttactgggtatttaaaaggtatccagcgtaatgccagacactcttacatactttctcttatttaatctttggattaaacctgtgagaaagatattgctatttttgctttacgtatgacaaaatagagtctcaaagagtaaataaacgtattatggttagaataaccttaactcctgagaaaccataagaacttgaatttgaatgagtcccttttgaaatgttgaaaatatcaattcacaataaagtaaaagtttgtaattttcattaaatatgatgacagaaaaaaagggaaaattgctcttaagttgttatcatatgcaatatcctagtcaagtgatttaaggatatagaaagaaaatttcaatacaaaaaataataataagctaacagaaaaaaaaagtagaatacatttcatttcataatgaacagcctcaggatgtattagagactcttggcatatcatcagatttcagaattgatttcagattcctaatgcacttagagtaaaatgaaaacttttgggtatcaaccttaaaactccattggttggctcccaatcagttcttcagcctcatcttatcccactatgtatactttagtcactttgttctttcagctgctcctacatggcaaatcatggacttccttatctcaagaccttcacacaagctctttcttatgataacagactcttctccttaatctcagtttaaatgtcacccttcaaagaggccatttctaacactattaaaactagctcctggcatggtggctcaacatctgtaatcccagcactttggaaggccaaggctggtggattgctcgagctcaggagtttgagaccagtttgggcaacatagtgaaagcctgtttctatcaaaaatacaaaaactagccggcatggtggcatgtgcctgtggtcccagccactcaggaggctgaggtgggaggattgcttagtctgggaggcagagtttgcagtgagccaagatcacgccactgcactccagcctgggccacagaatgagaccctgtctcaaaaaataaataaataaatatgtatatatatatattttaaaagtagcttctcttgttccattacatggctccttgttttcttctttcccctctgtaacacttatcacagtgtttaattatgaggccatgttatattctgaagtattaattcgtgttctttgtgaattttccctcccattctgcttccttcagcccacaccttaggagtaaaaaaggactgaaaaatatctgaaggtctttgctgtgcagcagaatgttttggctgcatgttttcacgtacattttttttttttttctcatcaaagaccaggcaagatggggggcggggaaagaaggaagaggagtctgaatggctttattgattggataggcagaagcagaaggagaaaagtctgaaagtgaaaagggaagaaagaacttgcattgtcagaactaggagtagagtggaaaatattcagtgtgtgctgttttgagactagaaaaccaacgtgcccatgctctgtggacaactggttccattccatagccctatacacttgtaagcactctagatttatgatatttacacattgtagaggactggataatttctcaaagatattaatatcaggtcctattccccagaacctgtaaatattaccttttatagaaaaaaaggtcttttcagatacaattaggttaaggatcttgaaatgaggcgattaccctgcattatctcagtgggccctaagaactcacaagtatccttatagagggaggtgggagatttggcgcagagaagaaggtaataacgttaccatggagatagagattggaatgaggtggccacaaatcaaagaatgctgcagtcaccagaagctgaagggagcaaggaacagattccccaatagcacctctagagggagcacagccctgttgatgccttggtttggagctagtgaaactgatttgggatttttggcttccagggctgtgagataatacatttctgttgtttaaaaaccaccgtgtgtggtaatttgttatagcagccataggaaactaatatacacataacggagttaaaaaatcctgttactgtgaccagtgtgaacctgaacaaaatcactgggagcatttcccttaggctgggataactgatggatatgttacatttatatgtatgtatttatcatcatcatcatcctcatcatcatcatcatcatcatcatcatcatgttcttactttctaccagattataaccctttttttttgtttaccactccatatccaggacttagctcagtagctggcacataataatttctctacaaataattgttgaatgaaagaaaagcattgctaaaataacagcacaaatagaaggaaaacacaaacaataaatggtaaaaataactatgagaaagactgcaccagtaactaaactgaatagtcaaatacccattaccagcaatctaaatagagatttaggtcagtctgatcccatgtgtgggaatgcttccctcatttagagacttgccgtttagcaccgactgactgtgagtgtgttctggcactgacacactatcagcacaatctcttgtatgctcaaagctcaagttgatctatgaaggaatgagagacctggtgcccattcttgcaggctgaaatcaccaggtgggaatgtagttgttctaacctgtgaactatagttacctgtgctattgagatagcacgatatttccctgttctgctttttaaattaaaagatctcttattgtgagccaactcagaatgaaggggggtagaatactgccttctcagtgttgcaaaatataccagatcatgctgcattgtttgtgctcttctgaaagtgactgggataaaacaacataaatgtacttctcttggcttcttcacaaatgtgagtgaagtgtcacatgatgtcatgccgagaataaaaattttcagcacttagaactgaaatttcagcttgcactcctatttaattataacctaaacagtcccccactcagcttctgagaaaggtaaagcatctgctaacgacttctaggaatagagagattgtgagaatagctttacttgaggtctcttagctggaattaagctggggatctgtgtgccaggcctataggggaactgaagactgagcttctgtctttcccctcttcatgcaagcatctgctcccctctaagggccaagtggctttagagagtgcttgtggaccagggctgttcagttagccgggaatgcaaagtgcctggtgcaaactggaatgatgcagatatggaacaattcaaacacattcaaaccaaactcttcacacatctgcagtggtgaattagagtactgagccatttgaatcagagtaaattccttttcaaaaccttactatctttagaagtggtttttaactttttaaaggtcaaagtctcttatgagtagttaagaaaaacaactgatctctctccaccaaaaatttacttatgcaaacccataaaggctaagaaaacttgatcttttctacattgtacatgaaagtactaatttattaatggctaagatatttatttaccttaaattatgattaataaggctagactgcctgagttagaatctctagttctgccatttagtagctataggagattgggcaagttgcttgatctctctcttcctcagtttcttcatttgtaaaatgggactgataataataacacctaccactgaggatcattacgggtaaataatgaattcattatgtagagtgcttacagcagtgtctggcattcaacaaatatatagagagctttgactatatacagggactgttctaagaattgggataaggcaatgaatacaaattactgccatcattggaacatgcattttattgtgaaacttaaatcttgcagtgtagttcatagcaattaaaaaaactttttatgttttctctttgttccgacacagataaataagatcttaatacagatttcccctctgggatgctgtagcttcacagagctcgaatctacagttctaatttttatttcatcttcatcccacacctgacagccattctgcataagtaatttgggctgtgagtacttactttcaacttgatataggtatttataaaatgtaaaaaaagccgatggcaggaaaacaatttattctgtcccatccctaaacttttattcactcatctgttatgcttaaaaatcaattagcaatctgtatacactgtatagacaattttatttagttttaactgtaaagctaggtaaattcagctgcaatttcccaccaatggtgctctaagacaatgtttgcatttcagaagcaaatgagggcttcttttcagtatgccatattttttttaagtcctcatgcttatattttatctttctatccttttctttcctgttcctcacctgcctctctcccatcagtaccagtaaaatatcaccttttggactttcttgctttataaaaataaataaataattatagatttaagagaagttgaaaagtaatgtacagggacatcacatgcatcctttacccagctttccccaatattaacatcttacaaaatcatattaaaccagcgaattggaattggtacaattcagagagcttactcagatttcagtgggatttgtttttaacataaccagttattacatttggtaagcatcagttatgattgcagtaaaggttgaaatccactttctcacctgcgtgcacgtgtgcacgtgtgtctttggatgtgagttcatgtgtgcttttgtgtgtatccattgggttgtgtgtgtgacagagggacagagagagagagggaggaaacactcctggccctactctttcatgagactgtgtttctgaggaacaaatgagagaacataatgtaaatactgttaaaaaaaactataaagtactaaataaataaaacatattgtgttagatttctcatctttccattcagaaaaaaatgtcttatgaatagggtacacagagcataggtagagcctactcatctgcctcagagtgtaaggcagcatgtgtgtgttggtcaggggagggttatatggtactctcagcagaatcccattggaagacatagaatcacatagtcacagacttagaagggactttggggccaaccattccaactctgtacatggtactcatattttgaaatactctgatcaggtggtctcctaatctctgattaaaacttcaaatgatgagcaaattctgccttatgatttagtctttctccatttagagagctttaagtgtttaaaagctctttattataataagatgactaccccatgacttttacacactggtcttggttctgccatctggtgccccatacaatggatgatagctgaagacagtcatcattcccctaaatattctcttctccactataaacaattcaagtcattctttaacatgttcctcatatacaaggttgctcttctctgggtgagcttatttttctttgcaaggatggaatgagcacaatagggtgtgagcttaagcccaggaggcagaggttgcagtgagctgagatcataccactgcactccagcctgggcgacagagtgagaccatgagaaagaaagaaagaaaaaagaaaagaaaagaaaagaaatgaaaagaaagagggagggaaggaaggaaggaaggaaggaaggaaggaaggaaggaaggaaggaaggaaggaaggaaggaaggagggaaagaaagtacgaacagcaccctcaagagctggaccaatctctttctgtgttctatacaagatatttatatcagagcccctacaatcacattatgttttgtccccctccctcaacttgctttatattcctcttgaaatcaacattaaaattccctaaaatttttttccccaggctttgatatttagttgttcctccctgattctgcatatatgtagctagtttttttgggcacaggagcaggacttcatgaagattcttattaaaataggcctattgtaccattctattgagactttttatatcctgactctatcactaaatatatttacggttgccgctggctccacattggctgcaacccttataaatagtccttgagttctctcttaaaattgcggagaaaacacttgagcataaaagggtgaaaaggagatcattagaaagctataaattcttactgtaacattttgacctcctattaatgttaaattttaattcagcattcagttgtaaggtttcactgaggattgatataagaagtagccatacaccaaaggcctctgtattttctatggaattgtattaggtggttcaatgtctcatttgtaacattcccatgggaaatttctcttggtgcctagggatagaaaaaattttctctcccaatgattgctgagctgacatgagtttccatctgtttttgacttcttagaagctaggaggaaaaaatcaattgttcaattgctgtattttgtctttatttttatttattgatttccccccctttccatcacactttataacctaacattccatgttaatagttctgtgtgtgtatatatatatttctgtcctatttaaaaagtaaagaaattattccatggacatttaaacatctgaaaagacatctgatgtgttgtcctgcttatctttgattgtttgtctagttttatattttgcctgcatttagaaaaaggatatgtcatggatctgcctaaatatatatataatttaaagttcagagaacttatactaaagtagttaaggtttgctttagccctccaaagcacttcctttcataatttctcagtttagaatggcatgttctgaaaatcttccatatttaatctcctgaaattgtaccttatttaaagccaaaaatataaatcattcaatcatttgctaatcttttcttttttggcctttccattacagatttttttttcattaaatattgttacctgcctagaattatttacactgataaaacctctgggctcagtgtttgttagaagcccagagttctagaattggattatctattatttgtgtgactatgaacaagtcactgggtcatgaagtctcttatttacagaaaactggtttttgatgaacacctggtcaatattaggcattgttaaagagcacataacttacttttaaacagtttaaaataggtagtttataatatatagtttgactatatgaatgtgtaatactttaaccttcaactttaggagcttaataaaccagtctagggtagttagccagcattagcattagattggaaagataatactctagaggtggctactatatgagtagctgttgcacctacttcaatgaaaaaatgatgctttacttattagcaagaatatgtcagaaatggattttctttggtgaaattagtagcccattaactagcaaaataaatgttataaatggaacttaattggtaagatgagaggtttaaatatatgtgggatattacaatcttggagacattcctcacctttgcatgaagaggatataaaaatcttagggaggcccatggcctataccataggattaatgaccaaagtttgatcactaaactaccctattttcaactgtcaatctaataggatttctgattgtctgatgctgaatataagggtaacaaagttgtctcatctgcctcacgtgaacctttttctaaggttatgattagaacacctaaatggacagagacctggggttgtatcaaatttatggaaggggttgtgagtcgaacactgccttcttgctaattaacgtttgctaacatatgcttatatatgtagcagagtttgccataagacttacttttaacctaactagcaaaagcagtatcactgggaggttgttaatcctcaccaacctcaaccttcaccagtagccacatttacctgtcaaaggtttgtatgaccaaattaacacaggatagctctcaacaaacattttgcctcattttattcttcatcagagcccttcaaattagttactattcccttttttcagataaggggattaaagtttaggggatactaatccataatcatatgaatattgagtggtagaaccttatgtgtttgattccagataaggtaactgccgcctcccaggtatatcaaaacatcattgcaaggaatgggtaagtaattatgaaatgcgtacagtgtgttccctgcaaatgtttatgctaaacaaggtctgtttagctcccttataagaaagctcaaagtcaaccacgtattaaatttattatatatatatatattcttactttacacaattataattactgttaatatactttgaaattttttaaacttttcatactgtttttaaatctataccttatttgatttatataatatattcagagaaattgcaagttcatactctggggcataagcctctatgtgacgcaattgtgtgacctagctctagagtcctctaccagaaagttagactctgaaattatcacttgaaacatgctttgaaaaagtcacagttatctaaaggtcaataaaaagcttatctcaaaacattattacatagaaaaaagtaagtagtaattggaatgctgaagtgatagaaaatattcatgggttgagaattttgatatacattagaggacagcagagttgaaggaatagttttgggttctatgaaactactagtcagtctaaaaataagaaacaaatgaataaaattcaagatatgaatacagaagaatttcattctacagttaccaataaaatatcatgttccaattacatttgattttggatattgtgtcccaagcataaatcaatctggccacaaataactgaaatcgagtttatatattaaaatccttaagttcttagaaaaaagatcttaggttaatcgaaaggtaacattgataagtttctgtttatatttctgaaatgtatgcttttaggtaatttatgtttaatataagtggatgttatagggagaaaatgtttgtttcataggaaacaatttctttagcaactccttattacaagtggaagtggtggcatccagagaatatgttatgagaaaatgtatattcatacttttactttaaaatgttacatattttaatttactctaatttcatttaaaaacgaaagcatatattatgaataggtaatttaatcaaactcttttttggaggaaggctaatatgtttttattatactatagctgtagatctggcttcaagaattttgaggccgggcgcgatggttcacgcctgtaatcccagcactttgggaggccgaggcaggcggatcacgagatcaggagattgagacaatcctggctaacatggtgaaacctcatctctactaaaaatacaaaaattaaccgggcttggtggcgggcgcctgtagtcccagctacttgggaggctgaggcagcagaatggtgtgaacccgggaggcggagcttgcagtgagctgagatggcaccactgcactccagcctgggggacagtgtgagattccatctcaaaaaaaaaaaaaaaaaaaaattttgagtgcattagcctttttcatatgtgttattattacataaacattaaaattacccttcctctgtaattaaaatgaaaaacccacacacattacaaagtaaggagctatatctttattcttaaaatgtatgtatttgcttatagtaacttaggataaaaagtatcttgaaattactgtattcttgtaaatgttacttggagtattatgggaagaaagtcagctagttggattaatttcctgggatgttttttcaactcactgatatttatcataactgaacataatgaaatgagacataaaaattagattgcagcttttataggtttaatatccatcaatgcttagaaagctggttagacataaaatgaatatttattctaggttttcaacgttgacttcagtaatagcagggggcaaaaaaaaagaatgtgcttaaggagaaaatctctggttattttataaacataccactccgttcactgatagcagctggtctcctcttttgaggcctccgtgtctttcagccacccctccaggaattatgcgagagatataaatgggggaattttgctcctttcctcccatcacattaaaaccaaggccttcatcagtctttggcagttcaactactcgagggtgggagtggccttcactagctgcaaaagctgcaactgttgcctgaaaaaaaaaaaaaaagatggtcttttggtaataaaatgagggaaataaaggctaatcatatgctttgcagtgggtagctcaggcaacttctcatatttttatagtattctcctgtgaaagaaagaacacaaaaagcagaggactttcttcatttagatgccatctaggatttctttctttggtaaagtcccactcatctatttccagcttcctagggcttatctgttatgacagaattttcctgtcttcataaaaatcctttccagttaccttggttagctgcaattcttcctattcctggagtccaaataactttgttatatgtactatctactattataattattttatacatgtgttgactatgagcaccttaagagcagagatggcgtcttgcactcttttgtatgacacagagtctaatctggtgcttgcacataaaagttcataagtatttttttaataaattgaagagcacttgtatgtatacatacttttgaatacatatgtaatcttgctattgccaacccaaaagcttagcaaatttaacttttttaaaaaattaaggatgccttaaagagaatgaaaactaaaataaaataatagattcaaacagattattgttagcttataccaatataccatattattattccatactgagaaatcttatctggaacaggatttttcttcctatattatacattaatatttcaattattataacaaaataggcaatatgaagtcaatgattttatacctagatatacaaaacatcatttaatatggacataatttgttttaaaattcatgtactgatttcattaaatgagttcaagaaaacaacttaccattagttcccactaaccccatagaaataaaataacagcacttaggtagtttctatcaagaaatgattctgtgcctgcttatttttcacttttattaattcaccttgatcacagttgattagatgcctgctataaagtgacttactcaacactgtgaaaatatttattcccaacgactgtaccttcttttccacacacagcattatcacatcaatttagcattatgctactgtctgcatttagtgaaagatagtgaatgacatgaaaacaatggcttgtttttagctacatgcatttgctcatgcaaacctcattgtcatgcatagattttaatggctgacatggatgcaatgcagacagcccagaaacaaccagaaaatactgtgctattgcaacattatgctgctatcctgctgttctacatgaataagaaatgagaatggtaaaacactacacaattcactttccccttaattaaaccacgtagggatcatttttctgtgtgtgttccacttcagtacaagcaaagcatgacatgatgataataacaccctctttttttccctgagtttaaacaaaacaaaacaaaacaaaaaaaccttacaaatctacagtgttcagttacagagtaaaaactaaaaaatcaagagagaaactaaacaagcgttgatgtaacacaaaataattaaatggaaaattctactcattttcaatggttatttcttatacattattagaaaaataaagtatttttaaaagcaagtcatgtttctattataacatttgtgtgtttgtaaaagaagagctgcatcagtgattttagtttaaaattggtatttcctaatggcctattttcctgataatttcctgatgttatcggtataacatttccattagtagggtctctacagtctctggatttgagtctttaaagggcagatgtggtcactaccacaaaaggtgacaggcgttttctataaggtctatgccacatcctttcagcaagttacccactgctcagctgaatacacagaagtatcctagatcagtgggtgtcaggtgaattcttttcctgtctatttgaaatcaaatctttagaccggtgcaaataaatcttcatgcactgaatatgatacaggttctttcagatcagaagaatgtgtctgaaaatcatatagtatttcacacaatgaaccagtagatttgcttgtgccaaatggacattaagtgagtttaatgaaatcattctcctttcttaagctacagaagcagcagaaacgttcaattttccattaggatttttacctgagaagtagtactggttctagactctgggctgccactgatgtctaaattctcttacagtgtacacacgagaatacctgaaacacacacgcgcacaatcaattactagataactggggtcaagtatatttttaaagttactcaagccttacctttgctgttgccctcgcacggaattcgggacagccattaacagttatcgtttcatgcatatattgatacacctaaaatgttcacataaaaagaagaatgtgtaagaacatgaagaataataattcttttattgcagaaagaaaattatattttcactgtaggaaaaaaattctctattgcaaaataacataggtctgatgtttgggaatgtacctgatagcactccttaaacagcagatattattactcattgtgattttagatacaattacagaaatcattaaaatgtagtagaaaaaaattgtttcttataaacttccagggatgggattataaaatctttgtatctatggtaaaataaattgcttaaactaaagtacagaaaaaaaaaaacttaaaggatgccttgaggaagatgtttggaaaaaagtaacaaggttaaatgtgttggactatatgttcattttggatttaaatagtatacgtaaaaatttattgcataatgcatagcaataaaagtccatttggtactaggctagagtatttttggggagtgatccattagctatttcagtaaaaaaggaaagggaaaaactgcaatcgaaggttgaaaggtttttttcttcctttatattaatcttattttacatgcttaactcaaaaattaaataagtgaatccaacatttgattaattcacccattcaacaactatttgttgagtgtctgggactaatctcttccctgcatttttgactggctcataatttctcaaatacatttggttgaatctccactaacgctgactcatctttcccaggtgacatggttagaaggaaattgacaaagtagtctgtactaaaaaggcaacagtgcaattcagaatctaacttttagctctgaatctccacttaacaattatgaggtgttcaatttctatgggaaatctgaatggagacaggaacaagtttccagaagatcatttatggaatctgagatatgttactgcaaattctccaggttacctgaacagctgctaaacgtacttccagattatttccttggaaatgcattattttgtttcatagagacagcctttccaaaaataaattatactatttgctctaatagcccatttcagaggaggattttccctgccctgcttctcttgtaataaactctctcaaatctgacccttcattccaccctagctcattatctcttgctgcaagcattgcattagtgacttaattgggtctccctgccatcaaaccatatacactttggtgatcatcaagtacctacctgaccatgtccctgctgtgctcttggctgtctgctgcccttactgcaaaggtgataagggcaaatacctacaggagtcaagccacagataataatgcagaactcagccttctctctagttttattttcctgttttcttttctccacccccaccattcctcaaacatattgaactctccaagttacctaggtctctgcacatgccgtttactctgctaggaatgcccttccacctggcagactcttattcatccaaatttaatatgatgataaaaggtcaaattcaaatattgtctcctctattaaatgttttctgcctccctcaagcagagtgagtctctccacagttcctggtcatctgaatttgtttgaagttattttggttaacattgccagggaaagtgactttgcctgcatccaaggatgtttatgaagacaatcatttagcaaataattggaatattgtcatcaattgaataaaacaaaaggtgattttgtaagtgctggagataaatacctgtacctaataaatatcacaaattaagaataattagccttaagaccccaaattgattttgaattagaaagtggtatattcaaggagcaatactgtgtagtagataatttcacagactctgaagatggcttggaagcaaaccgtagctgtaccatttaattgtatgatgtttgtcagtcacttgatttctctgatcctcaatttcctcattttaaaaatgtgccttaaaatagtaagtaacttctaggtctgttatgaggattaaataagataagaacaatttgccatgtttagtatgtttccaaaagttagctatcattgttatgctgttgctggcatttgatgtttctcatcttatttgaccatggatcttttggggaaaatctcctaagatgagcagttcgtgaacactgtttacatagaattgatcaagggctgtagttctcaactggggacaatgttgcccttcaggagacatttggcaatgtctggaggcatttttggttgtcataaatgggatgctactgcatctagcatgtggtggccaaggatgctgctaaattcctacaatgcacagtgaagcctcacagaacaaagaattatctgccaaaatgtcaatagggctgagattgagaaatcctgatctaaggaattaagctataccttttcttcgtacgtgcaatgattggtaagctgtaaaaacagacttggatagcactgagtaaaggctcttgtaaaacattcaataaatatttgttggagtaaattaccataattctggtatatatttaatgagaaatcaccatgggccaaatgtaatgctaaccattttatatccatgagctcggttaattctcctaacttcttatttgggcactctacacacaaagacactgagtcacagaggtgggaacataccgatgaccacacagctaatttgttgcagatttgatacagcaactcatctctatctcccttcaaaatctttcctctttcaaccgtatcagactttcttatattaaaacagcatcagatcattactattttggcagtatcagtgtgaacaaaaacttgcaggtgttatgagaatttctttatattttgaataaaggaatctaggttttatacagtggctaccattaaacaagtgagggctgcaaatatacaatacaacaattttgaaaccaataaattcattagtccacagtgaaatatcattttaatcttccttatgattataatatatgaagacttagtggaatgaatccaatataattgctagtcttttttttttttttgtctacaaaacacaatagattctgattagctggttttcaaaagtgagctgaagaggacatgatctggttgtagagtcaggtcaaatcctggagatattaattctatttccattagctgtgtcaccttatgaacttccttagcctctcatttcctaaggcgcaaaatatatccatgcctatcttacttttcaaggacaatttttaaagtatttgtaaaaatctgaagcaagttttcatggaaagccaaagtattttaccagataccctgagagagttcttaaagggaaaacagaaaatagttgtatgtgctttaatgaggggcttatacgtggggcttatagactcctgaattctttgggtcccagaatgtatgacaaacttcagctacagcatttgtaagacatttcattggtaaaatgggtttagttcctagtgtaagccaaataattcatagaaactcataggggttttatatatctcagcattattaatttcctaaccttgaataaattgcacagattcagtagcattttgcatgtttagaacttattccaagctactgaaaattgaaaaagattaacttaaaaaagcaataaaattatagtgagttggttcagaaagttcatttattcatttgttcagctaacatttaggagcaattctagtcaatgtattaggcatctgggctaaattatgaaaataaaaaataatggttgtttttaattaatgtttgaaacaaaattttcactatagaagggctgttttcagttttttaagtgaaaaatttccattttatttttctttatatttaaatgaaaatagaatactttttccggatggaaattttatccctgagagaataacaagtataaatgaagtacaagcttcactttaatttatttaccaagtttacatacacaggttatgcaatcattatcacaatataaactttacattgcatagttcgtcttgatcttgaaaaccctaattggtacagaaagctaggtaagggatgacaagcctttattgtgagtttctcattctggatctcttttctacatgacttcaagtaacctactatctgtgtaccttagttgtctattatgtaaaagcctatattcaaagaggcaatcaaagaagataaagtatgtgacttcacaaaccataacccattattcttattatgcttttattctaatagctgctattatttctattattactattatatatatatacacaagatgcaattggaaaagtgcctttagaatttagttgcttagccagcagcaagtttgaaaaaactttgaatttaaagctagattttggttgttctctcttctacttttatagtagaggtttattgccttttgtattttgatgttatttaaaactttctgctgaggcagacactagacagactcatctcacacaatccccagtttcaatccccttctcccagtattgtctgaccatatgacccagttctgtccaatgacaattcaatcggaagcaggtgagaagctgctgggaaagcgttactctcgtggtgcaagtgctgtcttttccctgtcttctacttcttgtcttgtgtgtggatattatcagctgtagtggcaaccttcaacttcagagagaaggaccaaggaagtgtacagatgtcagttctgattacatggaacttctaagtgcatgcaaaacacctgcctatctctgaatttgttataacgaagaaaagcattcttgtttaagccactacagctggactttctgctactttcagccaaaaaagttcctgattgctatatttctcaagtaaatgttatatagaactatgctatctttagggtctcttttcttctgttccttccaattctgaaacttataattttgtccatcagaaattagtgcaaatttgttaatatgagggcctacaaaccaaaaagatagcctaaaataatagttaaaaaaaaaagaaactctttgaaaaacactgttaaaaaaaatgaaaagacaagccaactggcagaaaatgtttgcaaaacatatatctgataaaggcttcatattcagaatctataaagaactgtcaaaagccaaaaagtaaacaacacagttaaaaatgggttaagtatttgaacaggtacattatcatggaagatatatgggtagcaaatatgaaaagatactcaacatcattagtcacttgggaaaattcaaattgaaaccatacttagatacacctacacacttattagaatgtgtaggttaaaaaaaaaaaacatactgacgatatctagtgtaggtgagaatgttggagaactagaatttttttttctttttttgagacggagtctcactctgtcacccaggctggaatgcagtggcactatctcgtctcactgtaatctctgcctcccagattcaagcgattctgctgtctcagcctcctgagtagcttacagccgtccaccaccatgcccagctaatttttttgtatttttaatagagacggggtttcactatattgttcaggctggtctcgaactcctgacctcaagtgatccgacggcctcggcttcccaaagttctgggattacaggcatgagccactgtgcccctgctgaagaactagaactcttgaacattgctagtggaaatacaaaatggtacagctatttgagaaaacagagtaacagtttcctgcaagatttaatgtaagatccactcatcttcttctagctatttatccaagataaagaaaaagttatattcatacaaaaacaatatggaaatacttatagcaactttattcataattggcacaaactggaaacaacccaaatagccttcaggtgtgaatgaataattaactggtggtatagccatacaatggactacttggcattaaaaaggaacaactggctgggcacagtggctcacatctgtaatctcagcaccttgggagcctgaggcaggaggatcacttgagcgcaggtattctagacaagacttggcagcatagtgagaccccatctctacaaaatttatttagaaaggaacaactactcatatatacagcagtgtagatgaatctgaaatgcatgttgctaagccaaaaaaaaaaaaaaaaaaaaaagccagacattataatgattttatgtgacactttgaaaaagacaaaacaatacggatagaaagcagatcaaaggctgccagaggctaagggtggggaccaacagattagaccaagtatgatgaaatttttgggaatgttggaactgttctatatattcataatcatgtaatgattacatgattgtatgtgattattacagctcttagaacaacacactaaaaagtagaactattactgtctaaattatacttcgaaagactgactttttaaaaagcaaaaaatattttttaagacataggaaagcagaaaatattttaaagagatgaaaatattcagaaacttaatcatgatttcagaagctaaaagtaagggtttgaaacataaagacatatatatctaagaatatatttcatataataataacatgacattcatcctcattccacaaagtttatcagcatggaaaacagtagatatatttaatggataagaacatctctttaaaacataggatgctccagagattttgtagtgcctcgttatagatgggttggctactaaaatgtcaatagaattacaattagcatcatataaacccctctctatcaatgactggaaaaaaaaaagtaaatgcttcaacaacaaagtgacattagaccaagttatctcaagagggaaaaaagtgaaaagacatataataggtattatcagagcaaatgaaaggacacatgggaaaatgatgaggtctaaatctcagcacattatagtgtgcattaagccttgttaagtgtatggcttttcttaaaaagcaagtaagaatggttttttaataagaaaaattataaaaattaagattaatatctatacctatctacactttttaaatggatttcttgatttttctgattgggaaactcagataagagttgaataaagaaaaattatttgatgtggtatctgactttaaaatattttaaaatcttcattacattaaaaataaaaatttagctccccacactcttttacaattataggccacctgggtagttggaaaacattcataatattaagccataatgtatttatcataatataataatactgcaggcttcttgaaagcagattttaggccaagggaggtatctaaaatgaatttggggatcatttgaggctctaagtttaattgcattcagtggaatggagtccatgcctgcaaaattaagtgccctgatgtaaatgtacatactgtacttgatatgactagaataaaatagaaatagaacttaagtcaccaacaatttggtctgcttgttttaggaagttttgtgaaaataactgattcatctactaaggaagagatgttttaaaaatatctatttattgtcttttatcctttcattttgaaaacctggcagccacatataaattttatatattttaagctatagctatccatatagctttcatatatcttttctatatgcttttgtaactgtggaaaatattgtttaaaactgtagtgttagaattcctataaactaaaaaatttaggttatggaattcactgcctgcggccagccattttttgcaaaaaaagaaaaaagaaaaattaaatggcaatggtacagactgtatacaagtcatgtctactacagtaagatcatcaaggctcaaatcgacccagtgaaaatccaagaaggatagaatttccagagtactatctttctacatttctctgcagccatcaacttcgatgaaaacatgtcacccgtcggacaagaaaaaatactgacaggtataaagaagcaaaggacaacatctttgttaggtcgaaatgagttataaaagagggctccaccattaaagcagatatttgatagtattactggtaaaataaatgtggcaaattggttttaccagttgacaaactctaggaataggtcaaggtcttggagaggaagcattcctcctaggttcagtggtaactgtgccatgtgaaatactctttatgtcctcaaacaaggacgaaaaacaaatgaactctccagtttttagtcacaaaggacatacaagaccttcgtgtaggctattagctccattactttcattggtattttaaaccatgctgatgcagtgtaaagtgcctttggctacaaagtgcttcctttcagcactgaagaagaaacttcagttaacactcattaatatatcactattgtcttcaagaaacaaaatcagcctacctctagagcctactacttcagtcgtatcctgacaagatgtatctgacaaccaagttattaataggatggcaatacttataactaaaaacaaaacaaaacaaaacaaaaactccactgaatttgacgattgaaaacaaatgtgatgcaaacgtgatactttgggattaaaaacttcctgcccattggcacacaatttagcctctgcacacctgtttattagttgccccaatatccttatggaaggaagatctgcccgtgtggttgatcagcatgcaggaactgtacaaggtcatggctttactagtggtattgatagtgtctctcaaaggttggctctgtgagatacaccttcttctctttctgcatccatgtcacgagaacttaggtgggggtacctgcttggagccgatacagctagtcttctcattttatattccaccttctaggccaagccagatatcttagattcagagtggagtaaaacagatagtttacttaggcatctgggcccagtcttcattttccaatctatattttatcagaaaaagcttcactagagaagatcttggtgctttccatgctgatagcaaagtggtactttgtttcccatttggttatggcccttgtatctggcttcctttggtagtaatccctgagaaggaaggacagaatgtggaagaggatttgagcactactgggcgcctggatagaataccatcttaatagcactgaaacctcatgtctacttcttacagcccacaagcatatttctgagctcaactacatgactcagacattttgcttcaatgtgatacatgccatttatgatttgctttaaaggacattaactagactgcagatatagaaaagtcaaattgaaattattcataatttatgaccaatctcatgtcttaaagccaatttctgtgaaaatggttttaccagattgaagaaaaatgtagtctcaagttgcaagtcatctccaatgctcagattagatgaagatgagaaggattttggacacagtgatggccttaaatatctaaccatctgcctagccaagttacaaagaaactgggcctttttctgaaatgatgtttatagattaagtttaatgagaaggacacatgagaaacgtctccagcactctacctcttaaatgatgagtaaaggatggggagaccctctaggatggtattctagaaacacttaacagagacgattaaatgtctccttgtgcctgacagtaaatggcacatccttttatttgattctggctttgtgggagctcagtagggaggcatcaggactataggtacataatatagcacagtcttcaaaagtgtctaccaattttcaaatgtccagaagctatttatatcacttgttttaggtgaattaaaatgaccatgccacacacttaattttccaaagtaaatagaatatactttgctcaaatttatagtttcaaaactaattattctattacataaaagcagaataattagttgggaaactataaaactgaagaatgactataattttaaagctatgctattaatcttaatttccctacctatttttataattggtttatatttcctagtggctcttaacatatataactttaataaagtagttcacatcaaataacttgtacaaatcatttaataacttcaaggaaaaagtgagatcacaaataacagggtgtttctactctacatggcaggtggccaagccaccaagaagaaatttctttttttttttttttttaagttgttcaaaaaagaattcccttaaggcagctgttccctgtcttgtccttgttacacagtcagaatcctctgtgacaggaaatgcctgagcaaaattttgggaagatgtcattttcaattagcatagtaccattcaaagtgactgaattatctttatttgcttattttgggtaaaattcaaacaaggtttggggcttcaaatatgccttaattttcactgtttggattacgctgatgtgaaattttatgaaggattgtgaagtgcttagatattggctcagcagacttgaaatttactagtgtacttaaaagtttgcaagggttgtaaaataaggtttactttttaaaataggtctttatcaggtgaatatattatccaggaacaattagggatacattgtcattgtcacaggagtcatatcagctaatcaaatgaatgctgaggaaaaaatttaactcagtgaataagagccaacctgattattcagttgattgaattaaaattattatagctaataataaggttgccagatgtagcaataaaaatattggatgcccaattaaattagaatttcagataaacaatgaataaatttctagcttaagtgtgttccatataatatttgacacaccgttaatactgcatcataaatgaattaaggttaaaaacaagacttatagtttgggaggtgagagatgttaacaacagtgagtataattagggagcaaacaatgtaatttgatgattgtaggctcaggttacaaaagataggaagaggtccagtttgatgtcatggtaaaagatgtgggtgggttaataagtttgatttcagacaatgttgtttgagtcattttgtgatctctaggaggagatgttcagtagacagctgcatatgcaggtctaaagctcagagggaaaatgtacgctataaaatataatttgtgagttatttctttgtcagaagaagctttgtgtatactttaccctctaggagagattgagaatgagaaaatgagagaattttgaggggctccaacatctatttatgtcatttataagcccagccttaatcatattgaacctattgagccaagacatctttttaaaaaaattaaataactcacatatactcctttttaaatggattatatttaggggaaaacaaatacaataaaaccccaaatttttaacaaatgattttaaagtaaaagtaattcctatacactatagaaaatatgtacaatatagatacatataagcaagaaattaaaatgatttataattccatgccaaaggacaaccactattaacaatctatcatacttacttttaatgtttattagttttttaaatcaagccaatcattacatactttttataatctaatattttgttttctttattttttacactatttggaaattatgacatgtgagtacatattaatgcttattctacttaaagcttcatattactccaatttggatgcatcataattcatttaatcaatcctctgatgaggtgcttttttttcttacaatctgtacagcaagaaataaccttgaatatctgtgttttgtaagtgtgagaacatctctttatgataaattcattgaagtagattactgagtcaaaagtatatgcatttccagtgttgatagatattggtatattacccctttggtagagttttggcaccccagtgtgtgccaataataattattgcatctgttaccgcacagactgcaagaagtttagaatcatgttcaatactgaaataaagcttagtatttcagaaaaattgacatcaatgaaagaatggatgtgagacaagtcattcaaattgcaacacaaaatgttgccaaactcatagtccagatagatgccaactactctggccttttcctttagcagaaggatgactaaaatagtgcttcaagcaacagagttaccattctgtagctccgttgtccagcatctgtctgttctgatagagatcactttcctttcctgaagagggagtctttacagccctcaagagttaattcagggtggtgaatggaccacttcagcctctcagtaatgctggcaggaatcaaagtcttcagaacccagaacaacaggataaactacatcattctggaacccagagcaactggataaactgcacaggagtgaatagagagctgaagttttcaggcgttcatgcctgttgcagatactcttgatgcccagcagcactttcatttctgacatgacactcttttctgccacctcctttagtagatctttgattgtggaaatgtcatctgaaaatgctatctttgcattaagtttcttttgaatattcttctcttcatcaactaaccttgagagaactgcctcttgctcatgatccgcaaatatgttcaggtgctcacatttagagaaggatgtctgtatctggtttttcaccctatttctcagttgtaaaggttttctatcttgagtggctactaattttgcactgtctacaactttcctttccagagacttaatgtaactgctgagcctcttctggtgatgagaggcagctttctctctgggcctcaagtggtgactgaccctggtggtcagagggctgagtacacaggagacgtcacacctctaggtcttcctcacagaaaagggtcaggatccgatagtgctccttgcacaacactttggtgcctgcctcttcattttgttcccggtgatgtggagtatctcgggagtttcagtcgtccttccctgcagggtgttgctcctgcagtggccctcttggcactggtgacaccggacaggcaagggaagctgtcctataaatccacccagcgctgcttgatggaggagtgacagaagttgtgcccacatttgatggtgacggggtcactcatgtaatcccgacagatggggcagttggcttctgcctggagtccagggctgctacaaccaccactgggccatgaacggaggtctggactaaagtgagttttcttcaggaaggtttagttgtgcagatactctgcagtgagaagcagatacaccctgagatgccactgcctttactgtcctgactgtctccttgtcttaattagtcaacactgatgtcccagggagccactgatccttggttgcaaagcgaggtgcccagaggagctctgctcataacctgcagacaatctcacatttcctgggcaactagctgcccttggcagcccagaggatataaaaccaatctaagcaattatcttggtcagaaaacagacatgacttaaagatgactagttcctggagcaggcagctctgtgaggcaggtttttgagagttgtctctgaagccagtcttgcaccagattgtatgtaacctgatttttcacttaaaatattgtgaacactttccccactaattaaatattcttttagattattttaaaggagccatcatcaatgtgatggtattagaatcatttgaagacttttaagataatagttgtgtgaccctcaaaatagatctctaaatagagaaatagatgacttggttattttccaaagaacttaccagatagttgaggttataactgtctcaactatcaccaagtccttcagcttatactaaccgaacagagagtgagtcacaatttggtaatctgtaaagcctgcaaaaagagtttcatcatatttcacaatttccaggaatcctttaaaattatggatcttaaccttttatgtgatacaactgtatacctaggtctgacctcttttcttcaattgattatattgaaaataaggactatcactgattctttttatttgcaggaatgttgtataaagtccctgcaaagactaaattagcaaattctgaaccactgtttctagagaaaatacatggttaggtttctctgaatctctggttacattttcaccaacaatcaattcataacagttttatgaatgttttttgtttaaagacatcttatttaatacatattgttgatttgctaacattgaactcaaggccaacagcgctataatgcatgtctgaacgaagcttatctaacacgtattttctctctaaggcacatcatcaacttcgtgtactgacaaacagtagatagcacttcagcactatgatgaggggccatttgaaacagcaaaatcaccaagaaaaggcacaacaatgtgatgaataaggcactaaatagatggcaaaaagcccacttcattacaagttgttgtaacaggaaggcagagcattgccttgttcatcctcagctgggaacttgagtgcatacattagatgactcaagtttttctacagaaaaagaaggtacagaattaaagattccagattgggcttacctttactaacaccatcctgactcactgttaccaaaatgccagactatactcttcacagagaggagttttccattacatcttttctcatgtgttctgttacattcaagttatggtaaatgcaccacgcttggctctgtataattaatttcacaagatggatgtcaagactataaaacaatcactaggttctgatttgtagcctaagatgggctttagctctcctgcatgtgcagctttgatagaaagaaagaggaaggaaaggaagaagatattaaggatgctgacttaaggctgatttctattagagttctatttcaagttcattatttcaacgactgaatagactctcacaaataatgatttagttctctgctttcttgtagattaaactagataattgatatagaggcagtaaatatgcataattaaacatactttgtttatagaggtagagtctaaatcaagttctaaggtttgatctacaaaaagacagtcaatgtgtcggcttaaagaagggagaaagagagcacataatcaccttttcaaaggtgcacataaacttagccaagccgcaattaaccatagattttatttggcttgaattatccagatttcccaggccctttgaccttctattctgatgagtgtttaattatatgtcctaatgaccataatggcactgtcacccaaggaagagagaaagaagactcataatgacctcattggtagtaacatgtgaaaacatatcttgatgtagtctatatgatgtggcattttgacatagtcctcttaacatagaaaaattactttaaagcatttttttaaggatcaagttatagacacaacagacatctctggtcctcaccctatcctataccccatctggtggtatgggttatgatgcttaaccatagggtaaggacatttcttttgcatataagctggaaactcttttttaacagctaactaatgaatgatgaaaggcttgtttgtttgtttttttttaacaacattaaaatgttcctttgaagaaaaggcagcaccaaatatttactcaaccctcaaaatgtatctggaattttgtttttgcagaaacctcactgaattgagtgaaatttcatgtaatttttaaaataaaaagatttgttaaaacatgacttatacagatattttttcattatttatatctatagaagtctcaaaagacaaagttacactcataagtttaagggcgtaatacttgcagcaactgttattatttctgtgttgaaatcagctgacccagacataaggcttaagatgacatggcaaatcaactccaagactcaatacgcaaggcttgaccccactgctctaaccatctccacttcacttgggatctgcataagattttgttaaagttgtttccatatcaagatgagaaaaaaaaagaaatgaatcactttattgctgaaaaaaaaaacagcaaaaatgatgtggagaaaataatggctgtttacatttgccattttaggatgaaagcatttgaattttttgttttgaaaaatgattttttttatttgccaggaagtagacatgtgttttcattaggaacattgttggaaaatccctgcaaagaggaacatctgcatcattatcactactgtcagaaaaattccctggcatgcaaagcactgaatgcggcttgtctcaagtagcagagatgctaactcattaaaaagcccagacctgaaaatgaactaaacttcatttaacttttggaagtgatatgccaggttcaattatagtatggaaaaaggcatcaaaacgcaacattttttaatgtgaataatatttcataagacattttctctctaaaagagaaagtaggtcagttttatcaaagtgaaagaagatgtgaatttgaatacattattaacctgtctttggggatggcaaaaatctgcctttgtacttccatcaccttcaaattaaatcctataaaaatctaagttagtttgtaaagggggaaagggaagctcagaaagttttaattaggttgaagtgcttcattagtacttaccctcaatctggtaaatgctatcaattcatgtaaatgcaaagaatctctcagacactgattattcctctcacattgctcattcatttttattggagataattgtcagcatagctcagcattaaagaaaaacaaccttctgattccatgcctgtttcaaagtttatggtgtcttctttatgttcttactgcctatctaaatgcatattttaaaaagtctttcacttaaatgataagattgtgtagtcatatttctcctctgttaagcaagttatctctgtgtattacaaaattaaagaaattctacactgatatgacctatgaaatgcaaagcacattcatctgtcattttaaaaaaaaggtttgttttttaaactgagtggcctatcctgctgttggataaagaataaggatgcctgcttatataatatctaccacagtttttatcatcttacttaaagatgaagtaggaaatcaaggcctacatctaacaactgagcaatggagaagagggatgagattaacaatagctgtgagaaatcaaggaggtcttccttgaaactggtagtttagcagctgtcatattagacaacaatgtagtgtgatcacaaacatggtcaggagttacagtgctgaaatgtccactttggggctgaaaggtgacacagattctctgcaagatgatggatccagtgcatagtgttttatgtgagaaaggacaggcagcttccctctgtatctcagatgagggaaaggatttaagacattgctatgtgatctggagaggtagatgatgataagttcccttcctcaaaataagtggacatacagcctttcagaggatagagaatgtttcttctgtaaattgggtgagtcaaagaattgttaccaggattcacaataagctgtcaggtttgtggcctatgtctcccatgtggagtttaaatcactatgggccatttcttagttagtttcctaaattataattcgtgggtcagacaagaggtaaggtattaaagggccttaatcaaggattcagcagtggtgttttaaaaagggtgtgcatgtgttgtgtgcaggtggggggatttgtaacaagtgacaaagataactaatcttcctctcttgaaattagatataatagaatctaatatttgtttctgttatgtagacatattcttcaaagactaaatttaataaagatgaaaggagtctctcacttttaattattttacataaaagatactacaggatatttaatggatacaaagctttatcaaaggaaataagcagtgagactactctatcaaaagtagtaggtacttgattacatttgaatatggttcaaactgatctctaagtaattgacttggagttccttttgaaaactatgaaagcattttgttgactctattatactcttcttaatttttttttctgtcttattatccagtgaacctactggcacaaataatgttttcagtctggattttcttttttagtttttgttgtttcagttatgaaaaactcagatagaaatgaaagatataattcaaaattgctcaaaccatatggtttccaaatgttgctgcataatggaatcacctggggattcttaaaacatagtgatgtctggctcccaccccaacattctgatcaaattgcaatgggctgagagctgggcattgagactttcaaaagcactctatgtgattcccatgtgcagcacagtttgggaaccactggctcaaacactgagaaaaactaataacatgaaagttcaaggtaaagaaaatctaaggaattagttcagagaccattttttcatgaagaacaccaggtttttacacctctggaattcttagaatgccagctgtgtctttggaggcttgttctcctcaccatcctccaaaggctgccgtagttccaaaaatcacatgcagacaagacaacacccagtggaaaagagggcattactggttcccatgtctctcttttttttatttttattttagagacagaatcttgttttgtcacccaggcagtgatgctgtcatagctcactgcagcttccaaatcctggctcaaggcatcctcttgcctcgccccccaagtagctggggttacaggtatgtaccactgtgcccagctaagtttcacattttttgtagagacagggtcttgccatgttgaccagtcttgagctcctggcctcaagcgatcctgccacctcagcctcccaaactgttgggattatagatgggagccaccatgcctagtcccatgtctcttttaatagccatcatatctttgtcagaaagtcacccttggacttccactcatgccccattggctggatcagcttcacaccctcactcctgacaagggaaattagaccatgacccctgccttagattaatccagccagattgacccacctagccgaggatagagtcaccccttccctgagtcagacaggggctaagaggtgggggtataaacctgaacaaaatcattctaccagttagagagaggtgaaagagactgttgatagcagctctggagtatctgctgtattccttttttttcatgatctaacagatagctttcaatctacttggataagttttctgttatgcaaatcttctatgagttttcttttgacacgctttctgtatgaacattatgctccataataatgagacatcatgaagatgacagggttcagaggaatatcaaccataaataaccccattcctagagcaggatgtaacatcttatagtaaatttcaattgtttactttaaaaaatgtttttccctcttaaatttattgtggtaagagcccaatatcactaaacatcaagtattttcaatttgtgcctcgctagtagtacttcaacccatctccttaatacacagaaatgtaatgtattaaaaaactgctacatttattatatcctgtcaatttaacacagtagtatttcaattttcatttaagtatagttaaggtttagagtccacataaaaatacttatccctgaaatgttactacactgacagcaaagcaaagtgaaagctggaagcagctatttcagcttcctatagtgaaataacagatgattagcaacttgactgcaccttggtagcacttcttttactgataatgtttaagttgcctcccgcaagagtgtaataatcattatgagaggccatctgcctagtaccaaggtaatcattcacaaagttcttccagcatgtcactgtttgcatgcccaaggataaagagacatctgtccttctggtaaaagaggaaataaactggccaggaacggtggctcacccctgtaatcccagcactttgggaggccaaggcgggcagatcacctgaagtggggagttcgagaccagcctgaccaaaatggagacaccccatctctactaaaaatataaaatttgctaggtgtgatggcgcatgcctgtggtcccagctacttgggaggctgagtcgggagacttgtttgaacctgggaggtggaggttgcagtgggccgagattgcgccattgcactccagcctgggcaacaagagcaaaactctgtctcaaaaaatcaatcaaacaaacaaacaacaacaacaacaaaaaacaggaaagaaactgcaggacttaaatcttttcttcatagccatgtgttacgtgtcttttgatgtaattcaggtcaaagttttcaggaagtaattaattcagaaaccaggaatgttacctgcccagttgcccagcagagcccattgctaagctttaattaactgaagataaactatgtagcagataagatcactaaagaccagtacttgcctctgggctggtttcaggtgggggggcccatatcagatatgactactctcaggtaggtagcaaaacaggatcaccctcacagaaatcctagagcagagacttttccagtgttaaaagctggacccactgcatctcaactgctctgcacttgacacttaagaaagatggatacgaaggcaatatgtaatctaaaccatgacatgattgccagcaagaagttgcaaagtgaagtagaaggtgaagctaaggtggcctaagttttggctaggtggagaaagggcattggcatgtagcactttaaactaaagtatctaataaataaataaataaatatatatatatatatatttatgtgtgtatatatacatatacataaaaggttgtgtggtgtagttcatgagacaaatgaacagaattctaggcagctcaagtgaacgctttgtgggaactcatgttgacagtttaagatgcatatgttttctggtcacacaaacatatagcatttctatctgacttgagaagattctgtagtgtggggagttctgtggacccatgaacatgttctatcacacttctaaccagctcaaactgcctggttggattgcttagttggctgggggcggattcatcttcaggcagaaggcactgcactccatctgagcaccacaggagaggcttggcaaagatctgcagaagtgtgggcagaaaaccacggccattggcaccctctgacttctttttatcacacctcaggagacctcagaatagacatatacttaatttaaaaactgttgggaatcatttcatggaataacatgtatttttgaggattctaagaaatagatgtccaaaaatagtataggtattgtcagagatttaaatgtctatataactactaaaagcataactcaaccacattacgccaatggtttttttttttttctttttttgcaaatagtcttctttttagtttaagagaaggcaacacttgaatgctctcaactctggctcaacaactgggtaactgaacatgacttaccctaacagtgttgcatggaaacctatcatacaaaatataaaattatagagtcagatacttccaagaagaatttctcatgaattttggagatcatggagagaaagctagccagatgttttaaaggattggaaaccatgacatacgaggaaagttaaaagaaagatatggtatatttaacttaaggagaaaaaacttgccagttgcaaggctctggaaacttccctaattcctaatagagtggggcttctcctaggatctcaatgcacatggtatgtcctccctgtgataaaggcacaacataacaaagaatatgttaggggaaatcttgttccatcattatcacaattagtgcatccatgcatattataaaaagctggtccttccttaaaacactgccatttgccagggaatttaataataaatatttaaatcttggatgaatacaaaatgaacgactcctctaaagtgtggattaaataatattacttggtatccttgagaattttcagagttattactaatgtaagtatcctctctctttcaataagaagaaaggtgaattgtgcaagtccacatgattggaactgatagacatacaaatactgggcatgtcctgggcaaagcatgggagaacaagaagttgtaagaggaacagaagtggggagcacagaggtctcatcacttccgttcttcttataacaacatggaggactgaataaatgttccaaagatacactaaatcataacttccatcacaaataccttctatatgtttggtaccctcatctacagattactgggagaccacaaaggggtagacaaagtctcttctaaccagaaattatgaacaggagaaaactgttgagccaagactatcgccagactatgtatagtggagtcaagaacatcagagtgctcctccaggtgctagctccaagttgaaagttaatatttctttgcatagggaaagatattttgttgtactatggtaggcacattcacattcacaaattttgggccacatttacctttgtatgtgaaaacttcaaatgtaatatgttcatattatttaaacagcaaagatgctaaggaattatttgtatacctcagggaaaggtcaatgcaaaattctgctgtaaatgtaaaaagcattcaaatagaaatgatctaagccccaaggtcataaaagtagtaactgctacatttttgaaggagtcagtgtttgttagacaaaattaagacatctcaggctgaaaatagtgcgggaaatatacccatcaaattcagctttttttcctcttgctgccacattagaggataaagaatgggatgagaggtagaaaagagaatatatctgtggttattttgttttaaaagaccaagtcaaatgtgaggtaatggaaaagaatgggtaataggaaatgtcccttggagttaacacacaacatatactgagtgtatttcctaaataacttgttacattaaaatgaaattatgtatattgaattgcagtgtctgaaatagtatctgtaaaaggtatttctctattaggaaagcaagtcaacaagcttaattatattgcaactgcttttaaatccaattaaatagttttatatattcaaattagctattgcattgaggaaacctactcatcttactttttttttagttgtcattatgtatatcaatcccaaacgtactgaaatatgcttcaataagcatgtttttctaaccattataaatattgctttatcaaaagaaaaccaatacttttaaatgtcagaatatttggcattgaataaacaaaacagccagatagagactaattcataaatattttgcttgtaaactcgttttgaattaagcatttattgtaaagcaactttcacaactaaatataagtattgatggtaaaaatatttctagaatcttgtagtagacaaatgtaaacctttttatcactaggaattcaatgaggaaaacattttttaacttctacaaaatagaaatattttataaaatataagaatattagttgatatttaaagtatttttctcactgttagctcattatgcctatttagctaactaaagatagcattaactcttttgacaattttttaaagctgtagcttaacagagttaaattttcattacatagaaattcaagttgaagaaaatatgtttgtatagttatatcttcaaatactggacacttcaattttttttctttgcatctggcaataaaagcattataaagccataattggaacaataatcatttccatttatttttatgccattgtgattaaatcaacattttaagtcaactctttattacccaagtttatcatttctaagatgaaaatttgaatataaagcatgattcagcaattctattacttgcagtccttaagtcatggagatcttgaaaaagtcctccctcagctataatgatgagccaaaattaattaaggcaaatgaatattctaaatgaatctcttcctcttaactattgtttaaataattgcttatgcttgacaagatatttttcatgaactatcaacaatgtgatttgaatcacactcataattacaaactcctcaaccatagtaatttataaattactgccctctcatgggactgtcttcaaacatttaaaacatttattattgagaagttctgttgagctattatagtgtattcataattttctaagaccttacatttcttccaaccttgtcatctggctattttaatttttagttttcattgaaatatacttgataaaattctttgtcacatttggaggaaagacatattttatagcttgtttagaaaaatctaatttactcagttaatgtctagcattctcaattctctcaacatgcggcagtagttggctctgtcctggagacaaaataattactgtcccatatatgaagagatcaaattattttcaaagaaatttttatagaatccagttgcaattcactttctaaaatacggagtcaacaataactgacagctaagcaggtggtcacagaggaaaattaacagaatatcgttttgatcagttgcactgtaaggtagaattctttaattttgcttgactgccagtaaacttctccacattgtctccatatgggcttatattcctcagaacagttagccctgagtattctttagaaagatgtgtgtggcactgttctctttttatggctgctgtgcctgttgagagccccaggttggtaagacctgaaaattgtgtaggaagaggtgtgaagcaatcgttagggaaatcagtgaaagaaaaataacctaatctatttggtgttccagaaaggctaatcccctctctcctttcctgaccttaaaacagaggaacaggtcaagcacagtggctcacacctgtaatcccagtactttgggaggtagagccgggtgggtcacttgagcccaggagttcaagaccagcctgggcaacatatcaagaccttgtctccataaacaatttttaaaaattaagtggggcatggttgcacaagcctgtagttctaactactcaggaggctgaggtaggaggactgcttgagcccaggagtttgaggctgaagtgagttatgatgacaccactgcactccagcctgggcaatagagcgagaccctgtctctaaaaaaaaaaagaaaaaaaaaaagtaaaaataaaacattctgattttaaatgagagggatatctttgcatttaacatgaaaaatgtacacctgtgcattgtcaacaaggttatgcttttgttggctatctagacctcaatgatttatctgtcattaatgccactggtcactggcccatgtttccagtagcaagattgaaaagaggaagacgtatgttactggggggtctctaatccctcacctggactattctaaggtaaatggtatcttatattttttttattgtttggttggttacttgtttatctgatttttatgtttgcttttttttttttttcacagtccctgaaacactgggaaagatgcctcttaaattactgctattttgccctacaactggtagggctgggttctgtagctgcatttctaggtgctagcaaatagggaataggcagcaaagtactcttgggctggactttaggcagtaggatacgtctgagatgtcctactgttgatctgggaaatagaaaatgtagttcaaaagtttccaagtatcgggcttaataaagcctaggagtcacttattatatggtgaacaggtcccatgtcaaccatgggaaaaacaaggtagtttgggataacaagattacatgtcacagatttcttttctctctatttaagaaaataggctttcttcctaactctgtggctattggttgaaaatggtttttctgtctttagtgctaacttactaagaaaagaactatgggcacatttaaatagacatgcatatttgtggtagatccagaaatacatttgctaaagtttggacttaaaaatactaaattattccagaaagggctgaaattttctgaaaatgtcataactgttttgatgaaataatgccaattatacaatgattagtaactaaattttttacattgtttcttgaaaacttgaataacaaatatatgagaaaatagaataccataagacaatacattgtgttgtgttaactgaggcaaagaaaggacaaaaaggcatatattttaaaaatcattgttgttggtacaaatggaacatatatgaataggtattgtggagatgggaatcatggtgcaattttcctattttaactcattactgacaagcattaaaataatgtttcggctggccgcggtggctcacgcctgtaatcccagcactttgggagactgaggcaggcggatcatgaggtcaggagatcgagatcatcctggctaacacggtgaagccccgtctctactaaaaaatagaaaaaattagccgggcattgtggcgggcgcctgtagtcccagaggctgagggagctgaggtactcgggaggctgaggcaggagaatggcatgaacccaggaggcagagcttgcagtgagccgagatggcgccactgcactccatcctgggtgacagagcgagattctgtctcaaaacaaacaaacgaaacaaaaacaaaatactgtttcattattcccacattccagaatgttctgttttagctattacccataacaagtaaaactagaactagactgggacctgggatactttggttctggtgctaactcaggcactaactaggttgaaagaccacttaaactttctgtatcttattttctcatccataaaattacgtttacagtaggtgaaggtaccaaatggatcagtctcagatttaccaaccccctgaatttttaataaaaatatttgcacatgtacattttttctggaaaaaaaagcccataattttacctgattcacaaagaagtttatgatttcccaaaggcaaagaaagcatagcactaggtgctttctatggttccttttaaccctgtatacattaccaacttttatacacttactacacgaaactcatgtgttacatatctgcacattcataagaacgtacatatttatgcaaatacataaagaaccctgaaaatttggctctaattacagatcacttttcaagggtggaagccattttaatgtaagatgttattctgaactagaaatgttagcatgttttgtctgcgatttctatgagctcagagtcccatttgataatacaagatttatgaaaatcaaagatatgtttgcctactaataaaaatgagtcatcttaaggaattcttccatggacccaacaaatatttattaaatgcttattatttggctgatatcatgctaggtactaattttctgttatgattataatagacattttctactttcagtctaataaggtagatgactattacttaaatctttaattaactttaataagatagatagagatccacaaattatagatttgaaactgttctgttttgagagcagtaggctgtattctattacatttttgccccctttggatctcatgtgcaaagaacagaattggaatcaacatgacctttagtttatggcacatactcatcattatacatttatccgtgagttccttggttttattatttttatacacacacacacacacacacacacacacagagagagagaaagagagagacagacagagagacagagagagagagtgacagaaacaaattgaaatctcccactgagacaaaagctgggaacacaagtagctaggatcaaaactatgtgccacccctgttccccaaactcattcccttggctctcacagatgagttaaatagtaatgaagggatgagaacctagaaacagattcctatgtggagactatgatggatagtaaggagacagactaggaaaacttcagtacgcaataaaggtaaatatctttcagacactggggtagggaaagatttctgaagtgagatacccaaaaagcatattttaaacaagagcaatgtgagcatttaaaattgagaattttattcatgaaagataccttgaagacaagttacaaaggaagataatatattcactatataaaccaccccaaaaaaactactaataagactacataagaatatgtaaaagcccaagttagtagaaaaacacatgaaaggatgtttcacagaaaaagaaacacatatggccaaaaggatatattcaacaatcgactgatcaagtaaacaccaatgataactgcaataagaccccattgcattgtacattccattggtgaaaatttaaatgtctcatatacaagtgttggaggtaatatggatccacaattatacattgtttgacagtgtataaattggactaatcaagtttgaaaactgtttgacatagtctcttaaagttgaatattcttggccgggcgcggtggctcatgcctgtaatcccagcactttgggaggccgaggcgggcggattacctgaggtcaggagttcgagactaccctggccaacatgatgaaaccccgtctctactaaaaatacaaaaactagctgggcatggtggcacatgcctgtaattccagctactggggaggctaaggtaggagaattacttgagcccaggaggcagaggttgcagtgagtcgagatcatgccactgcactccagcctagccaacagagagagactctgtctcaaaaaaaaaaaaaaaaagttaaatattcttatacttcatgacccagaaattccacatgtacacaaataccccagagaagccttggtcatctaaccagagacacatgtatgttaatagtagtaccaaccaagatagtgataacctggaaataactcaaatgtccatctataagagacagtgattttataaactgtgatatcttcacacaaaggaatattacacagcagctaaagcgaatgaaccacaacaatgcaaaaattatggaatcttagcagcattatagtaagtgaaagagaacattccccaaatatttcaacagtatggttatctctttataacattttaaacaaataaaattaaaataaatatattttaggaaaaaatactgcaatcagactatatacaaataaagcaaggaaataatgaaaaaagctgggatcagttttcagccctaaatctatatttccctatgagacaaaaaaaggaagaaaggaaggaagagagggaagaagaaaggaagagagtaagctagtaatcgccttacatatatttgaattatgaatgatactaaattcatttctttttacatgcaaattacccccagggaataacagcaaactggcttaaaaatgtctatttgtaacttaacattcattttagatgacttgtacaaatgaacttctttctctccatttttgttggcaacattcaagcaagaaaaggttaaatgacttgtgcactgggaagaaaaaaaaaaaaaacagttgtcatccgtggtgccaaaaatagaagttctgatttccagtcctgtgatctcaacagaagacagaatgttcactctatctgactgatacaaaatacaacttctccaaggactctattattttgaactactgtgtaagtacatgtaattataagcttctggaaatacgcactgtttattttatcatttgtaatagcaaatagaaaggcttgggctgagcatttacccaataatgacactaacagccttcagagtcattatagatgatttttaagggtctgtttagatatccttaagatcactgacccattagtgcaattatagtttaagatggttcctgtacttgctgccagaaagtgacaagttgatgttacaaacactctctacacatcattaaaaatgtgtctttactcagagaaagctgcagaaatagaactataactatactttaaaattctgttccccatgggtgatgtagtcattctctttttgtaattcctctgataaaatgataaattatattctcagaaaattgaataaaacaagtgtgtctggagtttgttcctgctggtgggtttgtggtctcgctgacttcaagaatgaagccatggacctttgcggtgagtgtgacagctcttaaaggtggcacagacccaaagagtgagcagcagcaagatttattctgaagagagaaagaacaatacttccacagtacggaaagagatctgagcgggttgctgctgttggcggacgtggccagcttttattcccttatttgtccccgcccatgtcctgctgattggtccattttacagagtgctgattggtccattttacagtgtgctgattggtccattttacagagcacggattggtccattttacaaacctctagccacagagagctgattggtgagtttttacagagtgctgaatggtgcattttacaaacctctagctagtcacccagcactgattggtgtgttttacaatcctagctacagagcactgattggtgcattttacaatcctcttgtaagacagaaaagttctccaagtccccacacgatccaaaagtccagctggcttcacctctcacaagtacatttattctgtagtattatttttatcaatttaaaaatcttcatagtacttgtctttcttaccccattcacacagtctcacacagttacatattccaagtatccatacatgctcagcctttcatgtagatgcaatctatgtgaagaaaaacatagattgcttgctatgtaactatagattcacagaaccggaaggatcacaggagactgactacctagtggagcagtgtttctcaactgatattatagaccttattaattagtctttatttgggggtaggagggggtgggatagagaggagatatcatggacactagaaaatctaatgaagtttgtgaagttatcccaagaaaaatccactcatgtgtgtaaatgttcatatcatttatttatttgtttgcatttgtcattgagttatttcacattttacaaataattatgtgactcatttttcttgtgaaaattgatgacctctttctaaataaaacataaatgcaaattactaaccaaatcatataaaaaaagaaaacatatattctgcttaaaatagttttcaatgagaaggctgttttatttggcttagtaagaagttaaaatttaggctactctggaacactttgcctatgggatagccctgctgtgtctatggagcagcccaaaaaaaaaaaaaaaaaaaaaaaaaaaggaagaagttaaaatttagactgagccttcctttataggaaaatatcggtgttatttttagtatccaaacaatttttcatctgttttaatagcactatgtgctcaaagttgcagctcacacagctttcagtatcaaacagaattaaattccctatcagtcggagcagagcagacgtttatcaagacacctgagctttctccaagctacttcagggtgaattcaggttctatgaaaccctttgtcctcaagtcaaatgaaattatttttggaaagcttagtgtcaacaatgcagccttagtcagcaagggaagatgtttgaatgctttcaattttatgtagtctaagcagaaataacctttaaaagagttttgtagtctttacagatgtttgtagatcttctccatggataaactgacatgtctttctcattttcaactcccttgccctcactaaagtctttctttcagcactttcatgtcaatggaaaggtcacaagattttacctgtaatttcttcctccaaaatgacagttgtttccagagccaccctactagaccagaaaatctgaaattgaaagactagcctcatttttttttgacctaacatctacaaagaagtccatccatgaataaacctctcttgtcaaattgttttaagattcagctctcttttacttaaaaaatagataaaatgaaatttctgacccaagttcagccaagtgcattaacacttattcattggaaagccaaaaaacttctgatagtaaaaataatacattttgcttcattcccaaataaaaacttttgaaactctagatttctggctatgtctgtgaaattattttaacagagcaggcaaagcatctttttagaataattatcagtgtctttcacacgaatgcatgctgatggtgagggcaatatgtctctatgaaaagtggaacctctgtcttcaccagattaattacgctggatcttgcataaagaaactccatatgtactccatatgtacttgcagtatcaagatttttgttccattaggagttttgcttgataaactctgttgggaggaggcaacgcacacacacacacacacacacacatacacacacacagacacacacacacacatcgacattcaggtgagagataaaaatcagagttttactgaaacaatcatagttttcactcagttgcatgccaaatgggaatgccacagctgttattttcactataactggctttgaaatattggcaaaataccagagttcaagagtaggttctatcaagtgaacagaggtgctattaattttttttattctaatcaaccaaccagctcaagcatttctagagtacttgaaatgataaagctttctccagttatttatggtttcttttgattggaaacatgtcaaaagtttcatgttagtgcaaatataagttttggtaaatttccatccttttaaaattgaacttcttctccaggggaaaaaaatctatattgtgtgatttattttcaggatgctcagaaataagctttcttgacttcatcctatcattggcaggaaacttatcacacaagaaacagtctggcttttgtgtcccatcacatttagcaatgcaaataaaatcaaaggaaatgtaggagccatcagctttcttttctctgacatttgccaacttaagctaagtttaatgtgaacagaaagagatatgcacaaacataatgtcagatgcattttcattaattctgatgaatgcaatgccattccagatgtcattgtgcaaggatagtaactttgtgtgaaaaaatacatgctactctgtccatgtttaaaggaaaacattaaaatattttaaaacaataaaaatattaaaacattaaatacattaaaaaaatattttaccatgaacaattttttgcacaaaaagcaaagaaaacaaaataaagctaagttatatatatatatatatgtacacacacatatatatatgtttgctcttacttaacctacaacataaagtctgtatatgatctttaactaaaatatcccttttataacgtgatctgaaatacagcatctaatctctgctgttgttatataggaagtttcctgtattacaaatgagcccatttgtaatagttgggtatttctagttatccttggttatctggttatccttggttattcttccatttttcatccagtgttctggcatggttaattctcttgccatttatcccatcaactattgggtggtaaatcttatgttacacattacttttctctttatgtggctgaatatcaccaagttcttaacttcttgtcatctaacaaggtatccagatctctttctatgctggttgcctttttctacaaccactacaatgtgttaacatctatctgaaaatttggagccatccatttaaaaatattgcattttttgaatgatcaagaactacatacataggtacatattttattgaatatataggagtgaaattatataaagaaatgcaatgctaatggtttctctaaatattcttttggatttttacatatacgatcatatcatctgtgagtaataacagtactatcatttttctttcattctttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccttttctttcattctaatacttacacctattttatgtttttcttgacttattttagtagctaggccattcagaataatagtcaatgacaatggtgattcttaactattatttctaattttagctttttatcacttaatccatcaaaatttttacaatagctacaatttcttaatcgtcaactctttaagctaggcactgtattagtcaaggtatgtaatctgctatctcattttatttaatctttctgacaatcctatgtagttattattgtcttattttatcttaaaaaagagaataagcaaaaccaagatcacagaaattaagtaacttggcactagattacaaaatgatgtggtcaagcaaggatgtgaatccagatttgtcaccatccattgccaatattctttctgcacttttccattatattacaataagctatgattcagtatcagctttacttccctccctccctccttccttctttccttctttcttctctctctttctgtttttctcttctttttccttcttctgtttttcttccctacctctctccttctcatccttcactcgctcccattctttcttcctccaattcctctttctcctattatccttattttatctcatattgtcactaatgagccaagtatgtattttcttagggtaattctgaatctaagttgtatcacccaaccaagcattgactctctcataaagctgattaagttttccttctatgttttcatccacacagtagattaagacattaataggcattaatttgaaaagcatcaagaacaaaaacttgtgtcgtaatgctacttctcatatggttgtgaaattagggtgcaatagctcaatttattttaattattgatggtgggataatgaatataaatataccagtcttgtgtgttttcttcgattcagcttatggaaaccaccatgtctcttcctatctgttattcattccctaacctatcaaaacaccatacttagggatactgtgggatcctactctttaataatgataaaatccattgattgtgtaattattggctaccacacactgtactaggtagctgcacatacatgatatttaattagcaggatcagtgcaagactggtggtattagtccattattttaaactaaaaaatacaattttagagaagggaaaaataggtagccaagttgggattcaaactttggtcaatttgaccacaacactactctatgaacttagcttctgtctctgatctgacagaatgtctcacggtgacctttcccacatagccctcttgggaggcattgtggtgaaaattcccattcccttcaaaaaataattctcactggggaccaggagcacttgaacagtagacggataaactccaaatagttctcctatcttgattatatctttaagttcataagacaaaaaaatctctttataaagataataatgaaagtaggagaaaatgagagataatcaagaagcaaataaaatttgtgacctaagtttctcaaaattttaaaaattgtgaaccgtctaatggctataggtacttatattggttacaaatttcatataagttttcaaagatgtatcacagtttatacaacatagttttaaaacattttgttttacagcaattaaaggattgatactgcttataaccttttgccaaagtagatttggtttgatcattgtgtatcaatgtgtgtcaggagagcctgggtaatgctgatgtacaataatctctaagtcttggagatttagagtaacaaagatttatttcttgctcagactacatgttcataaaaggttatctagagtctctattttttattttctcgttcttaaaccagactgattgataatttatcatataaaacattactagtcgtctagcaaaaggaagagaacatggcaaatcatttacttattcataggctcccatgaagaagtggaacatatagcttcttccactcacatgtgattggctaaagcagttatcataaccatagatagctttagataggacggagaaattcaactgtagcatgcacaaagaagtagagaactgacccagttttgaaatcctattatcacaaaatgacagtcattccatatagggttgatttattttcttattctatacttctactactttagaaaatactaacattcaatttggtgattagccaaagaaggcagttcttggtgattatgacattgtgttctgcgtttttgcttcaaacctgcaaatagcagttataaatgtgagagtaagtccttacaacagaccactgttagcagcacatcatcctccaggtcaatgagcacatcatcctgaaaagcaggagcatgaatattttacaacttggaagatgatgatagtacatagatttttaatttttttattactttggttgccacaagaattcctttgtactctgtattctttgtattgtttgtattagatgtctccttaaaatatgatcacttatacatttattgatttctttctctgaggtgcaaagaacatgaagttttggggcaaagtctaattcttgacaattgagctatttgcactgcaattcagttgtcttcgggaattctcttattaaaaaatcaacatttcataatcatcatatttcaactctattaataagtttaggctaatctagctaattaatacagcatgaagctaaagcttgaagtcacttgaaatcagggaaatgatctttactgagaatatcggtaccataaaatatttatttcatctctcattcaaaaacttgtgtaaatgtgctcttatcagccagcacatctcattatagaaaagtagtatcatgtgtcagcccatttctctgccatgttctttaaaatcacttgcactgattagatgcaatttaaatattgatcaggggtctttagagatccttcagcaataaaacatgactaagaaaagtgttgcttaccactatctgtattctgtgaatgaagatgtgtgaggatttgcattcaagtgtaagttatttcttgatagaggaatgcctttcttagttgtgtatgtagatggtcttcattcagtactgatctcagcatatattttcatgctttcttacaggttatagaaaaaaatagttaagggagcttcaaatctcttttaaggccatctatttctagttaaaaaaataaaattttatcaaactattctcttcatacaggtgctgcacatatgccaggagctgattcagtggtttcatccaaatgtaaagcaaaatatggaattatttcaacatataataataactactgttacacttatgtaaggcaataaaaatatttttggcaaaagcttgtcctgctttcttttttgagcataatttatgttttacaatcttgttggcaaaagtgtgacctatgtctgtttttgttctggtgagtgcaactaagaatgatgccactgtcatttttgttcttttctctgttttgcatgacaacattaataactttcacaaggaaaagtattaactagcaaatatttctgaaaaactcagataaccacaaagattctgagcattatttgaataaaaaactaaaacttcaaagttttttttttttgccagtattacaatcagtacccaagacaccagaagaggaagtattctaggctcactataatgcaacttcgagacatttattatcatactttatagctgcaattttctttactggcatttggtttcacctgcctggcaacatgcattcatattttatattttaattgaagaccttttcactagaaagattcataatattattcagaattgttgtttatatattgctactattattatttcccacagtaaatgtaaatcaacacaataagaataataaagaaattccaaacttagcaaatataaaccataacatatgaatggcataaaatgttagccaagatgaagtaatcttttacacttcctgtataacgtgcattgcctttaagaacaaaattattactaaggactttactgtgaatataaaattaatcttactagttcaaatttataaaaatgtaaggtagataaattacatcatctgctttccctgtgaaaatgtcaaactgtctatggatcagttatagacttctatggactaccaatgacacacatacccactttaccataggaagagtttgttagatgtatttataatgcctatacaaagccctcatatttattttccattttaatttcattctcattttccttagcaaattctaaaataaaaaaggctggtgtgtttatttgaacagatatccataacacatttacatttccagacccaacttctcccccagccttcagacttagatgcctgttagacatctctgcttggatatctcaaaagcatcatcaacttactatgtccgtaacagagctcctggatagtcttctgcaaaactagtccaccttattataacatcattcattcaattgttcaagcccaaacctaagattcaatagagtcttctttctttgacatcccatatcaccatctagttcattaataatttctgttgattttgctctcaaaaatatatatctggaatcagacagcttcccatttcacagtgctgccacctttgtccaagttgctatcatcttatctgtcactcaatctactcactactttttcactagtctctctttgtttctacttttgtactcacacttgtagtctcatcacagcatccaaacacacattttcaaaagaaaataaaatcaggtcagaactctccagaggcttcctaccatgcttagaaggaaatccaatgttcttactacatggcctgccaggcctatgtgttctgctctccagctacctctatggagcctaccttgcttattctactgcacacacattagctttcggtttttgcacttgtgatttcttctgcctggaacactatgacccctgatatttctgtgactgttccattacttaattagcttttattgctgatcatattaaataatagagcttcaacatgacccctctaatcctgctttatttctctccagtcttgtcactctgatattgtattgtatatttatttatcatagttttctcccactagactgtgagttccatggtggtagagactttgaattcatcataagccacatactcaatgagcagaggtatatatttgatgtatcctatcctgtggttacttctgtggaaagcagaattctaaggcatagaagagatggtagaatctctaaaaaggaaaaaaaattggtcatcaaatttcgggggaatggcactctgtgaaggaagaaaacagagtatgcgaaatttggccttggtctacagagtgagcacaggagtgacaaccataatcaagaggacgctcatgcagttttgagatattttatacctttcccactgaggggaagctaatgccaaagaatccgtatgctgagaaatttccttacagccttcaatcaaattcataggttaaaacttagagacgttattatggttatgtacttaggttgtgtgcaatattaacaaaaattaaatagtgaacacttcacctgataaatatttagcacaagcacagcataagtcaacacattccagcaaaggtcaaattttacatgtattgcataggcaccagtttaaatctgtagtgagaagttttgtatgtctttatcttggtctttcctgcctagcgactaaactagtattgttgaggcaaaagaatatacattagccacaagaagagttgtaaagagaaaggtggagtaacacaagcattcattggaggtgcctgctctacgctacaataaactctgtaggtagccattggtttcaactgactttggagggaataacaggaggtaattcatcactgaggattttggcagggtaaatggatttatggactttaggttctaactaatgaattattacctggttcctgacggggaaggagtaatgggttaccaagtaaaacaatatagcttgtagatctcaagtggcttcttttgtaaccaattaaattcattagttgaatggtccatcccaccacaagtcaatacaaaattcaaatagtcatttcaacatacttgtttcaccttagtcttcttgaaaccattagtcaagaaaggattacaatgtagatttgctagaaaggcataccagcctatctgtatattttccattgccttagacagtaatgtttagtcagtaggaggttactacttcagatttacctgggagagaattagttagatgttctttttagacaaactcagcccccattaatgataactatttctacctgaatttctaggtggcttcatgtgaccactaaatagcatagactacatgcaacagtcacctgctaggcagtcccttcattggtaccagaagatcaacatttggttttatatgaatgtataaatcctggctggatctaatttagcaggctaaattatattttatcatctgtccaagtagctaaaaacagaaaattaaaatgtagttccaatcttaacaatttcaactgtttgtgtagagaagacatgttttctatgaagaagacatatggctgaatttagttattaaaattttagtgccatacctctcgaatagctgtacaaaactcactctgaagcacttttttgagggattgtagcttgtgcactggtacttctccagattcctgtagtttttccagtaattcaattgctcttgcaacatctgaatgaaaaaaaatgaaaatagagaaacctagaataaattgtatctcatcagctgaaagtactattattccagttggatgatgacattgaaaagcaagtggacttaaattgcataatcagaacttatattcatagctttttggtctcatcttttggtaaaaagtcattttaatttgttccacacatctgtcacttcatacattttctttgatgggatttcatgtaatttgtgtcatacaaatgaatttgaatattatgtcagtaaagagttggacacatgtctattatttattctgatactccaataacgaaactaattcatcaattttgcctctgaggtgcttcctttcagttcaacttttcctttcccatttcagtttgtcatagctacaacgttacatgtattactatgattaatggattgctgtgtatctccgcagtttgcctataaacttcttgagggtgggaacttctctggtttggttaccattgtatcctcagggtatggtatattgtagtgattaaaattaatgcactttttccatttcactgccattgcattatttcaggccctcgtcatctcccctctgtccaattggaattgtttcttctcctccagcctcttcaaatggtccacaaagttattttcctaaaataaattctgatcatgtgcccatctaccagcctttagaacagtactaagcaagagttttcaataacaattattttaaatgcttctctttcacttaacaatatcaaaggttaatgtatcaagaaacatgtagtcttttatagacataaaatttaaaattccctggattatttcatattgccaagagaaaataattcaataaagagtcatttaaaaatacttatgggtgatctcttctacccttgtcactacagtaaataactcactgaaaagccacttaggcatttatgttataggacatgaggttttcgattcctaagtgcctagctccagaaagcatcccacatccctgccatcagcttataaatttatccattcactcatccatccagtattttgagtttctgttattaatgcttggtgccagcttaacaagagtatgatactccctttcaaagctcgcaatctaatgagaaagaaatataatagcacagccaccttcaataaaattgttagcacctcagaatctgggtggggttagcataggtgtaagtatctaactgaataaaataacaaaaagtgactttgatggggactgtctttgaagtagtcattttgactgccaatcgtgggccaaagtagcacaaatcattaaatcaatgtgacactgccagtttccaaagtctgtcttttagtacataaacaggaagtctacatagtcaactggacaaaaccagacacttccgtaatcaataaggtaccaagctgagattttatgcatttctaactgcaaaagatactctacctaggctgcagtaagccatgattgcactactggactccagcctaggagacagagtgagaccctatctctaaaacaacaacagagacaaaaattctacctagatgcccatggatgcatggaactctcagagctcattttttttccccctaaaactcgctcttcttttcctttgttccatatttctaaaaatttctccccccaaacaagccatcctctcaagcaaaactatggtgtttttcacactccccttgcatacagatagtcggcaagtgcggtagattctatcttggaattgccttttgtaaagagccctatcactctcatggaagtcttcatcatttctcacttgcagtactggaacatctcctaactgatctcctttaaattagtcttcttttttcagtccatctgccacattgcttccatagtaattatcctgagtggtaaacctaattattattctcctgcacatcaaaccttccctggcttcccattccctacagagtaaagttcagagcacttagggttacatataaggcccttaacggccgacttcttctcgctcatctcagaacacctcctcctgtccatcctatagtggggccatcccaaatttttgctatttctaagacatgccacagaattccacacctatgttttggcacatgtcatcacctgttcctgaaatgcaattcattcatttatgcagtagtgctagccctgggctgtgcacaggagacagtggtgaaggagatagcccctttctcttgctttcacggaactcacaggcttgaggggcaggggtcacagacatgcaataaagtgggtgtgttctataaatgaagcactacaggattgtccatggatgtataacaaagacatttatcatcatcaaagaagtcagggaggatctatttgtggaaataactgctaagcagagtcctaggtaggaggtgtaagtggagaaggagggaagaatgttcaagacaaagggaataaatgcagatcaaaggcttgttaagagagtgtgggatattcaaagaaataaaaggcgtttattatagctgaagctgaaaacagggtgagagtagcaagagatgagtggcaagagatgaggtagacagaaatcacatcatggtgggtgtttaaggccatataagggcagacttggcttaaaaaccatctcctcaacaatgtcttccctgactctctgaagcagcttcagttgctatcatgtctgcatttccatagttctttgttcactcatctattataataattactaccctctgtttgcacgtacatctccctcctttatctctgtgaatgtatacaattcttcagatgtcagaaacaaaatatctcattcattgcatccacagaattccacatccctgtgtcttggcacatatcatcccatgttcctaaaatgcagaatacctaacaaatatcaagtgttcaatgcatattcgttgaatgaatgagggattaattgatgagactggctcaggaaggcaggtgttagaggtctatgtctgtgtgaacctgtaacttctcatgaatctagaactccagattattatcagccttggttaagccttgcttggatctggactaggagaaaaaggcaagcctaaatctgcaggctgaagagaattagagactacactgggtgaagtccagcaaaattgaaaatgatactatcctgaatatttttagtagttctcaacctgggctgtgcattgaaattatctagggtgcatttagaagttattaatgcctgagacctatgacaaacaaattaaaccagaatctccagaacagtggttttcaaccttaactgcacattaaaatcaaccagagaggctttaaaaaaacacaaatgcctaggtcggtcccacctggagaatttctgatgtgattggcacagagtggggggctgggcatggggctttttaaagcccttcaggcgatgctaaagtgcagccaaggttgagaccactgctctagtttgcatgggtaattttaaatcccctgtgtgattctaatatgcagccagggttgagaacctctgctacatattattggttctaaacacgaatgtgtttaagaatcacccagaaaagcttattgaaatgcagatgcctaatccttaccccatttgagagatgttgattcagaaggtgtgaggataagaccccggaatatgccttttaagcacaagttcaaagtgattcttagtgattgttagtttacagaccccagagagagaaaagtgaatgaaatgatttttttaggtttctttcattccagaattccagaaacccttgtactctctattattctttaatacagtgtgtaacatggtgctgaatgggattctttgaggagtttcagaatgattcataaaagcccacagatgacagcaattagtgctaaggcggtcgttagcaaaggctgctcattggaatcacccgtgaaatttttcaacctgacctactaccacagaccaattaaaccaaaatctctaggagtggaatctactaaacaagttgttgtttttttaatttttgttttttagcttccatatgatttctaagaccatcaaaagctgagaaaaatattgttcaaaaaagagccatcaaggaaaccagacacgtctccattaagacttataaaagctgagccaacccttttctattacaccacaggcctttcccagtcctcataaaagatcattgggagataagagaaaattcaagaattgttaaatcattaatttgacacagtactaggtcttttgcttctcttccaacaactaagtaaggaaggctctgacagaaacaattgtagctagtgggcatgcctgaaagaagggaggctagcatctctttcctcgtggcataggcaatgaacttggtgacccgcttgccctctctgtctgagcagagggagacagctaaaaagcagtgcccaatggagcctaaaccatcttgaggtaccccttaagccatctagtgggtacccctccaaggaagtcttgcagtataatgtcagggatacacagcaggtggtaaaagccaatggaagtctgaaaaccagaagtgggagagatcaagttcctccagccaggcctagccgttttggaaacaaataggtgggagtgataaatggatatgaggctggagttttaaacagaattctgattcccttaagttctataagaatatcagaaacctgcaaggctaggttccagaaggaagcaaaagaaggcttcgagtcagcaacatacttttattcttaaatccattggaataaagtgtgtgtagtttatttataacagttcccttaggttcttgttcagaacctcctgatgcttgttttatgaaactcttctatcacatttgattagtaacagagaagtttgcgtttactggtataactcagatcaagaggaatattagataagaactggggaggctgccaggtaagcacaaggaaagcaagaaggattattttcctagaacctactcctcctattgtctgccacctctgatgaataccactctcccaatgcatgaggcaaatacttgcatattacacttgcccctttgctctccctcacactccctcacactttcatcacacttctcagaatggtgcacaatttaaaatttatgcattgcttatttctagaattttcgatttaataattttggattgcgattgactgagggtaactgaaattttggaaagtgaaaccacagaaagcaaaactacagataaggggatattaaaaattgagattaaaaaaagagagggagaggtggagccttaaaatctgttttttagtactcatctcagatgattctgatgcaggaagtggttcacaaatgcactctacagatcactgagtttaatacatggtccagaacaaaatgagttaatggccatcatttagtcagagcttacttgtcttacttagatcaccatgtaaaatccttactattatatcaagagattactattatttatactgcacagttaaagaaaaataaaaacaactaaggctcagaaagatgagtcatctggcccaaagctatacacctaacaaatggagaggccagaatccaaaaccagctgtgtttgactccagtgcctgtgctcttgtttattcctctaccctgccacagaaaagggattcaaaataaaataataaagatatggcaaatttagtttttagatactgcaacatggaccattgtgagcttgggtaaacagttataacactgccgaaagcctcatattacattatagtattaccaatgtgtttatagtgataacagtggatcattgaaagatgatcacatcatcatcaactgcctgatagtaaagtgccacattgtcaaaagacttccttcaaaatagctggaacattataaacaaaacaaaaacaagaataaaatattggaacttaaaaatattagaatttaaaagggatgagcttacagtgatctaaaggagttcaattattttttcattctctaatgatgagttttcatgaactcgattgacatttagactgtggaatttgacttatgacgcatccaaagctggaacatggataatgatgcagctgggtcatttaaagttactgttcactaattccacaaaatgtgttgagcactcaagctaacaatatgaattatctatcccaaagccatccacaaccctctaatcgcttgccatcttctactacagaaactgaaaagagaatgcacttctttttccagactctactgcaattttgccaagttgttttaagtgtaaagtcacttgttatggcttccaggaaggcctttgaaatggacaaactgctggcataagccttcaacattttcatctttgcacccttcctctttcccctttcttttgacagatataatgccttgaagtgccttggaggtaaaactcccattttgtgatcacgaagataactgccatgtgctaaggatggtggagtaggaagaaggaaaggacacaggcctaatgtcctcactgagctgttgtactagccctgaactgtccaaacccatgattcttgtctgtgagaaaaaatatatgcttcactatttggttatctatggctttcaaccaaatacaagctagctgccaggagagcaggtgactttaaaggtgcttttctaggtttccgggataatattgatgctatagagacactggaataacctatagtggtcttttgattaagatcgtcatggaagccaatctgggaaaggtctggaaaatgacctttggactgagactggaaatgtcagccatgtaaagatccaaagaaggagcatccagacaggaggacagaaagggcagagatgctaaagtgagggagtaagcctacatgtggaaggtcagacaaaaccagtgttggtggaacactgcaatcaaggcgacaagcgatagtaacagtgatgtcctggtaaataaataacactggctactgacttattactagttttttgaggtgtctaaaaattttaccaaataatgttcagtttaaaaatctaatacaacgacagtgcatgtgtaccaacaacataaaataaatggtaaataatgctttgtacttctatcactgcgatatgaaaggaaactgtcaatttagaagttactaatgagacatgacaatcgatgtgtcctactcatctgaccctcatctctgctttaatctgccaacaacttgctgcgttcctcaaatgcagactaattggcaaacccaaagaagaactggttcaagttaaatgtgttcaaattttaaaaatttactcagtatgctattgaaaatacccaactttatatttgttatcaaaaactaaatgatcatgggatttgggacaacactgaagtgtatcacaaaaaaagtctgacaatactagagtcatgaatttatataatgacaaaatcctggcattgactgctcaaagtgtttgtcagacctactgcaatgaacaatatatgatacaaaatgaaaaactatagttcttaagagattctctggaggtacttatttcatttgaaattgattacctacccaataagcaaatctttaggtatacaaagcttaagatacagccttctttgttaaacaattgctgttatgtggttaaagtcagtaatgcattcccagttttcctaggaactatatttagcatttttttctttttcttctttcctgttttttttaaaatccttcttattttctttcctaaacagctaaaactgaagtttgatttgcctactactacccgagacatcatgaaatcaagttttgccttcctttctgtttcagctttcatttttttctccttattatttgatgtctttcctttatatttgatgtctttccttttttctgtatttttacctcacttttgtatttaatcttgtacatatgtttttacatccttacagccgactatagccttattcctaatcccagtgaaattagcttattttattttttcttgttcccaaaaatgtaatctgtttttacacatctgaaggaagttgaacaatctactgcctgcccttgttaggctaaatactagaacacctgtctcctatcaattttggtgtccagcatagaatcgtgacaattgcagacacctgaaaattgtttgttggggccggatgcgtaatcctgtaatcccagcactttgagaggagaggtgggtggatcacttgagcccaggagtttgagaacagcctggccaacatgacaaaaccccatctctactaaaaatagaaaaattagccggcgtggtggtgggcgcttgtaatcccagctactcgggagactgaggaggaagaatcacctgaacctgggaggcggaggttgcagttagccaagatcgtgccactgcattccagcctgggcgacagagtaagactgtctcaaaaaaaataaaaaaaattgtttcttgaatataattgattgcattaagtcaaatattaaatattgatttattatttgcaaaatcaaaatattgccaatattttctctgattctgtaagttgtttgtttactgtgttgatagtttcttttgctgtgctgaagttttttaagttaattaggtcccatttgttaggttttggttttgttgcaattgcttttgatatctttattatgaagtctttgctgaacctatgtctagaatgttatttcctagatcatctttcagggtttttaaaattttagggtttatatctaagtatttagtccatcttgagttgatttttgtgtgtggtgtaaggaaggggttcagttgcaatcttctgcatatggctagccagttataacagcaccatttattgaatacaaagccttctccattgcttgtttttgtcaactttgttgaagatcagatggttgttggtgtgcaacattatttctgggctctctattctgttctattggtctctgtgtctgtttttgtaccactatcatgctgttttggtttctatagccttatagtatagtttgaagttaggaactgtgatgcctccagctctgtggcttttttgttttttgttttgtttagcattgccttggctatttgggctcttttgtggttccatgtgaaatttaaaatagttttttttttctaattctgtgaagaattgtagtttgataggaatataattgaatctgtaaatggctttgggcagtatgtccattttaataatattgattcttcctatccatgagcagagtatgttttttccatttgtttgtgtcatctctgatttctttgagaagtgttttgtaattctgattgtaaagatctttttgcctccctagttagctgtattcctagctattttattctttttgtggcagttgtgaatgagattgcattcttgatgtggctctcagcttgaatgttgttggtgtatggaaatgccactgatttttgcgcattgtttttgtatcctgaaattttgctgaagttgtttatcagatcaaagagcttttgcacacagtctatggggttttctaggtatagaattatatagtctgtaaacagggatagtttgacttcctctcttcctaatttggatgccttttctttctttctctttcctcattgctcgggctaatccagtactatgtcgagtaggagtggtgataaggcatccttgtctttttctcattttcaagaggaatgcttccagctttttcccatttagtatgatgttggctgtgggtttttcatagatggctcttattattttgaagtacgtttcctcaatgcccagtttgttggaggtttttagcatgatgtgatgtttaattttatcaaaagccttctctacatctattgacatgatcatatgggttttgtttttagttctgtttatgtggtgaatcacatttattgatttgtgtacatttgaaccaaccttgcatcccaaggataaagctttttcgatcgtgatggattaactttttgatgtgatgctggagttagtttgtttacattttgttgaggatttttgcatttatgtgtatcaagggtgttggcttgaagttttcttttttgttgttgtgtttctgccaggttttggtatcagaatgatgctggcctcatataatgagttagggaggagtccctccttttcaatttttttggaatagtttcagtaggaatggtaccagttcttctttatgtatctgggaaaatttggtcatgaatccatctgatcttgggctttttctggttggtatgctgtgtattactgattcaatttcagaacttcctattggtctgttctgggattcagtttcttcctggctcaatcttgggaggttgtatatttctaggaatttatccatttcctctaggttttctttttttcttttcttttttttttttttttgagatcgagtctcgctctgttgcccaggctggagtgcagtggcgcgatctccactcactgcaagctccgcccccaggttcacgccattctcctgcctcagcctcccgagtagctgggactacaggcgcccgccacaatgccaggctaattttttgtatttttagtagagacggggtttcaccgtgttagtcaggatggtctccatctcctgacctcgtgatctgcccgcctcggcctccctcctctaggttttctagtttgtgtgcatagagctgttcatagtactctctgacgggtttttgtattcctgtggagatggtggtaacatcccctttgtcatttctaattgtgtttatttggatcttctctttttttatttattggtctaggtagcacgctttctatcttattctttcaaaaaacaagctcctgaatttgttgatcttttgtctggtttttcatgcctgaatttccttcagctcagctctgattttggttatttttttgtcttctgctagctttgggattggtttgctctggtttctctagttactctaggtgtgatgttaggctgttaatttgagatctttctaacattttgatgtgggcatttagccctataaaattccctcttaacactgctttagctgtgtcatagaaattctggtatgttatatccttgttctcatcagtttcaaagaatttcttgatttctgccttaatttcatagtttatccaaaagtcattcaggagcaggttaatttccatgtaattgtatggttttgaacaattttcttagtattgatttctatttttattgttctgtggtctgagaatgtggttgatatgatgttggttttttaatttgctgaggattcttttatggcagattgtgtagttgattttagagtatgtgttatgtctggcaagattgtttgttgaatagaattgattgtattaaatcaaaatttcatattctatttatgtaagtatttgtattcactagttaacaatgataccatgtcaaactctatttaacaacatttagaattcttacaaatatgaattctaagaagatgaggatttaaggaactggactccatctttttataatgattaaatataattgtctaagtgaagcagaaaagaaccgaagggtatgacttgaaaatagattggagttcattttattagcacttatgaaaatttttagggaagtcatttttaagctttctggggaagatattttaaagtacattatccaaactacaacagtttacatgcagacaaacttttttagaaaatgaatatgatgggcacttaggcactacctaattaagtacactagaagtacagctgtaggaataaaataaaaccactatgtaacagattagcaatatgatataactcaacagtgcactgctggcttcccatcctgtccatccacactattccttatttacattccatctatgacctcaattgattttagatgcagctaggtgaaaaaacagaacacctttcacagagcttcaagtttaatttaattcgaagtctatgtattttaccttttcttccctaatttcttatcggtctaatgatctctcaataagttaaataattattgctggcatgttaaaatgcaagccacaaatatataccagttgtaatatttccctaacttagtacataaaaaacaatctaccttttatattggtagtgttccatctgtgcgcattgtaaaaattgagagattttttccctgtaattattatcagtaaatcccagttcccttttatagtgttcagggaattggaagagaaaatctatcaggaaattgctgaagagacaccccatcaatttgtctgggtgtttttggagagtttgttataaagaaactacaaatttaacttttcctgtcctcaaatacatcctatactagcaaatggatgaatatttttatctaaactgacactttgatatataattctgctgtaaagctccttaataatgtttcctcttttaccttatcattactatatcatactgtcatccgttttcttcattactttgagagttgtatgatgaggttagtgtggtgctatctacatctttaaggggtaattagagggcaaagtaaagcttgatgtttgcagaagttgttatggtgaatagtgcatctattttattgagaacattatcactacagggcagtataaaagattatttatagttaatttttgtatatagtgaaaggcaggggtccagcttcaatcttctgtgtatgactacccagttatacccaggaccatttattgaagagagtgtctttcccccattgcttgtttttgccagcctttttgaagatcagacgattgtaggtgtgtggctttttttctgagttttctattctgttccattggtctatgtgttttttttttttttttgtaccagtaccaaaatgttttgtttaatgtggctttatggtatagttcaaagtcaggtagtgtgatgcctccagctttgttctttttgcttaggattgctttggctatttgggctcttttttggttccatttgaagtttagaatagtttttttctaattctgtgaagaacgtcattagtagtttgagacgaatagaaatgaatgtgtaaattgctttggacactatggctatttttatattgattcttccaatctacaagtacgggatgtttttccatttattagtgccatctctgatttctttcagcagtggtttgtagttctccttgttgagatcttttgcttccttggttagctgtattcctaggtatttcattttctttgtggctatggtaagtgggattgtgtttttgatttcactctcagtctggacattgttggtgtatagaaaggctactggtttttgtacattgactttgtatcctgaaactttacttaagtcatttatgagttctaggagacttttggcagagtctttaggattttctaggtatagaatcatattgtcactgaagatatatagtttgacttcttcttttactatttggatcccttttatttctttcttttgcctgttgctctggctgggacatccagtactatgttgagtaggagcagtaagagtgggtggtgttatcttgttccagttctcaagaatggtttgacctcttgcccattcagcatgatgttgtttgtgggtttgtcataaatagcttttattattttgaggtgtgtttcttcaatatctagtcaacaaacattgaagaaacatacctcaaaataataaaagctatctatgacaaacagactagccatcaaagaaatgtactgctttaatatttaaacattatcaaaacattaaaacattaaaaaccaattggagtactctattttataataataaaataaattaacaactgagagataaaaaattaaatgtaaggggcacaagtgcaattttattacatggatatattgaatagtggtgatgcctggggttttagtgtagctattattgtctgattgatgtatgctgtacccattaagtaatttttcatcacccaccctcctatcctttcaagtctccagtgtctattattccacactctatgtccatgggtacacattattttaactcccacttataagtgagaacatgtggtattgactttgtttcttagttgtttcacttaatggcctccagttccattcatgttgctgcaaaagacatgatttcattattttttatgactgaatagtattgcatggtgtatatataccccattatctttacccaattattcactgatagacacttaggttgatctttgctattgtgtgataaacatacaattgcaggtatctttttgttataaagattttttttttcctttttgtagataaccagtagtgggattgctggatcaaatagtagtagagttctatttttggttctttgaggaatctctatactgttttccatagaagctgtagtaagttacagtcctatcaacaatgtataaatgttctgttttctctgcagcctcatcaacatctgttatatttattgactttttaatagtagccattctgactgatgtatgatatatcttgctgtggctttaatatgtatttatctgatgattagtgattttgagcattttgggattttatagagtaagtataaatcctagtcctagactttagatatttttctgtgtttataacaatcttttaaacttttttctatgtgggcaagaccatcactaagcttttgtttttctaaaattaaaatgaaaacttatgaaaataactcaaaataatataactaaattaataattttagcttaaataagagcatatagttgtaaaatttatttatttttaatcaacaaaaaaaattgcacacacattatatacaacgtgatgttatgaaacatgcacatactatggaatggccaaactgtgccaatccacatatgcatcacctcacatgctagtcatgtttttatggtgagaacacttaaaatctactctcctagtgattttcaagaacactatacaatgttactaattaaagtcaccacgtttaatgataaatttcttaaacttattttttctatctgaaattttgtatcctttgacctaaatctccctagcccccaccttctagtaactaccatgatagtccctgttactatgagatgaattttattatacacataaatgagatcatgcagtatttgttttcctgtgtagcttgtttcccttaacatcatgtctttcagatccatcatgttgttgcaggtgacaggattttcttatttttcaagactgaatgatacatgaaaatgtggtatacatacacaattgaatataggttgaatatccctaatccaaaattcttgtgactagaggtgtttcagattttggatatttttgattttggaatatttatatatacataatgagatgtcttgggggtggaacccaattttaatcataaatttttttatgcttcatatatacctatacatgtagctgaaggtaattttatgcaatatttttaatagttttgtgcatgaaacaaagcttgtgtacatgagatcaggtgtggaaatttttattcacattttttttcaaagattcagcaattagttttttgaaacatcttttgctccatgatcatttacttattattacttgcttttatctgtattttttctttatcgtttgactagctgagtgtctgtgtgtgtgtgtgtcttttaatgatcctacatttcttcacaattccaatctagtgacatctcatatagagatcatttctttctaccatttaattttgatatcttctttaaagtaagtgttgtttataattttaaaatttccaaggattttttttttttcttttgaggcagagtgtggctctgtcacccaggctggagtgcagtggcgtgatctcagctcactgcaacctccgcctcccacgttcaagcaattctcctgtctcagcctcccaatggatatggttttaagaagattatacttctgcattttatattttaattttgttatacattggtcagagaaaattaccagtgttatttctcattttggattttaatagcatttttggagttacatatggtaaatcatccacagatgtttaaaaataatagataatacagacacaaacatatataatatatatgctaaagcttgttaaatgatttaatgaagtctcaaatagccttattttattttatctccttgagctggcaatctttgagaaactggttgaattgctaatttttcccactaacagtttttgcctcatacacatgtatttcaaagctatggggctaggtacatagttggctctaggtttaggatgctaatggcatcttggtaacatttctctaagttaaatatcactctttcacatttaattttggcttgaattctattttgactgatattttaatattatattgctgtatttttgtgttaactttttcctagtatttcattttctatttctttattttcaaactttctttttatgattgtctctttttcatagcagcttattattttcttggttgtctctggtatttattttctaaagcatataatcaaatcattccattaattttatattcttggggataatttattttagataagttctttcataaagatgggaagtcctcaaagagctagtatttttttgtttttatttaatatttgtacttaaagatttagattaaattgtatacctccataataaaattggtattttcattctcttgtcagtagatacagtttctaataataagaacctgtttctagggctaggtgtgcaggtgtctaaagaatggagtgttctgcaaggaaaaatgaagagctggtttgtcactgggtgtgacagtacagtcactccaggtctttgaaaagtgtctgagaatattgctatgcctcttttcctatctcagctctcactctactatttgcatgtcatacttcagagaaaaagctggggctttaactagcagcaagtgctgctgtttctcagtgtagagaagtgagagaagatagagtggattcacctagtgattccaattcagttatcaagtgtttgatccaggactctctttcacctgttgtctttgagtttatggtttttcttgctttcactgggggttggggggtttgccttgcacttgctttctcaggttcatgctttggggttcctttttctaagaaccacactttgtgtctggctcctgtctaatcactgtggcatcctgacatagtgattagaaaggagccagacgcaaagaagggaacattagacaccatggccttcctgagggtgcagggtgggaggaggtgaggattgaaaaaccacctatcgggtaccatgctgattacctgggtgacaaagttatctgtaaacgaaaccccaacgacatgcaatgtagccatgtaacaaacctgcatatgcatcccttgaacctaaaatgaaaatcggaaaaaaacaaagcaaaacaaaaaagaacggagctaggaactagaaaggtggggaagctaagttttcaggacagataattaggagggtgtctcaaagatcagacttcctggctccaatctcaattcagcatttgcaaattgtgtcttttcagacaattcaaccaacctaagttttattttcagtgaaacaatgatcataatagaacatacctcagagtgcgtgctctgtgtgtgtgtgtgtgtgtgtgtgtgtgtgtgtgtgtgtgtgttgaggattaaataagagaatacatgaaaatacttagcattgtgcctggcacacagtgaatgcttaatacattttactgtgggtgataattaccatattttcactcatcagtctgattttattgtgtgctatctttcaggaattcttcaaaatgtcttgtgtgcagtaacaccctttttatctccagtgccttttaacatttattatttgctttatatctttttgacagctatgatgtttggaatgggaggcaataaggacatatgtgcttaacctactatcttgattcaaatcttcctttcattgtcatccacttacttggaaaatgcattttaacattaaggaaagaacaatggacttggaagtcaacagtccttgtttctagtcctaaaattgtaactgaaatttttgaaatttgtttaatttatctcagcttcagcatctttatctataaaatgagtatttggactagtttatcttttctggctctaaagaataaatgctctgcctaaaaggattgttcatttatcaagagagctattaaattaatagaacacaaaaaaaggctatggaaaaaaagtgatagagggcaatgtgagttctagagagaatggattccatagagtgttacaccaacctggctttttagaggagaatggaaaatgaagaatgcttaaagagtaggaagaaataaagaggatccctatttcaagggaaactagtaataaatataagaaggtaaaagaaaaagaattatttaaaagtgttctagacatacagccaaatttaaattcttctgtgtgcttgatattaatcaatctgtatagaatagacaattcaaattgaagctaccccaatgataatcaaatcagtactcataaatttatagataagcaaaccaaaaccaagtaagataaagttattgcctatgacctaaaagttgagcatttctaagtacttagcctgagatatcagtgatgaagttaaaaccagtacaaagatacttgaatcccaggtcagatcttttccccactgtactactcaatatttaattaaaattttccagacttgctttttccattttgtcttaaatatagatttgtttagttaagatttaagaaatatagacttagatttagtcttaaaaatagattgctatatatacaaacgtgtaccaaccgtaagaatgattccaacattttctaaatcaatactcacatatctactatatcgatgttaaatggttatgaaattcatatgtataagtaatacgagttataataaaatttgatccaggggaaagagtcattaaaatgacctaaatgaatgccacattttaacatatataattatatgggaagtaagtcttatcagagttaaatatctatacacatatatgagaatttattatcaagtaaaatgtaattactggagagagatgacttaaggtattgagactaataagagagcttactgatgcaagaagagccatttctatacttttctgcacttgagacaataatgatagagaataaagtttacctttttaaagctcatacacaaaaggtgatatttttaaaaacagcattctaatagaatgatctcagtgtagtttcaatttgctttttttctctaaatactaatgatgttgactatcttttcatatgcttatttgtcacctgtatatcttctttagtgaagtatctatacaaatcttttattcgtttttttttaaaagttggttattttcttttattgttgagttttaggagttatttatatattttgaatacaaatactttatcgacatgttttgcaaatattttctcctaatctcgtcttttaattttcttaatgttatcttttaaagactaatactttttaatttatcatccttttctattatgatacgtgctttttatatttaacctaggcagttttggactaactcaacgcctcaaagattttcttatactctctattttaaaataatattggtttaggtcttacatttacatttttggcccattttgagttaatttttgattatagtgtaaaggattgaggttcaattttttgcatttggttacccaatttttacagtaccattattgaagaaagctagcttttccccagtgagttcccctggtatagttgttcagtatcaattaagcacatatttgtgggcctgtttctggactgtattctatttcattgatcttacatatcaatacttataccaaaaaccacactatatcttaattactgtatcttaatagtaagttttgaactaaagcagtaatgtgaaccttctctgtcttagtccattgaggctgctattgaaaataccataggctgggtaatttataaatcataaaattatttctctcagttctggaggctgggatgtcaaagattaaggtgctgggagattcagtgtctggcgagggtccactttctcacagatggcatcttttgctgtgtcctcgcgtggcagaaggggcaatgaagctacttgggaccttttttataagagcattaatcccattcatgagggccccaccctcataacttaatcgcatccccaaaggccccacctcctaatagtacggccttggaagttattatttcaacatacgaattttgagtgaacacaaatatttttaccataacacctttcaactttgctcttgcttttcaaatctgttattctatgtcctctgcatttttgtaaattttacatctaatgacaatttttaccaaaaaaaaaaaccctaaaaacacctgttggcattttaattgagattgtcttacatctctgtattaggttactgtgaaagtagttgcagtttttgccattacttttaataatgatttgggaaaaattgacatctctacaatattcagttttccaatcccttgaacaatggtatattatttcatttgttcaagtctttaatttctgtcaacaatgttttgtaccttcagtaaacaatttttgcacatattgtgttaaatctgactcagtactttcctgttttgatgatattgtaaatattaccttttaaatttagtttctaattgtttattgctattatacagaaatacaactgatatttttaagataaccttatattttcttccattactaaagtcacctattaattttagtagcttttttggcagatcccacaggattttctccatagacaatcatattgttggtgaataaagatagtttactccttccattcaaatctatattacgtatttcttttgtttaccttattgtactgactaggacacctcataaaatgctaagtagaagtgatgaggcaaaaaagtgatctttgccttgttctcaatcttaagagtaaagaattcagccttttaccattaagtatgatatctactataggtttcttgcagaaaccctttattgagagagctttcttttatttttactttgctaggtgttttaaaatcatgaatagatatggaattattcaaatgctttttctacacctattgagatgatgatatgatttttgttatggtaaattatttggattgatttaaaatatgttaaaccatacttatcttcttggaataaactccacttgatcagaatacattatcttttgtatgtgtatcctttttgtgtatcttctgctggatttgagatgttaagattgtgttagccactcgtacattcatatccatgagaaatatttatcttagatttattttcctatattgtgtttttctggtttgggtatttgttagggtaattttgtacaactaaaatgagaaaagtgatccctttctagtattttctggaaaagtttgtgttgaactgatagtatttctttgttatatgcttggcagaattcaccaatgaaactgtcaaagcaggaattattctctgtgaaaatatttttaactacaaattaatttttataaacagattatatttattcctttgttgagttaaaacacctgtccagaagatggaggaaatattttggggaaagtttgccttgctcagtgctattcagtacatatgttcactgactctataatcaaaattcaatctttacatacatgaaaatgtgtcagaaaaatttcaaatgtgattttaaggaggttctagagggtggaagtttgtctattttttttttttttttttttttggtggggagaagatgaggtctcactatgttgcccaggctggacatgagctcctaggctaaagagatcctcccacttcaggctactggcagctgggaatacaggtacatgccactgggtctggcttggaaatgcaagcttggaggttgggttgtagactctaagcataagggattaattttaaaatttataaacaagacatttaatcatatggaaagggatatagcaccttaatatttgaccaaataacatagtatttccttgccaaatgaaaacaaatataatcttagaccactagatttcctgaaaattattcttgtaccttttctagttggggagtcattaggatctaattgactcaaaataaacaagcaaatgcaataaatttgaaatggcttgttcaacaaggttttgaatttatagtaaatagcttggtattcttccatttgagagaagattaaataagcttagctttgttttatcttttgaacaagataagatcccagtacttaattcacatttttttaatgcaagacaaattactcatacataaacaagtttatttggaaggcactatttttcaagtggtattaacatgaactattcctgtcataatttactgagtatttttatcttatctttaataatacatacgttgaatacgttaactcaggtgcaagtacttcatcacattttattaatgctttaaacatatttatttctctattaacagataagaaaaaatttaataagccttaggaattccttctcttatatgtgcatctcagtgtcaacacttactaatgcatatacacaatgcaaatgaaacaggaaattagtatgctggtttatcaagcaccaattcagggcagccttactatctttatctgacatttccataatggaatgcaaattcaaatgccaaagaagtttgaaagcagtgactgagaaaaacacattgtttacctgaaaatcattagttatataaaaggcattatgttcttctcatgtatgggggttgggggggatatataatacctaatataataattacattcaagaaacatttgtaactgaattagatataaaatcagtgtggctattcttatcattaatcatagatctccttttaaaaatagactctaggccgggcatggtggctcacacctgtattcccaacaatttgggaggctgaggtgggcggatcacctgaggtaggagtttgagaccagcctggccaacatggtgaaacctcgtctctacaaaaaatacaaaaattagctgggtgtgatggctcacacctgtaatcccagctactcaggaggctgaggcaggcgaatcccttgaatcccagaggcagaggttgcagtgacccgagatcgcgtcactgcactccagcctgggtgacagactgagacttgtctcaaaaaaaaaaaaaaaagaaaagaaaagaaaaagaaaacactctatagaaaatatatgttatacgtatgttaaaatggaaaagatcttaaaggttacccacgccagtctccagaaaaatgcaaaaagaaatcctgtatgtgagctcacctccatacctgcataagcattttagaaattctaaaacattaatttcattcatattaaaaataagaacaaaacactcatgtttcttattaaaaatgttcagaatttattgtttttatttgcaattaaaatgtcaaatgcaagaattcacatggcagagagtgagttgaagaaaacacaggtgcctaattcacaagctacaaaaaacagtataaaggtgaccatctggggaaagctggctgacttaattttcctatgagcttaccgtctgttccttatttctcttccagactccatattctgaccttgaaaatgcatctacatattttgctacatgcatttccttctaaccataaattaacaggtattaaatagatctaattatgcaaaggatataatacaacaaaggacatattatgttgccttttacgtaatctcagtttaaaaaggttttgtttctggtgatgacgcttttcagccttttagccattctataaattcctacactttccatgatacgcctgcaagtgcagacaagcacagttctaagaaacaaatgctgcttataggagggtggtttacaaggtgtagaaaaaagttagatgtctgagaatgtggagacgaggaaacgggagcctgggattgtgatcttgatgtgttcgcaatgaattatgaggcaataccagccggagaaaagagaaggctaaaacagcgaggaattcctggcttatcagaaatcaccgactgctcaagtaccccgagtatgccaggatttcagaaggaagcatcacactttactgccatagcgaatacatatgctgtgtttattaggttttctttttatgtctcactctgaacactgacaatgatgctagtcgaataaaacatacttactttcaactatttgttgccacagcttttcttcaagtagtcttttgttctattctgcattattttctgaaaaaaatctatagctattacttctgtaatgttgctaattcatgctctacttactttgagattattctctatcattatatattatttggcgtctatgcttctgaaacttgcctctaacttagaacacttttcatatatcagtcccaatttatccttggttgtttcccccacatcttaaagctcattaagtgctgagctaaactcatcaacttcatggaccaacatgtttcctctttgacttttttccttttcctcattttcacctcatattagtcaataaagcatgccatcaagatctctttcttcctttcattcccattactcctcctcaagttaagatcagatcatacagattactataataatagagtccaatatcctcaaactattccaaagaatgatcgggttccgtgaacagagtttcgtcgtctgcatattacataccatttggagactcacaaagtatattgtagcctacagtaaagaaacaccttcaattttgtttaacccagtgtttgggaaacccattattttctaatttattttaccatgaaacttttgttcaaggaccatccaataaactctctcagagtaatgtttataaagcacgaatcttccccatacattcaatcccgcaaccaattttcacattagttaataaatacaccagtcagattagttcacttccttactcagaattttcaaacactctcaatcaaacactcccatcaaaagaagcttattaatctgcaactcgcatgtttcacgttatctttcatgactttcttcatattgatagctgcccagatgttaagcttagcatccattgtactaaaactgcccacagtcatatcaaataaataggtaccatcacttggcaatgaattaacttttcacacagaactgtgagactatgggcaacctctattaatagtttctaatggtcaggattgtggctcatgcctgtaatctcagcatattgggaggctgaggtaagaggatctcttgagcctagaagcttaagaccagcctaggcaacatagtgagaatctgactctacaaaaaataaatatttttaaaattagctgggtgtggtggtgagcgcttgtggtcctagctagtcaggaggctaaggtgggaggatcacttgagcctattgcaacaaaaacaaaaattgacaagtggaatctaattaaactcaagagcttctacacagcaagagaaaccatcaagggaataaacagacaacttacagaatgggagaaaatattcacaaactatatatctggcaaaggtctaatatccagaatctacaaggaacttaaatcaacaagcaaaaaaaaaaaaaacaaaaaaacaaaaaaaattaaccccattaaaaactgggtaaaggacatgaacagacacttctcaaaagaagacatacaagtgactaatgaacatgaaaaaatgctcatcatcactaatcatcagaaaatgcaaatcaaaactacaatgagataccatctcacaccagtgagaatggtgtttgttaaaaagtcaaaaaaataacagacattggcaaggcaaggctacagagaaaagggaacatttatacactgttggtggaaatgtaaaacagtccagccgttctggagatagtttgggggcttctcaaagaactaagagttgagttaccattcaacatggaaaccccattactgggtatatatccaagagaaaataattcaacctaccaaaaagacacatgaactcttatgttcatcacagcactattcacaatagcagacacatggaatcaacctagttgtccatcgatggtggattggataaagaatatacagtacatagacactatggaacactatgcagccataaaaaagaacaaaatcatgtgctttgcagcaactggatggatgcagctgattaagctattatcctaagcaaactaatgcagaaacagaaaacaaaataccacacgttctcacttataagtgagagctaaacattgagtacacatggacataaagatgggaacaacagacaatgaagaatacaagagcagggagggagagagaggggcaagaattgagactgcctattgggtactatgctcactgcctgggtgatggattcattcatatttcaaatctcagcaacatgtaatatatctttctaacaaacctgcacatgttctccctgattctaaaataaaatttgagggggaaaaaatcctgtttactaaggcttccaaaggcaaccagaatttgatcacttgtcattatcttttctgctactagcctgatcccaaccaccaccatctctgacctgaattttttcaataactttcttactaatctgtctgtctactctttacattctatgatcaatatagctgagtgagtttattcaaacataagttggatcatgtcactaatccacaaaatccctcctgtggcttagtattttagagtaaaagccaaagtctttaaaatagtaaccctgagcctcatgcaccccctgatttctctctttctctttctctctctctctgtttgacttcatttcttactgtcctttgccttgttccctctgctccagctctactgagctcattgctgtttgtccaacactttagaacattactgcctcaaggcatttacacttgctgtttcctctgactgggccatgcttctccaattatcctgcttgtttgccccttgtccccacttcactagaatagaagcttcctgagagttgagactgtgtctgttgtattcactgctgcagtcccaaaacctagaagagaggttgaaatatactgggccctcaataagaatttgttgagtgataagtgaatgcatttacaaaagagcatacaggtgctttggaagtaaaagcagaaggatataacctaggttgcaggaataggaaaagatttcatgaggatttagaaactgagtgccaagaagacaagtagacatttgccagataaagagaagaagaagggaagagctttcccgcagagagagcaacacagcaagactctgaggtacttcttatttattcaacaaatatttgataaaaacctacaatgtaccaggctgtgttctagcatttgggacatcttaagtagaagaggaaggctatacacaaataaacattggcatatggtcagttaataaaaatgttataaaaacaaattaagctgggatacagaataaagaatgatgggagtagggaaaagacaagttagatatggtggataatacttctagggaggtgacatttgggtagagactgaatgaagctcagggtaagttattatctaaggaaaaagcatttctgggcaaggcaacaaaaaattcaagaggagaagggtatgcttataaatgtgaaaaattaaaaaatacttacaaagtggtgaaagggcaaactggcaaagaaaccatggacccaattccataaaacccatcaggccagccatattaagaatattagacaatgggaagccactgaagatttgaatgcaaaggatgaccagatcaatgtctcaggaaataaaagccaaacataaactggctgttttaatacttaactcacaatagcttccttttaagttcaaaagccatttcagaaataaggctatagcatcagtttaaatgaaaatggtgctatttttttctgtgagtacataaaaatggtattataatttaaaatgtttgtttttttaaactttaaaataaaatttgatgccattttatttgtaaaagtatctttcttcaatattcttatatttttaaataatcttttttcaaatttacctattattatttcagtgttatgctcttagtttatagtttctattctttcacaatacatacttttaataattataaatatgcttattttatagtctctgacttttgtgtcgagatctctccactcttcaaacataaccttttccctccagatttctgttccctttgcctgaaacacaggcctcattcacgtgttggtttgttgtgtacactgattcacctcatattctggctcctcctcatgtgtttttaatgtttaattgtgagcacacttttggaagggactgtttcttctatgagaaaccagtgtaaataaatgtttgagtgctatctttcgttttaccatctccagtatgccttggcctacaattcattttatgtacatttctttctttcattgtttttcttttctttttcttttttttctgagacatcatctccctgtgtcatccaggctgaagtgcagtggcacaatcactgctcattgcagccttgatctcccaaactcaagtgatcctcccacctcagcctccctagtagctgggactacaggcatgcaccaccaggcctggctgatatttttttttatttattttttaattttttttgtagtgatgaggctggtctcaaactcctgagctcaagcgatcctacccatgttggcctcccacagtactgggattacaggcatgagccaccgtccctggccttatgtatattccttgaaaggtggattcctgaaccaagtaggtggaatatatttagatcccaaactaggtaatgcagtttggcttatgggcataatgcaactctaatgtctcacctccagttctgtattgacctcaggcatagggctgtctgggaccccttgctcccttttcatctcccttcatctactcttactaaagtatcagctcacacctctccattccagctttcaatttccctttccctttaatttcagacacttggagattctactccctcattttcaatctaagctatagttttttaattgttaaattttatctggcacatcttgatatttgtaatggaagagtttctgtgttggctcagtctaccatattagagactcacttaaaattcatctctaaattggattttaatttgaaatatgagcaagaacagaaaaatagtttgcataagcaaatacagtcatggactacataacatttcagtcaatgaggagctgcatatatgataatgatctcataagattatgatactgtatttgcactgtaccttttctatattcagatacacaaacacttatcgttgtgtcacaactgcccacagtattctgtgcagtcacagcctgtacaggtttgtaacctaggagcaataggctataccaaacagcctaggtgtgtaataggctatactatctaggtttttataagtacactctatgacattcccacaataaaatcacctaatgcttcttttctcatagaatgtatttccatcgttaaggaatgcatgccggtagttgctgagatgtacaaataagcaccaaaaattaaccacgctacaaaagtgctttctaagtctgtcttcccatctgggaacacagtttcttactctgctaggtgagaataacttatagttcatattgtatgagttaacgttgcaaaacagtagtagtaaaagggtgtaaaacccctctaagaggagttggaaagtgaacacaggctccctgacctgtgggagagcttgggaagaagagacagtgagtactattccaaataagtgagaaaaatccagctaaaatgtttaacaaattcaggaagggccaactgtgagcagggatgagtatataacctttgagagtggcaagcactcactgatttttttccacaaacttccaccgggtgcttcctagaaagaacagatcagggtggaaaacaagaggtgtagacccattacaacggggagaaggataaaagccaaaaaccctctatcccaggaatggggtgggaaagagagggcaggaaacagtcctagtcctgaaatcctttgatagtatatgtatattgttatagatttcctaccactggaaaggggcagggaactctcccacacaagactctccatagacagaaggctgaatttagtctggcagaccaaagaaaggcaggatcctgagaaagccctatgcttgagacccagacacacagaggcttcctaagactgaggctggaccaggacaacagagaaacaccttcgtctccaccaccaagctcattcactatcaagtcacaagcaattgcagtctacccctgggggaaggtagagggcaaagagacagaatctctcggtgacacatgtgcacagtggagcacctcaaatggttaagttgaaagtcaatataaaatacaacttctctttttatttttcttcaatgctttataagcagaggttgaaaagtattaggcccatatagtaaatagttcacagaccagtctccgtcccaactattcaactctgcagccgtagcaggaaagcagccagtagacaatttgtgagtaaatgagcgtggcggtgctccaataaacttcacttatggatgctgaaatttgaatttaatatgatatccatgtgtcacaaaatattcttctttcatgtttttcaactatttaaatatgtaaaagccatttttaagtctcaagatatatttgatatcagggctgtagtttgtgacctctgggttaaggtaaaattggtagcaataattatgggtttatagatacaacaatagcaccaaagatggaagggagcaatgggaagtatattgttggttgtaagtgatattattaaggaagactgtgttaaattaaggatatatactctaaaccctagggccaacattacaaacaatacaaaaaagacagagcaaaataggcaaaggctcacatcaacgttagatcattaaagtattatttgaatataagccaattgattagagctccatcacatttggaaaatttacagtttacaaagagaaaatctcatctttaaacatattcaggagaaactttaaaaatatgcataattaaattatattctttaaagctctgaaaataatggagagtgatccaagagaagttttgaaaacttgttagtacatgaaagacagagatttcttaaggcagagaagaaaaataaaactaagcaaaaaacaggaataccttaatatgtaccatattaagttgtaatattggccagataatgctatctagttctaatatccatgtacatctatctggcctatggctaaactgttcagctacttaagacagaggattgctgaggccaagatcatgtaatgattgctacgctctcttagctccagctgtggtatggcctgaatgtgtccctccaaaatgcctatgctgaagcctaatcaccaatgtgatggtgttagaaggtaaggactttgagatatgattaagtcaagagggcgctggagattaggcctcagagagctgccttgccccttctaccacgtgaggacacagcaagaaggtgtcctctaagaaccaggaaaaacaggccctaaacagacatggaatatgctggtaccttgattttggaattcccagactccagaaccataagaaatatatatctgtagtttataagtgacctagtctatggtattttattatagcagcccaaatagactaaagcagactgctgtaacaaaatgccatacactgagtggcttaagcaactgatgtttatttctcatagttttggaggctggcacttccaagatcagagtgccagcagattctacctgacgagggtcttcttctggttctgaacagcagccttctggatctgtcttcacaagtcagaagtgagagggagatcaagtgagcacaaaggcgttggggagggtgggagggagcatgctctgctctcctcttcttagaaggctaataatcccatcagggaggccccacccttctgacttcatggaaacctaattacctcctaaaagcccacctcaagtaccatcacattaggggctagggcttcaacatatgcattttggggggacagaaatattcagcctataacatacacccatcttaacattttcctattggtggttaccatgtgatgccaaactggcaatatttgaaaaatgtgtgacatcagaagaaattaatgtctgcctggtcacagaatatttcattcatccagaggcatgtatctgtcaaactcagctaagtaggataggtctgagaagccagaaggatgcaaatattccctttgagttcacaaaataagtatctcagaattccttcagtaatgtgcattaaattctactgccttatttgttttatcttccactgtttacaaaaagcccatttgctagaaaacatgcgctgtaatgaaataggaaaggaaataaatcctatgcttaggttaaaaatggttaaaaataaaattttggcctacaggagtaaacatctgttatctgtaagtttacttaggtagaacatcttttccagatagagtgctagaaaaatatagcattacttggtccacttaaaatccgtattaaaacctcaaggcatgtattttaatgatgttggataagaacagtctatgtcttttaggacattcacaagtaacattaaagggatgtcaagattctctcttcatgactgaaattcagggcctgctacattcccaaatgcctttctctcctttcactaggaggcaaagactatcaggaaagaagacttggggcactattaccacttttcactcacttttgtgagcctatcaaaattccaggtccatataaagaagttttgtctgtgtattacaggccactgaaaggtaacctgaatgtcacagtcatgatctcttggttcactagcacagcctgggaagaaggatcaaaatatgctggtactttcttataatttaatctgagatagttaattttaagtgtcaatttgactgaattaaaagatacccagatacagtaatccccccttatcctcagtttcgatttctgtggttatggttacctgcagtcaatctctgtccaaaaatattaaatggaaaattctagaaatgaatgattcatctattttaaattgtgctttgctctgagtagcacaatgaaaccccttgccttccatctctgtccgggacatgaatcatccctttgtcctgtatacactacctgcccattactgtataagaaaaacagtatacagagggttcactactaaccttggcttcaggcagcccccgggggtcttggcacatacccccttgcataagtggggggcactactgtagttggtaaatcactatttcttgttatgtctgtgagggtgtttctggaagagactggaatttgagtcagtgaactgagtaaagaagatccaccctcacctaatgtgggcaggcaccctagcccagataaaacaaaaaggcagaagaaaggcgaacttgcactctttctaccggagctggaaaacctttcttcttttgtccttggacgtcagaactgcagtttctctggtttctggactctgggatttataccagcaactcattggggttctcaggctttctgtctcaaactgagagttacactgctggctttcctggttctgaggggcctgtgggtcttctcagcctccataattgtgtgagccaattcctctgataaatcctctctcttaaatttatagctgtatatcttgctctgtgtctctgaaaaaccctgcctaatacactgtctatgggtatttttgccttttgtactaagaaattaataaccactattaataagcacaatcatttatttaacatctgctatttttcaataattgtgctggaccttaaaaatatattacatttttaaattgctttaccaacattgctatgtaagttccttttgtaagcattgtacaaagttccttcctttttttctcatacaacatactctcctggtgtgccttctacctgtctgttctttgaagtctttgcaagcacctgtgcctcaattgttccttgcaagttcatgttcctcagagcttgctatagattctattactgacctatgcacttgctgttgatagtatagtctagtggttaagcttaagttctcaagaatcaaccagaccgagctccattcctctttgtttagcctctttatgcctcaattctcaattcttcaaaatacaaataatgttttgtattttgtttgttgtgaagattaattgaaatgaaagtttgttgtgaagcttgttgccttataagtttattgtgaagattaattaaaatgaaacatgaaaagtgctaagcactatgtctgtcatgtagtaaatattcagtgtatgtgagctgttgttatcctactcaaaatatgttattctaaattatctgcataataactgtcttcttccctagaatattagctctttccctagccctgccttggtactgggcactcattaggctatcatttactttacactgaatggctaagcaaaggaaagaataatcaaaggaatgtgtcaccatgcaaactgggtgtcataattcctatattaaagatgaaagaaatacagtgtggagagggtagcaatattcaaagctttcatagatggcaagtggcagaactgcaattcaaatccatatgtatctaaatctgaagcccatgcaatctttcatttattgcattggggaaaatgcacccctggggagaagaggtggagaataaaataattgttgagcacttactatggacctggtcgtgttctaagcacttgcatgtgttttctcattagatatttacagcaaccttatatggcagagactataattattttcagttttacagaggaaaactaaagtacagaaaggatagtagcaggtcaaggttatatggctaggatgaagcagggatagacaggactgggactcagtcatctggatccaaagctcatacccctaaagccatgtttgcctttctcagcattatgtgatgcatcgcaattaaatagaactaaaaagaaagttaaaagtcactcttggttatatttaccccagtcagttacttagtacacatttgatatctgtatatgattagcttatattagaaaaataaaataagacagctgaacatctacataaactctaactcctgtcctgaactatcactgaatctcaaaatccatctgtaacaacttttacaaattgttattcaattttgtctgtccatttccactaatatgatgttcattaattcccagaaggcactgcctgagtctaattttaaagagaataaatgtaggaaattttttcttgaataaaaaatgtcagtttatatccttcgctcatttacctagttttaccctctaaaactatgcaatatttgaagacaaaccactaatttactcagcaaatgtttgagcacatatctttcaagcactgtgataggcaatgagtacggaaagatatatattaaaacacatatttttagggtgacagccatatagaagaaaatttcaacctcatgtggtaagtgttctaatagaattatttaaaatgtgttaattgaaacatcaagaagtatgtgatttggggcaagagcagaatggcaaattaggtgagtatacagggcaatttttatttgaacatccaggtatctccaagtgcttcctgcttctggagataccaaaataaactgagcccttgcctcttcatatagcctgaaggcagcaaacattctctgtccttgtctcttggcaggagggtggaagcacatgatatccaggactcagcaaagaaataattatcattgttgggtagttactatatgtcaggcctgttctatgtgctttacacacattaactcatttaaaaccaacaactttatcgggtcagtgctattattactattttccgttttacagataagaaaactgagacttattcaagtaactttgagggaaattggagagctattaagtagaaaagccgtgattcaaacccaggtaggatgggctctggagtgtatgtttttaaatacagaaagatgtgacttcccaaacaatacaatactccagaaatgacttctagtgcaatagaaacttgaagaaaatagtattaaaatgtcactttacagtttgcacagtattttgctgtccattatctcatttaatcctcacaacaatcttgtaaaataggcattaatacctgactaccaccctctatccatctgttccattctcctctttattttctttcttctagttactgcttgctattgcttgcaccctgcaagatgatcatcattgcactagctctttcctcttctcaaagtgttcttccagatcgttgcatggttgtttctgctgtaatgtcacctccttggagagcccttccagaatctcatggtgtagctttcagttgtattccactgttaacttttcttctctgcactttgctctctggaatcatactatttgtttacttatttaaatattttatctgttgacttaactagaacataagcacagtcactaacagagaatctatcttgtttatttctgtatctccctccctaaatatagagtaaacatgacatacagaaggcattcaaaaatataattttagctttttttgttcctattttcattcctatttttaaaattccttctttattataaattacttttccatcaatttttaacttattatttgaatataagggattgattttttttggactctatttagaaataggatcattgatttgtgcatatgaaaggttgtattaccttagcaaattcactaatattatctaacagctttgtagttgacaatcaatctggaaataattactttgacagtttctatttaatattttgttatttattgttttataacattggttaaaccatttttgtgctttgtttgatgtgatgtgaacagaaatgttcactctctcacctctaaatataatatttgacaatcccagcactttgggaggccgaggcaggtggatcatgaggtcaggagatcaagactttggtggctaacacggtgaaaccccgtctctactaaaaatacaagaaattagccgggcatggtggtgggagcctatagtcccacctattcgggaggctgaggcaggagaatgggtgaacccgggaggcggagcttacagtaagccgagatcgcaccacagcactccagcctgggagacagtgcgagactccatctcaaaaaaaaaaaaaaaaaaaaaaaaattgacattggcggcatttcatgcctagtgtttgtcaagttaaggaagtcctctacttagagattactaaaagttgttttttaatcagatattaatgttatctttcatcacatgcctttatcaatatatactaaaatgatatggtttttctcctttaatctgttagtgtaaagagttacagtaaactattttcttttctttttcttttttttttttttttttttttttgagacggagtctcgctccgtcgcccaggctggagtgcagtggcgtgatctcggctcattgcaagctccgccttccggcttcaggcgattcacctgcctcagcctcccgagtagctgggactacaggcgcccgccaccgcgcccagctaattttttgtatttttagcagagacggggtttcaccgtggtctggagctcctgacctcgtgatctgcccgccttggcctcccaaagtgctgggattgcaggcgtgagccaccacgcccggccacagtaaattattttctaaggttgaactatcctacttttttggacactgatggttctcaactagatgggatagaactgcctttaaaaagggaatgtggaaattcattgggtattttcagttaacacagtgtgattcaagctggcatttagctcctgggaactaaggataccaaacctcttatatgacaaataaacttagcgccctaactaccaatggtgtctcagttgagaaaaactgctaactgtgaatttgtttttcatcatttttttaaaattatactttaagttctagggtacatgtgcacaatgtgcaggtttgttacataggtatacatgtgccacgttggtttgctgcacccgtcaactcgtcatttacattaggtatttctcctcaagctatccctccccatccccccacctccccacaggcctggctgtgtgatgttccccaccctgtgtccatgtgttctcattgttcaattcccatctatgagtgagaatatgcggtgtttggttttctgtccttgtgatagtttgctgagaatgatggtttccagcttcatccatgtccctgcaaaggacatcaactcatccttttttatggctgcatagtattccatggtgtatatgtgccacattttcttaatccagtctatcattgatggacatttgggttggttccaagtctttgctgttgtgaatagtgctgcaataaacatacatgtgcatgtgtctttatagtagcatgatttataatcctttggatatatactcagtaatgggatcgctgggtcaaatagcatttctagttctagatccttgagggatcgccacactgtcttccacaatggttgaaccaatttacactcccaccaagagtgtaaaagtgttcctatttctccacatcctctccagcatctgtttcctgactttttaatgatcgccattctaactggtgtgagatggcatcccattgtggatttgatttgcatttctctgatgaccagtgatgacattcacgtgtctgttggctgcataaatgtcttcttttgaggaatgtctgttcatatctttttcccattttttgatggggttgtttgtttttttcttgtaaatttgtttctttgtagattctggatattagtcttttgtcagatgggtagattgcaaaaattttctcccattctgtaggttgcctgttctctctgatgatagtttcttttgctgttcaggagctctttagtttaagtagatcccatttgtctattttggcttttgttgccatttgcttttggtgttttagtcatgaagtctttgcccatgcctatgccctgaatggtattgcctaggttttcttctagggttttttatgattttaggtcttacatttaagtctttaatccatcttgagttaatttttgtattgtattgagtttaattttcatcatgttttaaaacttattattaacatgattaatataccaatacagttattctaatatcttttaaataatccctgctagggtatgctgtattagtgtttttctacattattaatattaactagttttatatttaattttccagagagtttttataatattttgataatttaatcacactgctcatgatgaatttattattatgttggtgcaaaagtaattgcagtctttgatattaccttcaatggcaaaaacctcaattacttttgcaccaacctaataaataaagtcctcaatcttttccaaataaaatactcttaaaccagattattccagtcagacaccagtacaatcaatatgcaatcagcattctaatttgattcaatctaataaatgaaggctacattcatttcctctaaattttatctcttttattgtaacctgccattcaagctaggaataattttagaatattggtagggttggccaaattatttgttattcctcctagcttagtcacctgtaaagtttgttaaaatatattctatggtgctcattcaaaatattggtaacagtgccaaacaagaccatgaaccaaacttccttggagaagtgtttctactagaaatccaacaatgcaatcatccactttatgtatttccacattttccacaaggtgtctgtgagagttgtggggtcatgaatatataatgagactatgacatatgtctgaacttctgcaatgtctactcttagtgattttccacgtagcctctgggatcaccactttcttttctaagtgccaatatctcattcttttaaatatatatatgtacacacacacacacattttatatatattttaaaatatatatatgggccaagaggcaacaaatagattgccctatagtttcccaaaacacctttgtcatctttttggaagccaggttatttgtccatcagcaattactgctcttctccaattttcctcaaaaatcactttcagcagtccctcaactatattccccaattttttcttcattattgttaaatagacccagctgtgatttcatgctatgtttctccatctatcttgtgggtttaaatcttatagccatgttgtgactcccattattctatctttttttagttaaaggtaatcctttgattaatttaaaaacaaaagatgttatattgaaatataactatctccacactgggcaagtaaacaaaagttgcacaaacagttagacttggactagctatattgtttctaaggaaaattaccatcaatggaaattagacaccctagctttatgtccaagataggtagatacttgaatataactacaaaataagtttcaatccctcatgatttttttcaagtggttttcaggcatatttatttttattggacaagtgtttgaattcagttagtatattacttagcaaaattcaatctttttttttaaagatctcaattgaataaaccagaactaaggcatggatgaaattaacacaatttttaaggttaagttcacatttggtagtgcagagtgagttcaagttaaatccattttaatttgtttattaggacatagttctgtcattcatgtatttatggttaaaaaaattgaaaagcgtagcttatatatatgtgtgtggaggggggcaattctatagcaactccacccatttaaaaaaccttttcagttgtattctgacattagctcgtgcgattcaattcataagttaaaacagcagggtaaatgcagacaactgaaacagggctatgactatcaaaaccaacacctcacattctttcttggcccttgagagcactacacttgtaggagccagctacatacacagagaggcaaagtgacatcctaaggtagccactacttttcattattttaggttagaaggcttttgttttgttttgttttgttgcattaagaataatccatgacagctaagtcttgctaagccaattttattcattcattcactcattcaatcaacaaatacaaagagcgtgccaactatgtgccacacaatgtgctgggttctacataaacaaacccgacatggtctctgacctgatggaaagtatatcctaacaggcaaatgtcatgactttaagaaaagaactcaaagagatactggcattgtgcatataacaccatctctaatacccaggacaccttcctgtttgatagtactccctagatgttttctttcctctacttaagagctaggccttagttgtgatccctgaaaaacaacactcataagcaagagcattaatttcataactgacaggagcacaccaaatacatttcagggctcggatgaatgacacaccaaactagaaaggattcaccaaatttcttatttttgtaaccaaaatgctttagagatttgagtcattctctttgtaacttttaattatcaaataaaaaacaggctgggtgcagtggctcttgcttgtcattccagcactttgggaggctgaggcacgcgcatcacctgaggtcaggagttccagaccagcctggccaacatggcaaaaacccgtctctattaaaaaatacaaaaacatcagctgggcctggtggtgttgcctgttgcctcctcgggaggctgaggccagagaatcgcttaaacccaaaaggctgaggttgcagtgagccgagatcacaccaccacactcctgcctgggcaacagggcaagactctgtcaaaaagaaaaaaaaaaaaaaaatggaaaactcctggagtgttttgtaactatatagtgtgaaaggaaacactcattgatttacaaagaaataaaaaagttcagttcaattttttaatatttgctggagcccagagaaaatatgagagagcaagcaagcgcttacttgtttgtacactaaaacacatgcggctgctgctatgggaaggatttaggacaagagacataaaatatagtcagccctcctcttttctacccctgatcaaaacaccagggcatacatcttgaaaacgacataaagactaacctaatttttattttccttcttccttaatctttctccgtgtcaaattaaaacaaacaaacaaactaggagcaagagaaggggcaaacccctctggagtgtaagcaaaagcaattttctggcaaatacagattttataaaaaccagtgaataaagctgattagaaaacctataggcttcccagggcttgaatcggaagacgcatgaagtaataagctctgcctgccttgaaaagtgaaaagggaaaagagaaaaattgtaatgtatcacaaattctatgacaagtgtggcacccatgggatagttatttgcattcaatttttgttcttatacttgttttccataaggttgaaatccacaaaataaaagttcttggttttatagcagattttttaaaggacaaaagtttgatttgtcttaaatgaaaagcacactaggatttgtttaatcaatattttaaattacgacttattttagaagccaagaaataaagatttccattttcatttttgcaacttgtccaaaatgaatttaactcacggaaaagttagatgatagtaataccaaccttgtatcttatgtaagcatttaaatgcagattggaagctactaatcatgtcataaggaaagtattagaaatgttttaattattcatttttctccaagagttggttttgtattattccttcataagccatgagtattcaagagccatttggcttaaaaattaagggaacagagtaagcaaaagtaaaatttgaagagttattttgtattatcttctctgaccttgagatgaaaagtgaaggagaattggagctaccatactttagaaagtccctaaatccatgcggtctttaattcctgaagcatttctatgttctttaatatccacgtgttaagtattaaggattgcattcttctttgttcccttgagtttagctgaaggtcattcctggttttaaagattaaaatctgagcaaactaacctctgatgtagagaagagttgctatgaacattttaaggtctggaagagaagaattccacactaatctccttatcagtatcttctctttgttacaagggtaaatgacatgtactactttctataccactgtctaacataaaatattggactaaaattgaatatatctcctcttatgaccacttggattcaacatgtagatttatgcatagtgacatgtaaattacagtgctcagtatatttctaaaaatcgaattataatatatgatgttttagccttgtaatacaaagaagcaaaaagctgatctatagattttcttaatatataattaaatttctaccccaggatgcataattaatgcgttattatttcttggtaatttcagtttttgatcattttcttggttataaatgtaaaaactgaaagacagataagttgtgactgtggacctgcttttatgtatactcttcactctctccagaatgcttttcctaaagatcttattaatctaatacaccaaaacgtagtttaaattttgctttctcagtgagccttcctcgaccaatgctaaccaaacaggcccttctctgttattctctattccaaccacatgtttattttcttcagagcacttcaaatttcaactaatctgaaattctaattatgagttacatcatctgacccccggctaccaactttacacatcccatttttcatattcttccctctctcactttttcacactgaccttcctggctgttcccagtatgcacaggagttccccctcctgaggacatttccccaggtatctgcaactttgcctcctcactttctacaggactcttctcaaatgtcactgactcaggagggtgttcctttactaacacatctaaaacagcagcccccatttatagcactctcctttacccagttttatttcttctccttggcacttgtagttgtttatgtgtgtgttcattgtgtgactctcattagcatgcaaatgccattagattttatttattttgtccattagcactggcacagtgtataaaacaatgtttggcgtaagtctggtgcacaatatttatttgttaaattaattaattaagcccttacttatcatccatctctcccattagactcgtaaggaccacaaaagcagaaacttttgtttctggtattcctccagcatcttgcatatagaaggtgataaatgaatattgaatgaattaatatttgcctctgtgtgtattttaatctccctctcctagtaggttctaattaccacaaaaagtagaattatgtctctttatcacaccagtgtgtaccaatcccacaatagggtctggcttatgataggtactcattaagtgaaggatatcaaggactgggaccaaagtcaataagaacttacaatgaccatagccacccagagacctttacagggttgatctcagatcttaatggcagatcaaaaagagttttggataggcacagggccatgaaaatctgtaatcaccttgttcatccttttggggcccagcctagaccttgaaaaagcttacttcccagagcagacccaggaagctaggtgcagacttctgagtttcttactttcagatatatctttcaaatttggaaagcagtaaatcttaatttcgatccctagctttgatttgtttgcttaaaacatttgccctgaagactatatccatgtatgatgtcaaaaggtagcaaacaaaaataattcaattgtaatataaaaatctccactaaatagtagagcaacttgaaaatatctcttatcatcacattttcatgctttttcatttgtaaaatgaagataccaaaaaagaactagcagctctaaaattgtggattatatattcagatttgctgggatgcccttgggaggctttgtcaagcaccttcttcccttcctctcctttgcccacctgccacaattcctcttggttaaacatcacagttttagtgagctattgttactgacggcaatccatcaagtgtataggggaaagctaggttgagaatctctggcctatgttatcactatcatcctttccatggttaaaatactgtgaatctatgaaatgcacctcagttcactaggaaatcactatattttaacattgcttaagttactgctatcctgagtttacttacaccaacttaacattatttttttattgtactgtgagtcagggactatagcagacactgagaattcaaagatgaatttagaaatggtctcttccctcacggagttctatccaatagggatagacaaatgcaacagagtgtgataaatgctttaatggggccaaagcagcaagtcaatttagagcgcatcaaagggtaccaaagcagcctgggagagaggtgatctggaaaatctcccagtaggtgaccaaaaactgagtcctaactctaattaattgaattatagactgctaaagctgcacagtgttagaatcatctaattcaaactcctgatgtggcacagagagaatctgatgtccagagaggctgatgtatgcagagtgagtatcagagttgcagctaggacccagatatgtaatactgggttgcctctttaaaaatgcaccttttttgaagggaaatttttagaaccttttccttcatcagtttaataatgaaagtaattaatcatatttgaataagatacggagaacaatatttatatatattgactttatgctcagtggtgatgccaataacccatcatctcttggttatagattttccatgagctgctgatgaattttttcagactcatccacagggtaaacctgcttgtctcctgagctactgcatgtacgtaattacactcagaaggacaagtagagtttggctgtgaacaagagcaaactttaaaaataaatcttagtccgattagcacctcctctcatcaaccgactgaggcatctaagggctaaggtaaaacccaacattgaaatatttgtattattagtagtagtggtagtatataaaatgacccaggtatgcaatcttcttggagtttttgctcctaacatagtcacttgatttgggatgtttaacgactgtgattttgtaatgggacaatataagagctcattacattaaaacataaatacttgggaagctcatagtttctgatagcttgccatctgtttggttcttaccggcaatggatttatcctgcttagtgcagatgatgatattgtgggtaaaatcatggattatacaatggatttctgaggtctttaactactgttattaattttgccagcttacaaatcaacattttctaatataaaatcaattacattttatttttcaactcttaccctaagaaaggttgctatgggcaccacagaacatctgttctggcgccaacagattgcgttaaagtcacccacagtctctccaaattaaaaacctcaaactgagttcactggctttgttactgtactctcagcaggatgttcttttgccttgcccatcgttcagtttaatcctctagaaagaaaatttttagaggtacatcggactaaatcattttcttctgagtacaccatttccaaatggccgcccagggtcctaaatccggcggctgcggagagggactagagggtgtcctcctctgcagagccgtaggactcgagcgccttcatcactggacgctggagccaggaaggaaacccacacactcagggacaggtataaccccacaggggtgcaccagtgaggccccgatcgcagcggaggactccatccctgagcttgtgagggcgtcctggggaggaagcgaacactttccccgttcaagtcagagagcaggactcactgggtggcaggtcagaagttgaattttaacccgacctgcgctttgtccccgcgccttccgcagcctgggcgccgcggtggcaccgagctgggagaggacacgagaggctggcgcgggagaagccgagagttgctatcgaccgggagctgccggcggcgggagcagacgcgaccctcgccgctttcgatctcgaagccgcggagagccgatctcggctgctggggctcggctccccgcgctctgccttgccctttcggcagagggcagctccctgcctgctgcagccccgccactgtgcgcccggcagcccaggggtgcgcccagcccgccccccgagtggccgccgggactccagcagttggaccgaccctcgccctccggcgcctggacaaacttccttcctcccgggcccctgcgccaagcaagctgacaggcggctccctcgccggtctcctctgggctctggccgggcgagcttgctctctgcccctctccaaccccgagcccctggcgcctatagccgtccccgcgcagcggctccaacaaagccagaggaccggagacgacccggcgaggggctgggagtggcagcggggaccccagagccagaaggaggcgtcccctcggcggggcgagtacagtgggaaggggcagcgggaacgtagcggggagagaaaggggaagaaagtgttctgttctcggcgcgaacgccttcctggctcgtcctcgttccccttctcctcctgcctgagcgcgtcccatgtcccgttgggaattggcaggcggggaagggaggaggggagaggggacgcggtggcctggcgagcgagccgctcccttacctctgtccagggtgagcggctggaccactgtcaatgtcgccatgtctgccgtgggagccgaagtgacgctcggcttcagcatcagcaaccgctcgtagtgagaaaaaaaggaggagattgggggcgggggtggagagggaagacggaaaggagggggaggagggggaaggaaggaaggtggtggtggtggagaagaaagcttgggtgggttggtagccagatggagacgcaactgttccgcggcggcagatcttcagttgcggtgcggagctgag

SEQ ID NO: 1395 - DNA, 147463 bp, Homo sapiens
tcagtttttaaaactttttttattttttaaattttttttaagtttttattttatattatctacaaagtaaaagtttttcccttaacttaaaagttgaaccactgtagacagtgatcacctcatcaaacttgatttataaataataatccgtcagtttgacggtaagaatttactgaaactttgtcaagtttagtaaaagggcgttccaagtcttgatttttttttttttttttttttagcagtaatagcagcaagaatcactcttgttacttcttttgctagctgatgtgttcatgactttcaagggttattaaaaaataaataacttccagtttcggcaagcagagctggggtacctgcgggactctgaaacagcatatggaattatggaatagcccccaagttcctaaatgcctctactcggtccaagtatcttccactgcaagtgaactgttagcattcctattggatgttacaagaaatcaacatatatattttaaaaacaaaataaatgaaattctagttttctgtgcttccagttggtagaagcagtagaagggaggagggaatttggcctttcggttcctccagggcagccttacaactgctgttggtggtgggcttgtactgtaaaaagaaaagcgaacattgaaacagaaaactggcaacaccacacatcagcctagtgtctctgcagcacatgattgtaaactatcctcgtgctagctgaacaaaactcaaaattgaattcgcttttccccctcccatctgcaccaaagtggggagggttgggtgggtgggtagaaacaaaccagtcagacgtaaaaccacttcagataaaactcccagaagacttgttcatggggtagaaaaaaaggccttaacaaaccccctccccaaatattagccaagcaccagtattgctttcagaataacaggtcagactgtgaagtatcgccatggcagccatcaagtagtagagcacaatcacagggcgctctcccctgttcaggggctggggctaacgctacactcaaagccagtccatccacagcgctttctcagcagtatcttctccagagctacaatcaaactctgccatggtaataaccccccacatgtcagacttttgggactcaggaaggaaaacactgccctgtccagcctgtcataacaaggaaggccaactgagtcctaggcatgcatcaggctgctgttgctgctgctgctgcttctcatcaagccaaatcctgtataccatcagaacacacacagactcggctcccggaagcctcaggccctgatgctgaactgatcgtcacagtccctcctgtgcacactcctggacgggtcttgctagttctcaaatgcggggcttgaagcactggccctgcctgccattccacctgtgcgagcagaatgctttggggtgccccggcggcccctgcacacacacgcctcacctgaagggtgcgtcatataggggaaatgcgctgttgtcgagactggaatgggctgtagtgcactttgagcgagggcggcctggggaccgccgggtggctgtgtcgtcattagcatcattggcgcatgggcagttggatgagaaggaaccattcctgactgtacatgagcctgaaacagagagctcttttacgcatacaggcaacatctccggcttcaacaacatgtcaactgtgttcctttcactgggctgggactctcaggaaagggcaacggtgggcctcagggcccagttctgttctctggggacaatctctagtagattatctattgacctgaagacgcgcttcacctttgggcagatcctgcaagggtcagggagcaggcaacaagtgagcctgggtagaagtcagggctgtgctgtcctaacccttgacatttctgatcattgtattctatgtatggggtaagatcttcacaaagattagacactggatccaagggcagctttctcaacttaatatcatacaagattcaatgatgcttcagaatcaggctgccatgtggggcctgaggtagttttgcagataacatccctttcaaataggaaaacagattacattaataagcagagactgtcacagtcaagtatgtgaattacttggacctctgttcatttgcctctctccctctgcttctggtctgctcaccaggcagtgaaaagagactcttaggcccccgtgactctctcagagatatgctgatggagcaggaggaggaggaggagttggagtttttaatggctccagtgagatggaaaggagtaacctgaagtcatctgggccagcccagcgtctctgtaccaagttcaacctggtctcactcactgtcaagttggaaaggtgattttagtcagcccaaacagctggattccagctctgcagggggttggcagggccaggaagagcccttgtttcctttttcccacactgtgcactgttctagactacgataagccttggatgaaatgccgtttttactctcacatattcaaacgggcacatggcaaatttgagcttccctgtgttaacctttttgccctttcagcacaaaaacagagtgaggttttagggatccctgacttacatgtaagttcacatgcctacttagccaccagcctctggtagacacctacaggaccccagctcttatgaagctgactccaccaaaccacgctggcccacacggaccaaaccggcttccctccccactatcaaaaagcaaatcaactgcagtgcgctacaccacagaacctaaactttgcagggtgaggacgcccaaacttcccagagctgtggaactctacttacaaggtagccttctgagagatagatccaactgagtcgcatctctagcccacaccttgccagagcctcactggcgcactatttaacaggaaatggaattcattgtggcaggtctcacttagacccgcctcagagagttctgttatgaaagtagcagagacatctaatacagccaattcacccgtaacagccccagggagggcctcaaggccagcgttagagcccaacttcagtgcagctccttctcctcattaagacaatcccctgggccctggagtgcagggacctttgtcagcagctgatgcagacagcaaccactgagatggcaagcacacctttcacctgtagcagcttacactggaggtgagctccaaagtgcttccagggctgctcttaaagaaaaatgggaccacctgggtgcttccagcttctagttacactgcaccaatgtccaaggccaagccctctcaagagtacaacttatggtcaaagcagatatatggataaccagggaaaacaattggagagatgtgtctggaactcatgtgagtaacaatcaagttgacaggccccggtagtcacttcggagagctgagactctgtgaaggccatcatccctgcctggcttccaaggtaagtgtgtaggggaatatatatgtacacatatatatagtagtgaggctatatagacatagcaaagcagacacagaaaggaaagaaggactgggttgcattccagagtcaaagatatttttaaggtctcagttggaaaactaaaggactgaccaatcagcaccttcactgatcccatgacaaaaccacacaaacattcccttagggccagatcacgtgtatttgagagggaaagggagacaggcaaatggcatgacacacagggtttcctagctgggagagcctctagctgcttactgataaccttcacattctacttggccttcacagaaagttggctaaagctggtattacctgaggtacgtgggccatgtggggtgggttggtatacgccggctgaacgtgagaaggatggatcgtaaagacagtctgttgtgctgctgggaaactattctgtggcgactgcgtgttggaggcaggtgtcatggagggtggagttggcgcaagccccgcgtggtaaatggctgactgctgctgtggactggccagatggagagcctgggcggcctggtgctgatggtgctgcaaagcgacaggaaagaattgagaggaaaacttctttaatgaaaagcagccaagggatacccacaaagctaagctttgcacacttgggcctatgatgagggtcactggaaagtacaggagaatgtacagggtggtaagagcaaggctggaggtgcctcccatctggacaactcctttctagggtacagaagcctgattctcagtctggcagttagaaacttctgagcatacatactaaagtcaaaaaagactactgccccagggaactgatagatatcaaagacatctttaactgcctccattagcaaacataattcaagaagctcataggaaaataacctcatcacataaaccttagaaattaaaaagtcccaagcaaataggaatttgccttatgaactttatgttaaatttgatttttcattactgcaagtttccagagcttatccaatcaccttattatcaacatgtatcttaaatgtgattttttttaattttttatttttttgagacagagtctcgctgttgtccaagctggagtgcagtggcgcgatctctgctcactgcaagctccgcctcccgggttcacgccattctccttcctcagcctcccgagaagctgggactacaggcgcccaccaccacgcccggctaatttttttgtatttttattagagacggagtttcacagtgttcgccaggatggtctcaatctcctgacctcgtgatccacccgcctcggcctcccaaagtggtgggattacaggcgtgagccactgcgcccagcctttaaatgtgattcttaaaaccaccaccccaggggcacagctgtatccatcttcacgagggtggacatgccatgtgttctgacgatgcgatacctggcacctgaagaaagcactcagatactaggataaagaagccactccatgcagacctctgagttgcccttacctgaacaggactgggtgcaggatgacttccaccatgttggctttgctgctgtccagtgggggtagctgaaggctgagggtgtggagtatgtgggtgcagggtagcgttagggtgcgcatactgctgagcaagggagcccgtggaaactaaagtgaaagaaaaaggagcatgtacacaaccgatgtctgacaacctccatcgctcctctacacttcatcaactgaactttcttgatggttacaatgcataactcacgccactaccaatttctatagatgactccatttaaaccatccattgtcttgaaaaaataagtgtagctattgcttaacagactagcatttggttcatataatacagctctacatatgatattaaaatcaaattagtttgcatttactcttaacggtcactaggttttcccaaaaaggcaacttgaaggcataggcagaaactactcaaacaagtgcattttaggtgcacactctttagctcaaggccatcatcaggctaacctcaccatgctactgccctggagcaatgtcctgagggcacagactatattgggtgtggtgggggatgggggtgcgggcactgtgtatggtatgtggcaaggccagggatctatcatcagggccgaaggaccacagtctctctcagctaatcacaggagcccttctgccactcagtttactttcccaagccctaatggaggatctcccatctttgctttatgaaataaatatagaaaagtaaactcccttctgagtgccccagccctttggaaagaaatttactagactaacttcaaaggacaacatgatgggccagtttaaatcaaaataaagataagaactgaaagccagttctttgtgaatctcagcgtgggccaaaccttggtacaaaaaccatttcttcatgtctttcagttttttgttttttgtttttttttgagatataagtctcactcactctgttgcccaggctcactgcaacctctgcctcccaggttcaagcaattctcctgcctcagcctcccgagtagctgagattacaggcatgtgccaccacgcccagctaatttttgtatttttagtagagatggggtttcgccatgctggccaggctgatctcaaactcctgacctcaaatgatccgcccacttcagcctcccaaagtgctgggattacagacgtgagccaccgtgcctggcctgttcatgtgcttcaaaaacagtaagttgagaatcagaagcagagtaggatgtgttcactgcttccagtgactatggacagcacaccgatgataaaaaactaacctccacgaggcaatgagctgagaatagagcgttctcaagacaactctagcaaggtatagttcccagccctctcttgagaaacaaatcctaaaatccctcaagataataagcccatacacagaaatgattccaaaatagttccccacattcttcatataacgtgttagcaaacacagacatatgcaggactgattggtgagagaagcaagcacagctttgggaagaggcaccctagttccagcagtctggtaggcaaggctgccgagtcaccagcatagacggctctgggtatattccacgtaaatggtgtgcagagggttaggctaggcacatggagcagttctataatcctaggtgttgtagggctaagggccaccaactctccagccctaacagttacgtctccagctgcaaagctatctcttagcaggggaaagggcaaggcaaagagccagttctaggatcacctgtgcatccactgccaatgccacagctggcattaatattccttcatatccagtttagactggatacagcagctttgtttatacactgggaaaattttccagactgtaggaattaacatatgccagaatattttaacaagaaaactgtggcaacatagtctctgaatgtttttaagagtagtgaacgtcttctgggagctagaacaaatgatgtacaaacgatgaagccttcctgagcttcacagtcccataagtctataagacagtcctttttttctaacttggtggcttattaacaggccctccatcatcatcatactcattaagtttacttccagctcctccaagttgtataggcactgacttggtctaaaagatttgatgtaaatttcgaacctgagtttgttgtacttgtaaaaatcttacgttcattttaaaaatgtatttatttgtttaatttttgacagagtctcgctctgttgcccaggctggagtgcaggggcaccatctcggctcactgcaacctccgcctcccgggttcaagcgattctcctgcctcagcctgccgagtagctggaactataggcaagcatcaccatgcctggctgatttttgtatttttagtagagacgggtttcaccatgttggccaggctggtctcgaactactggcctcaagtgatccatccgcctcggcctcccaaagtgctgggattacaggcatgagccactgcgcccggccatgtttgtttatttttgagacccagtcttgctgtcacccaggctggagtgcagtggagcgatctcggctcactgcagcctccgcctcctgggttaaagtgatactcctgcttcagcctctgagtagctgggattacctggctaatttttgtatttttagtagagacggggtttcaccatgttggccaggctggtctcaaactcctggcctcaagtgatccgtccatctcggcctcccaaagtgttgggattacaggtgtgagcaactgcacccggcctaaaaatttatttttgaataataaaaaagccacatgtagctaagtagctaatacggtggacagtgcagttttgttgttgttttgagacggagtctcgctctgttgcccagggtggagtgcagtggcgtgatatcagctcaccgcaacctctgcctcccgggttcaagcgattctcctgtgtcagcctcctgagtagctaggactacaggcgcgcctggctaacttttttgtatttttagtagagacagggtttcaccatgttggtctggctggtcttgaactcctgacctcaggtgatccacttgtcttggcctcccaaagtgctgggactacaggcgtgagccaccgcgcccagccacaaaatgttctactggatagtgatgtctacagttgtccatggtcccctactgttaaaccattagcactaacccctaccgccaccccagcctcttaaaaatgtcatttgtaacaatctaaatctgtctaaggaaaagcaattcccaaatcccaaattctgttcatggaggttcataaagatacagtacggaatctcagaggtttttgttttttttttgtaactttatttattcaagaaattttgtactaaaaagtttgaaatttcacttttaaataccttctaagcaaagtattaagaatattaaaaagtaacaataaatatagaaaataattatgcccatgaaatctcataatttaagttattcatcaactggaaaaatgtaaaaatcttaaaatcatttgaagagaaaagtaaagatgaaatatttttactatgcatttttaaaaggcatctctgcaatttaagtttaccagtatttaaagactataatacggttttctaatctatagctaatttgcatgcatagcacaaatacccaagctgagtgaatgtacataggctttgtttaaaaaaacaaaaacaaaatcctttccctacctaaataccggtaaacttgcaaggcattgattaaaaacaagacgaacaaaaaccacaaaggatgtgtaaaatatgtatcatacgttgtaaacaaaatttaaaaagagttaattagaaatatttccctttgtttttttgttctagctcaaaagatctgaaagaagtaccttaatcaggaattcttttcctccttgaatttgaaattgggagaaatggagccgggcacggtggctcacgcttgtaatcccagcattttgggaggccgaggcgggcggatcacctgaggttaggagttcgagaccagcttggccaacacggcgaaaccctgtctctactaaaaatacaaaaattagctgggcgtggtggcaggcacctgtaatcacagctactagggagagtggggaaggagaatagcttgaacccgggaggtggaggttgcagtgaaccgacatcacaccattgcactccagcttgggcaacaagagcgaaactccgtctcaaaaaataaaataaacaaataaataaataaataataataataaattgggagaaatgtgaaacttatactttaaatcaatactagtaacaaaaatacagttcggttccttgataggccagttaagtgacagtgacacaaagcagggtaggaagaaaatttaaaagccaaggaaaaaaatagcttggaagacaagagagacaaaaaaggaaccaggggccgaggtaggtgatcacgaggtcaggagttcaagaccagcctggccaagatggtgaaaccctgtctctactaaaaatacaaaaaaaattagctgggtgtggcagcaggcgcctgtaatcccagctactctggaagctgaggcagagaattgcttgaacctaggaggcggaggttgcagtgagccgagatcgcaccactgcactccagcctggacgacagagtgagactccatctcaaaagaaaaaaaaaaaaaaaggaaccaagataaggtaaagaaggaaaaaacacaggagaatcagggaaaaggagagtggagtgggaagggcagtgggttctgacccacacatattatttcactgcttttgttatatatgctcattctggctaaagatcccagagaggttaaaaataaagttaattttatttgtaatactgatttattcatcagttaaacttctatttataaaactttagtcttcataaaatcttttagattaaagataatcaaagacatatgcttctttggtccagacctagtccagaagtttcccactcagtgttccttgacataaatatttaagattctaaacatatgatcagtcaaaaatccttaataacactaaccacattccagaactagtttcctcagctgtgatctcactgaagcaaattaagtacagaaagctgtgtgtttaatttgtaactaggttttgtcattttgactttggatgcacaagtcataagagatcaccagcattgcaaaacttataaaacaaaacaaaatcttccaacttgtaaatctgatgttaaattcagaaaaagggaagtgaaggaaagttgaaaactctaaaaggggaataaaaggcaacttgaccaaaccatcataaaatggcttagaacagggggaaatgaagcagcagattaaattagcagcccaactgttagtttcttttaaaaagtactgatactcccttttaggggaagttgtgctaaggcaattaaggcttaggtgttaatgattaaggaccttagctacttaccaggaaaacaacaccaaactactaacagagacagtaagatggtgaggataactacatttgagacctcaaattgagtacataataaaatcacctactatcttttacacactacaatcacagacatagtttcccctttaatagtatatacatacagcaagactcctttttaaagagcatctattaaaggattaaatttaacatttcctagcaccaaataaattatatatacacacatacatatatatatatatacacacacacacacacacacacacatatatgtatgtatgtatgtatcagcttatttttggataccaagtcatggcataattaacaaagatttaaggtcaaatgcattttaaatgctaatatggcatttagtagagtcagacattgagtcaccccaaaataactcaaaatgtgcctaacataaaatttgaatccttaatatcctctagaacacaacatttcatacaaggtgacaatattaatggcacaaatttctaaaggatttctacaaatattagtactccttcctatttaaataccaaagtccaagactagccttatttttattttttattttgagacagagtctctctctgttgcccaggcctgagtgcagtggtacaatctcagctcactgcaacctccacctccagggttcatggaactcttgtgcctccgcctcccaagtagctgggactacaggtgcgtgccaccatgctttggtagagatagggtttcaccatgttggccaggctgttctcgaactcctggcctcaagcaatccacccacctcggcctcccaaagtactgggattacaggcgtgagccaccacgtccggcccttatttttacaaattgccctacaaataggaaaaatgtaccttaaaagttcatttccagaagaaagctctgcccagactttctccatgaaggagcaactatttctgtactttttgccaggtggggagaggggacctgtgctgtccaagataatgacctgagaggtcatgatctcttgcttaagctcaagatatcctgaggggtctgcttcctgaatattttattttttgagacagaatttcgctctgccacccaggctggagtggagtggcacgacttcggctcactgcaacctctgcctcccaagttcaagcaattctcctgtctcagcctccctagtagctgagattataggcgcatgccagcatgcatggctgatttttgtattttttagtagagatggagttttaccatgttggctaggctggtcttgaactgctgacctcagatgatccacccgcctcagcctcccaaagcactgggattacaggtgtgagccaccgtgcctggcccttcctgagtattttaaacctttagccatgcacaggactgaaaagtttttcccttagtatttcatcaatcctattcaattaaaaatcctggtaggcataaatttcatcttatcagaatataaataaacattttaagtttataccaagcttgtggcttggggtgtgtgtgtgtgtgtgtgtgtgtgtgtgtgtgtgtataaataaacattttaaatttataccaagcttgtggcttgggtgtgtgtgtttgtgtgtgtgtgtgtgtgtgtgtgtgtgtgtgtgtataaagctgtttaggaagtttctctaacaaggaaaatattaggcatttcccagtcacatttgcttggtatgcaaaaattgatttctgaaacaactccatttttcattaactccagccttcttaaattgggtatttccattttaaaaactgaattatttatatatataagtactttcaataatttgactggcacaaggaaaatattgttcaacaagtctactcccttaacatgtatcctttaaaaagtgttttactgtacaattaaaaattagtataaaaaacccaactcactggcaaagtagaaagaagggcttgtctccttgttgtatggtaatttgggacatgctgaatttgggaaatagaaaggtaaattagccttttgaggtgtgcattttccaaattttctggaaaggttgacatattagtaatttctttttgtattcatgcataattcattttcataagagatgacaagcactttaaacactgctacagaattttaaaagaaaggactaaaccggaagacactgttcttctgtacttaggtgtcaagttgtcatgctgacttgcttaaaagtaaaaggaataaaatcattatctaataaaaacaccaacatggcattctactgaacaaccttgatataaatcatgtaccaaaataaaactattttacaagtttaattcaatagacacacaattttgcaaaaacattactaatggaaatgtcattatcctgaaagattatctagtaatggatccaaaaatttaggatcatagcaagaatataaacatgaatattatttcttattaaaacatgtctacataaaggggtagggtatttgagtgtatttaaatacacctggaaggatacacatcaaaatgttaaaaggcagttgtcaggtggagggattatggatgcttttcattttttttttttttaacttaactatattttcttacttatctgcattaaactaccaaaaacaaatcaaaaaaggattctggatctaattcttcctaatggctctagttagtcggaaaagttgtattattactgtttctgaaaggtaaaagcatcaccataaaacaaaattagatggattagaagagtagatgtgaggctgggcgtggtggctcacatctgtaatcccagcactttgggaggcctaggcagacaaatcacaaggtcagaagttcgagatcagcctggccaagacggtgaaaccccgtctctactaaaaatacaaaaattggccggtcgtggtggcgcacacctgtagtcccacctactcgggaggctgaggcagaaaaaccgcttgaacctgggaggcagatgttgcagtgagctgagatcgcaccgctgcacttcagaatgggtgacagagtgagactacctcaaaaaaaaaaaaaaaaaaaaaaaaagagtagatgtgagaggaaaaaaaattaaagtaacttcttagaagggatggggtagaggcaatgatggaagttagattaagagacatcaaagaggccggggcagtggctcacgcctgtaatcccagcactttgggaggctgaggtgggtggatcacctgaggtcgggaattcaagaccagcctgaccaacatggtgaaaccctgtctctactaaaaacacaaaaattagccaggtgtggtggcgggcacctgtagtcccagctactcaggaggctgaggcaggagaactgcttgaacccaggaggcggagtttgcagggagctgagatcgcgccactgcactccagcctgggtggcagagggagactccttctcaaaaattaaaaaaaaaataaaaaataaataaaaaataaaaaaaaaaaaagaggctgggcacagtggctcacgcctgtaatcccagcactttgggaggctgaggcaggcggatcacgaggtcaggagatcaagaccatcctggctaacacagtgaaaccccatctctactaaacaaaatacaaaaaattagccgggcatggtggcgggcgcctgtagtcctagctactcgggaggctgaggtaggagaatggcgtgaacgcaggaggcggagcgtgcagtgagctgagatcacgccactgcactccagcctgggcgacagggagagactccatctcaaaaaaagagacatcaaagagataaggtttttgacaaaagccctttctaagatagctagaaagaggtcaaggtcaatacttttttagaataaaataattatcctattttatcatttaactgttcagtaatgttagcatatgtgtattaaacatactaaaaatttaaaaacaataatcaggatttcattttgcagtcattagtggtcctatgttttcaatgcctttggctatggctataacaattaatgaatgagaaaaggtgacataaaattgtcaccaacatctgggtgcatgttcttctgtttgcattaaatgttttaaaaacctagatatgatgtagcttaaaaagaaaagcacaattcatactcaaagtatttggttcctttgagaaaatttattacaatatatttaatatatttataaaatataaattgttcagggaagatgagtataaaattaacacttctatgtaagtttgttgtagtttataagaatgtacttcaaattttgtttatatttgatataataaggctttgaaagtctaataattcaaataaatcactgcagatttaatgaagaacatgcttaagcagattaaattatggcttatgatggcatagaacaaaacaattctttcttatgttttcttttttttaaatagagacagggtcttgctctgtcacccaggctggattacagtggtgccatgatagctcactgtagcctcaaagtcctggactcaagtgatcctcccatctcagcttcctgtgtaggtgggactacaggcatgtgccaccatgactgggctttttttttttttttttttttttttttttggtagagatgggatctcgccatcttgcctagactggtcttgaacacctgggctaagcgatcctccacttcagcctccccaagttcttggattacaggtgtcagccaccatgcccagctcctagtgtcctttttagggtcttaagcaccacaaagggaatcttgattaactagtgacaatcacaacaagtccacagccttgctcctagcctgcctccatacagacagcaattaaataccacctgtgtaaactgcaggagagtagttcagatttggctgagtaactttttcctggcatgaaagaaccggctctaatgactagttcattccagatttcactggacattagatctagtgctttgttttgtttgcaacatttcctatttgcccacacataaatggactttggggtctaaggccccactgctcttcaaatggacatgttctaggaagtagttatgaaaatcatctgtacctcaaacacagtatttaccctataggctgtttcaaaaccaatgaacattcatccaaaagatgaagccagatgttggcagtgaatgaacacaatgaggagaaagattcggctcaacattacagtattattgctacaatgtctcaaaagcatgcatacacaaataactactctccaaatgcaatggaaattttagcttaaaagtttcagatctgattccaaggggagtatgccagaaaatggaaggaaagagatgttctttccacttgttaaatcatgatgtattcaccagaaatgtataaacaatcataatgaacttttaacctaagcctttagcaaacaggaaaattgttaaaatatatacaagttgcataaaagccagcatgataaatcaatcgtgcctttgcacgcatattcagtccccgttaagacaactaaagacaagtcaaatgacggggtcataaccaaaataataaaccaagttagtttgtcagtatcttttacaattaaattacggatgggcctcttgaaaaaaatgttttccaaaatgtagcaatcacacaattttttatttaaaatgcgtaatccacaatacaaaattgaaagtgataatgtggaaaattaagactggacttaactgttttataaaactaaacacctttgatcatatacaaattcctatcagcagtgagcctttgtggcagacaagaacctccaggaagaaagcataagctgtgggttacaggtgacaggaaggatgattgctgctgcccaagtcctattctcattaacctacggaatgttaaaacttttattcttcaaaaaggacagaggtggtatgaaaagtagtaatgtctcaagaagaaggtttgccagaaatctgtaaattctttttttttttttttttttttggagatggagtctcactctgtcgctcaggctagagtgtagtggcgcgatctcggctcactgcaacctctgcctcccgggttcaagcaattctgttgcctcagcctccgaagtagccgggactacaggcacatgccaccacacccggccaattttttggatttttagtagagatggggtttcaccatgttggccaggctggtctcgatctcctgacctcatgatccgccagccttggcctcccaaagtgctgggattacaggcgtgagccactgcgcccagcctataaattcttaaataactcaattttgcctaaacatactcgttcaggacatctaaacttaaaaaataaaaattttatattcttagtatttcaaaaagttcaaagaggctttaaaaatgaaatgcccatgtagttacatgtaaccataatctcattctcatagcagtacacttttcaactgtatgaataaaccaaaattatcccctactccaaacaaccaaaaacgcaaataggaaaactaaacgacactacggtagttctcagaaatattcagaacaaaacatcttaatgaaatcagtactatttaaaaacatattctgaaaaacatttgaagcaatccattaattctgtatcataagatatacaaatggacattttattttaaattatcaacagtgaaaaatctattattttggtactttagacagctgctaagttgatctacacaaatttctctgtttagtcacaaaacgaagatgggtttttttgcttattattctcacatataaatactgcttagttttacataaaatacttctcattttcatttcagcattctgttcacattggttatatttaaagtgtgactcatgtctaaaatatatctaatatgacataatattcaaccattaaaatacagcatgatgtagaaacatagtattatcattataacaaacagcaaaaaaaatatgtaatgccagtgaccctcagatcaagtagtgaagcaaaatgttttcatgctggagaacacctttatgcttttattattataaaattctcttgcatgtcgtaggcaggatataccaaagcataatattgatgaggaagaggagaaaggtacctttctccacaaagatgctttgccattatatacatcattacattttagttaaagcaggaaagagatctgaagaccaggtacagaagtagaaactatttgccaaaagttataaagcaagtcaggcaaagaaatgggttcatcttttccttcagattcttgaccctcaatgtcataaaaggtcaggttattcttagatagagtatgttttcagaaacttaaattaagaagagtcacacacactggaagagacaaacaaagtgcttcctaccatacatcgcatgcgtctgctcatgagccccgtactgagttgctgaagaagatactaaaccaggctgggcgtgtgttggtggtgccatcattctagcattaccctgtattacaggactatagacatgaggatgctgtgttcaaacaaaaaataaagaaagcacattaacactgcaaatagagccaagcagactttagttaagatttttaactccatggtttccagatttccagaaacagctgtaaactctcaaatctttcttggctgtttcctctgaacctcttacaatcatcagtaaccttcgaatatatattgaaaagggtccccaagtccttagctatctaccctaccatcacacaaaagcaaaaattataaaggaaaatccctttaccatattaaaagtttttttatatggtacaaaaattaagagttaggccttaccagccttacctgagactgataatgtggcacatgctgaacaaggggctgatttgggaactgctgaggactgtaggcaacatattgcgtggagtaagctggtggggtggctgcaatcggtgggcccgctgctgacgctgggtgcatcatggcactctgatgatgctggtcttgccgctgttggggcatatttggtactgcagaaaaaaaagcagactgcctattaaacagtatctccacagcataatacatgtgttcacatggtctaggaggctctgaatgatttgaccctgaatctgcgtctctgatgccatctcataccactcccacttctgccactctgggttattttcctatcatgcatgctagtcctcagcctcaaacaccagttcccaaatcccagctgggataattctgcttcatccttcaggtgtcagcttgaaagcaacttcctcagagggactttctctcatggccctcagacttgatcaagtccctgtaacagactctcacagcattatgaaatcgcttctcatatggtattttctgggacgggcactgcattcattttgagaaaaacaaaggcatgaccaaagagccaaaacagatccaacactaactttctatcttccttaatttccaaccactgaatccttgtaacacttcccattctttctcaaacccagtataacacagcaccatgtagcatataccaggtttctaaataatagttcttttaaaagattactttatgtcttatcttaatccacacaggtggtctgcatgtaagggcctcgccctgttacaactctagttaagaattcagctcaactgtcatctcccatgtgaggtttttttccagttcctccagcacgagctagctacttcccatgtgcctctttcctcacacatttcttacagcactattgtctgtgacctgtttctggtgtggcattaaccaagccacttcaggaaaataattgtggaatgactgcttacaactaggtataaggcacaaagaatatagaacttgttcataaaatcctaagaactgattatataattaactgcaaatttgtggctaaacattcactaactgttgctgaaatttgggagagctagttacatattattttatctatgtaggaaagcaaacctgaacatttttttatattttatcttggatgcacgtatttaaaaaccacctccttctggtaaacaaaaaagccactgaaaactacttatcacttttatcaaatgaaagtttgcccgattatgctaactgagcttaaactattcactattattactttgttacttattaccttcctgtatatttaaaaaataattaaaaagctagtcaagtatactatggtgctattatttagatatcatgtgtttgtctccactaattctcatgttaaaacatgatccccaggccaggcgcagtggctcacgcttataatccctacactttaggaggccagggcgagcggactgcttgagctcatgagtttgggaccaccctgggcaacatggggagacactgcctccacaaaaaatacaaaaatattagccagctgcggtgctgtgcatctatggtcccagctactcaggaggctgaggtgggaggaacttttcagccagggaggcagatgccgcggtaagccgtaactgcaccactgcactccagcctcggcgaagaagtgagaccctgtctcaaaaaaggggagggtaggggacaggaggggaagaaaagaaaccaagcccttgactctgcctgttatttgaaaaatgctaaaaatatttttatccaatacctcaaaggattggaatttagtaaaggagcagggtaaaaactaacatataaacagcaatagccttcatatatggtacttcataagtaattacttagaagatgcaatggaagagaagtccctgggttacactaacattaaaaaagaacctacctaaggcatacactgaaaaaaatgtacaaaaccttaaagataaactttatttttatttatttattttctttgagacagagtgtcgctcggttgcccaagctggagtgcagtggtgcaatcttgactcactgcactctctgcctcctgggttcaagcgattctcctacctcagcctccagagtagctgggactacaggtgcacaccacacccagctaatactttttttaaaatatttttagtagagacggggtttcaccatgttggccaggctggtctcgaactccagacctcaggtgatctgcccacctctgcctcccaaagaggtgggattacaggcgtcagccactgcatccagccaaggataaactttaatatgctattgaaggtatactttgttcttgaacaggaagactcaacatcatgaagacatcaatcatttcttctcaagttaatttataagtttattgtgattctggcctgccatggtggctcatgcctgtagtcccaccactttgtgaggctgacacaggcagactgcttgagctcaggagttcgacaccagcctgggcaacatggtgaaaccctgtctctgcaaaatatacaaaaattaagccaggcacggtggtgcttgcctgtagtcccagctacttgggaggctgaggtggggggattgccttagctcgggaagttgaggctgcagtatgcccagatcatcccactgcactccagcctaggtaacagagccagaccttgtctccaaaaaattaaaaaaaaaaaaaaaattccagaagtttatactgatagtaagaaccaacgacaaaaaaaccacctcactggttacctttggaggataacagaaaaccaactcattattttgaagactgccttaaaaagggaaatgattaacattttaaattacttttcctaagaaagctatacctcagggtaaccaaacagctggatatgggaaagtttttctttatagaaatattccaggcaataattgaagaagggatgaaaggaaaagaatgtcaccattttacaacccctaaggaaataactgatcttgggctagacaattatcatcaatggctgctaaaaaacacaccaaaaaaattaaggcgctaaagggacatattatctcctggatagataaaacatctaggaactcactgactactcctatcaggaaaaagactgattacatgactcctcactgaaagtacacacatctgtgaaacattggggaaaaaaaaaaaaaacccaatctgatcaagccttcattatttactatcagtttacaaagattacaggggacagaagtctactttaaatatcaacacagggatacagtcagcaaaattcagatcgtgggaaaaaaatacaagacaagctggatatgaacaagacaaaaactaagggaaaaactgtaattaaaactgtgagggctgagtgcagtggctcatgcctgtaatcctggcaccttgggagtcaaggcaggcagactgcttgagctcaggaattcgaaaccctgtctctacaaaaaatacaaaaattagccaggtatggtggcgcgcacctttagtcccagctacttgggaggttgaggtgggaggaccacctaagcccaattggtagagactgcactgagctgaaatcatgccactgcactccagcttgggtgacagagttagacactgtctcaaaaaacaaacaaacaaaaaaacctatgacttggctgggtgtgatggctcatccagcacctcctaaagtgctggcctgtaatcctagcactttaggaggctgaggtagaaagataacttaagccctggaatttaggactagcctgggcaagatagaaagatggtgagactctgtctcaaaaaaaaacaaaaaacaaacaaaaaaacaaagaagaagaaagacaagacaagaaaagaaaagctggcaaggtggcatgtgcctgtagtcacagttacttgagaggctgaggagggaggatcctttgagaccaggaattcgcagcagcagtgagctatgattgcactactgcactccaagcctgggcaacaaagccagaccccatctcaaaaacaaaaaacaaaaccaaaaccaacttaaagatacacactaaaatgttggtggataaactgatgcaatgtctagaatttgcttcagaataatccagtggactcaaagcttttaagagacaatgggtagggatgaaacatgactggcctaggttattaatgtctcaatacattcgtaataaaaagttaccgcaaggctgagagcgatggctcacacctgtaatcccagcactttgggaggccgaggcgggtggatcatttgaggtcaggagttcaagaccgggctggccaacatggtgaaaccccatctctattaaaaatacaaggccgggcgcagtggctcacacctgtaatcccagcactttgggaggccgaggcgggcggatcacgaggtcaggagatcgataccatcctggctaacacggtgaaaccctgtctctactaaaaatacaaaaaaattagccgggtgtggtggcgggcgaatgtagtcccagctactcaggaggctgaggcaggagaatggcatgaacccaagaggcggagcttgcagtgagccgagatcgcatcactgcactccagcctgggcaacagagcgagactctgtctcaaaaaaaaaaggctgggctacttgggaggctgaggcaggagaattgcttgaaccccagagggggaggttgcagtgagttgagattgtgccactgtactccagcctaggtgacagagccaagattccatctcaaaaaaaaaaaaaaaaagttaccacaatatgaaacaattaaaaaaaaaaaaagacttcaacatataaacaaatccaaattgcaagcctgacttggaccctaattggaacaaattattgtaaaaagatttatcttttctgtttcttttttttttttttttttttaagagggaatcttgctctgtcacccaggctggagtacaggtgcgcaatctcaactcaactacaacttccgcctcctgggttcaagcaattcttctgcctcagtctcccaagtagctagaattacaggtgcctgccaccgggcccagccaagatatattttaaagatcagttggttttaaaaaggcaactgatttttttagtagtaagttaattatagagttcatatggaaaaataaacagaaaattcaaggtaatctgaaaaaaaaaatcaatgttggcagtgagtggatgagaaggtagtcctattagattagtgaagcagagtgaaaaatccagaaacaaattcaaccacaaaaagacacttgttatatgataaaatggcatttcatatcagtttgtatgaccataatggaattacattattatctatccatctatgcgcacgcatacacacacactttaaatacagggtctccttctgtcacccaggctggagtacagtggtacaatcacagctcactgctgctttaaactactgggctcaagcaattctccttcctcagcctctcaagtagttaggactacaggtgtgtgccaccacacccagcaaatttttaaattgttttgtagatatggggttttcctacatcacccaggttggtcttgaactcctggcctcaagcgatcctcctgccttggcctcccaaagctctgaggttacaggtatgagccactgttcctggtcaatatgatatacttagtagatgataagtatttgaacataatccaacaaccattcatgattaaaaagaaaacaaacccacctctgcaaattaggaactgaagtaacacctaactgtatgcttaatagtgaaagacaatgtctcacccctaaaaatgggagcatggcaaaatctcatgcctttttcagtaatgcaccagtacaataagacaaaaaaaaaaaacccaaaaacaccaacatggtgattagatcatgattgtatgtttaagtcttaaagggctgccagaaacagtgggtttaccaacacatcaagacacaaggtcaatattcaaaaatcaagtgcatctctatttacgaataaacaaacgttgaaagtttttaaaatataactcacaacagcacaaaacagatgaaatattaagggataaatttaagaaagcaggcacaaaactgatacaaagaaaactagaaaacactggtgaaacttaagacttaaataaatggagcagtatatgatgacctcaatgaagattccatattgttaagatatttctcccagaactgatataaagattcagtgcacaatcccaagctgattctaaaatttatttgcaaattcaaagaacgcagaataagagtaattttgacgagaataaaactgggagactcatatgaacttaaaggttggttacaaagtaacagcaataaagagagaattggcataaggatatatacaaagatcaatacaacaaaacagttcacaaatagacacacatacaatacagtcaactgaattcaataaagctactatggctgggcgcagtggctcatgcctgtaatcccagaactttgggaggctgagatgagcagatcacctgaggtcaggagttcgagactagcctggccaacatggtgagaccctgtctctactaaaaaaaaaaaaaaaaaaaatacaaattagctgggtgtagtggcgggcacctgtaatcctagctactcgagaggctgaggcagaatcgcttgaccctgggaagtggaggttgcagtgagccaaggtcacactactgcactccagcctgggtaacaagatcgagactcttgtttcaagaacagaaaaaaaataaagccaccaatggaaaacagaggctggtgccagagaaaccgagtaaatatttatggtggagaaaatgaagctagacctttacatcacaccctacacaaaacctaacctgaaatcaaccatatacctaaccataaaaacattcataacctagggtacgtaaaagatttcttattatgatacaaaaaagcatgaaccttaagagaaaagcttgataaataaggcttcattaaaattaacaatactggctcttcaaaaaaaaccgcagactgggagaaaatattcacaatattctgagaaaggacttgtaaccagaatatataaataacttaaaataatttactaaaagtagtaactttattttcacagtaagaaaagaaacatgacttttttttcttttttttgtgagacagggtctggctctattgcccaggctggagtgcagtagtgcaatctcagctcactgcaacctcgatcacccctccatcgccctccaaacccccgcaacctcgctcaagcgattgtcccacctcagccccccaagtagctgggaccataggaatgcgcttctgtgcctggctaatttttcttttttcttttttttttttgcaaagacagggttttgtcatgttcctcaggctggtctcaaactgttggctcaaatgatccatccaggttggcctcccaaagtgctggaattacaggcgtgagccagtgcacccaggcagaaacattgagacaaaaagaaattattaggacaggcgcagtggctcacacctgtaatctcagcactttgggaggccgaggcaggtagatcacctgaggtcaggagttagagaccagcatgaccaacatggtgaaaccccacctacactaaaaatacaaaattagccaggcatggtggcgcatgcctgtaatcccagctacttgggaggctaaggcgtaagaattgcttgaacctgggaggcggaggttgcagtgagccaagatggcaccactgcgttccagcctgggcaatagagtgagattccatcaaataaataaataaataaataaaatggaaaaaagatttgaaccatttactaaaaaaaggttgacagctgaaaacaaacacacacatgatgaggtgctcctggatcagtcatcatcagagaaatgtacatttaagatcacaatgagataccataagacacccattagacctgttgaaattaaaaagataacacaataccaagtgttggcaaggatgcagaacacatggaacctacacatgtacctgatcagttggaatgtaaaatgacacaatcactttagaagattgctagtttcttattaattgaaatatgtatttaccaggcagtgtgtggtggctcacatctgtaatcccaacactttgggaggctggggcgggtggatcacttgtggtcaggagttcgagaccagcctggccaacgtggtgaaaccccgtctctactaaaaatacaaaaaaattagccaggcatggtggtgcgcgcctgtaatcccagctacttgggaggctgaggcgggagaattgcttgaacccgggacagggaggttgccatgagctgaaatcacgccactgaactccagcctgggcaacagagtgagacttcatctcaaaaaaaataaataaataaaaaataaaataaattttttaaaaaaatgaaatatgcacttaccatacctcagcaattccaattctaggtatttaactaaaagaaataaaaacacaaacacttgtacacaaatgctcacagcagcttcattcataatagccaaaagctggcaataactcaaatgcccatcgactagtaatgggtaaattaactgtggtataatcataaaatgaaatgctacccagcaataaaaaggaataagctggctgggcacggtgactcacacctgtaatcccagcactttgggaggccaaggcaggtggatcatttggggtcaggagtttgagaccagcctggccaacatggtgaaatcccgtctctgctaaaaaaaaaaaaaaaaaaaaaaaaaagagagagagacaaaaattagccaggtgtggtggcacgtgcctgtaatcccagctacttgggaggctgaggcagtggaattgcagaccaattctgggacacagaacaagactccatctcaaaaacaaacaaacaaacaaaaaggaataagctgatactaacatgaaattcaaattactacactgtttaggacacacatatgaaattatataccaagcttgtccaacttgcgtcctgggacggctttgaatgtggcccaacacaaattcataaactttcttaaaacattataagttttgctatttttttttgttttgttcatcagctatcattagtgttactgtattttatgtgtggcccaacacaattcttcttccaatatgacccagggaagccaaaagattgaacacctctgttacacgctgtttgattccatttattaaaaaaaaaaaaaaaatctaggggctggctgaggtggctcacatctgtaatcctagcactctgggaggctgaggtgagctcaagagttcgagaccaacctgggcaatataatgagacgtctccaaaaaaagatttttttacgtaaaaaaagaaaaaaaaaaacctaatcaaaaaaaaaaaaagaaaaagaaatctaaagaggataaatctaatctatagtaaaagaaggcagattactggttaactggagctagtggtaataaagtacagttggacagagaagaggaacaggcacaatgttttccatcttcactgatgaagcaagtagttacatgagcaaatatatttgtcaaaactcattaaaatgtaaacataaaaagatgagcattttcttgtatgtaaattacagactaataaaactggttaaaacattttggatagtcatttagaacaagataaattggattcacattttatactttaagataaattctaaaattagccaggcataatggtacaggctggtctcaaactcctgagctcaagtgatcctcccacctcagcctctcagcctcccagggtgccaggagacaggcagatcacgagatcaggagttcgagaccagcctgaccaacacggtaaaaccccgtctctactaaaaatacaaaaattagctgggtgtggtggcgcacccctgtaattccagctactcaggaggctgaggcaggggaatcgcttgaatctgagaggcggaggttgcagtgaagctaagttagcgccactccatcagagcgacactccatctcaaaaataaataaacaaacaaacaatttaagaggaaagaatagtcttttcaacaaatgaggtggggacaacggatatccacaagcaaaaggaaaaacctggaccactactctcatctcatacacaaaaattaactcaaaagagattgtagacttaaatgttaagagctaaactataaaaatcataggagttttataggcgtttcataggagtaaatctctgtggccttgagttaggcaatgctttgtctgatatgacatcaggagcaacagcaacaaaagaaaaaacaaacagataaattgaacttcatcaaaattaaaaactgtgttacaaagaacaccatcaagcaagtaaaaagataacctatagtcagggcatggtggttcgcgtctaaaatctcagcactttgggaaggtgaggcaggcggatcatttgaggtcaggagttcaagaccagcctggccaacatggtgaaattccatctctactaaaaatacaaaaatgggccgagcgcggtggtgcacgcctataaccccagctactctggaggctgacgcagggggatcgcttgagctcaggaattcgagaccagcctgggaagcacggagaagctccatctctacaaaaaatataaaaattagcctggtgtggtggcgtatgcctgcagccccagctatctgggagggtgaggcaggagaattgcttgaacccaggaagcgaaggctgcagtgagccgagattgtgccactgtgctccagcctgggcacgatctcaaaacaatacaaaaaaacaaaaaaccacaatgacacttcataaccactagaatggacataacccaaaccaaagacatatcggttatttatgaggatgtggagaaactggaacacttgtacattactggtagaaatacaaaatgatgcagctgctttggaaaagtttggcagttccatcacagcatttctactttaggagaaatgaaaatctaaggccacatgaaaaaaaattttattttttattttttgagactcactctttcactcaggctggggtgcagtggtgtgatctcagctcactgcagcctccgcctcccaggttcaagcgattctgatgctcctgcctcagcctcctgaatagctgggattataggtgcacgctaccatgccagtgtaatttttgtatttttagtagagatgggatttcaccatgttggccaggctggtctcaaactcctgacctcaagtcatctgcccacctcagcctcccagactgctgggattataggcatgagccactgctcccagcctcatatgaaaatttgtacatgaaaatccacaaaagcattactcattgccagaaaaaggaaataatccaaatgttcatcaactgatgataggtaaaagtggtatattcaggccaggagcagtggctcacacctgtaatcccagcactttgggaggccgagggaggtggatcacttgaggccaggagttcaagaccagcccggccaacatggcaaagccctttctctactattttttttttttttttttttttgagacggagtctcgctctgtcacccaggctggagtgcagtggcaccatctcagctcactgccagctctgcctcccaggttcatgccattctcctgcctcagcctcccgagtagctgggactataggcacctgccaccacgctcagctaattgtttgtatttttagtagagacacggtttcactgtattagccaggatggtcttgatctcctgacctcgtgatctgcccacctcggcctcccaaagtgctggattacaggcgtgagccaccgtgcccagactctgagtatatcatttctattaaaaagacagtacctcctgaagttagaatgtgactctcccatcagatagccaaactgtcatgcttgctcttactacagtaaccttttatattttaatgacaacaaaaagttcccattgcattgttttaagtaatcattgaaaacagctacacctgctggtgatacatgaacaccttaacactacattaaaatggcagtaaaaaaaaaaacccactttcttctcagaatttctaaaggccctcaaaataagattaaactctataatttgattacattatttcaggcagagttctttcaacaggttcatatgttccaaggctaaaaaaaaaaaaaatagcatactgagaaaacgaaaattaagagttttagttaacatctatgaaatcacaattaggtcaaacatggagaaaattggctgggcgcaggcactttgggaagcagagccaggcagatcgcttgagcccaggagtttgagaccagcctaggcaacatggcaaaacccatctctacaaaaaatacaaaaattagctaggtgtggtggtgtgcacctgtagcccccgctatccaggggactgagaagggaggatcgcttgagcccaggaggtcaaggctgcattgagccatgatagcgccactgcgttccagcctcagcagcaaagcaagaccctgtatcaaacacatacacacacacacacacacacacacacacacacacacacacacacaaaacacccaaaaaaacacattgaggaaatcttattaattcaggaaaaatgaaaactttatgtcagaaaggcaattattgggcactgagaaatgtcttttctgtataaattattctactttctatagtttctcaactgatagcagttaatcactctaaattaactggttggcaaaaaaaaaaccctttagcattttccaacattaaaagaactctttttttttttttttttttttggacggagtctcgctctgtcacccaggcacgcaccaccatgcccagctgatctttgtatttttagtagagacgggttttcaccatgttggccaggatggttttgtactcctgacctcaagtgatctgcccacctcggcttcccagagtgttgggcttacagatgtgagccaccacacctggccaaaagatttccttttaagaaaaatgtgggattttttctacgaaggctctttaaccacacaagcacagaatactagtttatgcaactacattatacgacaactccctaattttaatgcagaaacatccatcttatttttctttttgaggcagggtttcgctctttcacccaagctggagcccagtggtgcagtcacagttccctgcagcctggaccttctggtttcaattgatcctcccacctcagtctcccaagtagctaggactacaggagcacaccatgacggctggctaagatttctattttttttttgcagagataggtttttgccatgttgcccaggctggtcttaaaactcccggtcatgtgatctgcccacctcagcctctcaaagtgctggaattacacgtgagccaccaagcctagccgaaacatccttctaataggatcttaacattggttgaagttagttgcccctctgcttcaaaagaaattctggctttggggaaataactgtaggtatatataaagcaaggttagcaatctagtaaattaatctagcaaaccctcttcttcaaatttaagttcagatttaaatcagatttcagatcaaaaagctttggaattaacttttttttttttttttgagatagggtctcactatattgcccatgctgctctcgaactcatgggttcaagtcatcctccagctgggatatcaggcatggagccactgtgtccagccaattagtctggtttttttgtttgtttgttttttgtttgtttgtttgttttgagatggagtctcactctgttgcccaggctgaagtgcagtggcacgatcttggctcactgcaacccctgcctcccgggttcaagcaattctcctgcctcagccccacctagtagctgggattacaggcggcaggtgccaccatgtccggctaatttttgtattttagtagagatggggtttcgccatgttggccaggctggtctcaaactactgacctcaggtgatacacccacctcggcctcccaaagtgctgggattacaggcataagccaccatgcccagccagtatttatgtttgagacggggtctcactctgtcgcccaggctggagggcagtggcataatcacagctcactgcagcctctacttcctgggctcaagtgatcctctcgcctcagtcccccaaacagctggggctacaggcatatgccaccatgcccagctaatttttttgaattttagtagagacaaagtctctgttgtccaggctgatcttgggctcctgagctcaagcaatcctcctgccttggcctcccaaagtgctaaaattacaggtgtgagccatcacaccaggcctccaattactctttttgaagaggatactatataatcacaactgatgggcattttttctcccctgtttttcttcataaaatccatgtgaatatctatgtaatgttgttcatcaaaagccaatgcatagcctcatcaaaaagtcagagctaaactacaactatttattcattataaacttagttactcaattcatgcagcatgcaaactacaagcaaacacaggcaggattattctcacctttacctgctctatatgtcttggcttgattcactggcatgggcgtcataggtattgggtataaaggcttgagagaattaaaaaaaaaattaacattaggcacctatgataataacaaggtattctgtcactcttagttttatattgctagagagctaggcatgagaaggtttcctgattctccattagtcattaaaaaattagatcatacccacagctaaaaggaacaaaccccaaactacagtaaatctaaaccatctttttcacagaaaacattctcagatttaggtcctcatacttaacaacacactgaatctctgcatgcctgtctgtttcaaatgcatatgcataaccatcacaccctcaagtcactgaaaacctaaagagtgcttggtgtcagatacaaacaattggggaggctaagtgaacatcaaattctatgacttacttgcacgcctgggctcactgggactggatacatcatatttggtgcaaaacaaacaggctgagtataaactggagttggctgttgatgacccaccatagatgggctaggttgtgcttgaggccgaggtgaagttggggtagtagaaggctttggctacaaaaacaacaataaattcaattatctcaaggtaacagatgaactattattgcaatttaaagacggattttcccagtctttctaattttacttgctttaactatgtcccttttattgaaaacaaaaacacagcacataaattttcacatttcaataaaagaaaaaatgtttcagtaggaacttaaaactttgtcaattaaaaaatattaaaaacagtggcagctatttttaagaaactgatggaagtgtttttaaaaattaaaaataaatatatcttcttatgatctcagtcgaataataacaatagtacagtcatctcttagtatctgtgggggattggttacagtaccctgtgaagataccaaagtcttggaatgctcaagtcccttacataaaatcatgtagtattcgcatacaacctatgcatatcctcctatatactttacatcatctctagattatttataatacctaaaacaaggtaaatgctttactgtattgttttggaataatgacaaggaaacgtctgcatgtgttcagtatagattatcctaactatgtttttgatccatggttggttgaatccagtgatgcaaaaccctcaggtgcagaggacgtatctataaacctgacagcctagctagccaaccatcgtcaaattctgggtcagagaaattcaaagatttgcccaagatcacatctaattgatgacaaaacaaagacctttttttaatgtttaaaaagtattcattaatggccatgtaaaaaaaagaaagaaggttggttcagcacactaaaacaaaattcagatggcaggtatggaagaaggactattactaataatttttctttttttgggactagataacctcaaagaaagtaataaacctacctgagagaaggaacgtgggttgaactcctttgcattgggattcaatgttgatttcctaacttgcctaaaaaaaatataaaggccagtgaaatctacatggactttacgttgctctaaaatcttccatacctgacaatttaaaaaaaattgctaaatatagatttaaactgttctcactagaagatcactaatcgtttttattgaaacatatacacttatattgcccattccttaatcccttaaagaatacagccataaaagaacaattttttaaaaatctgagtaatatacaaccgttcctctcaaaggcaatcaaaaaatactttttttttttccttcacagagtcccactctgttgctcaggttggagtgcagcagtgcaatcttggctcactgcaacctctgcctcccgagtttaagccattctcttgccttagcctcctgattagctgggattacaggagactgccaccacgcccagctaattttttttaatatttatttttagtaaagatggggtttcaccattttggccacgctgaccttaagtgatctgcctgactcagcctcccaaagtgctgggattacaggtatgagctaccacgcctggccaatcaacaaacacttgagctgaaaagacagtagctacttatgaaatatccttaaaagcaattcttaacataacagtatccttttatttatttatttatttatttttgagacagagtctcgctctgtcacccaggctggagtgcagtggcatgatctcggctcactgcagcctccaccttctgggttcaagcaattctcctgcctcagcctcccgagtagctgggatacaggcacctaccaccatgcctggctaatttttgtatttttagtacagacagggtttcacatgttggccaggctggtcttcaactcctaacctcaagtaatctacctgcttggacctcccagagtgctgggattataggtatgagctaccagtcaacataccaatattctagcatgcagtaattcttatgtgagaagatattttacatgacatacctggaaaaagtcatggctgtaaaaaaaaattgcctcaaatcaagaataagcagtccccaatttatcaataagctgcattccaaaacttcagctttaactggattgtttggtacccaaacacctaagtcaatggtagttaagttctgaggttagcccctaaaagtccatttaattaatatactgaatgtgcagaattaagtctatcttaacaaatctaaacattaactaaaacacagtttctgatgaaaaatattttgaattccaagtagaagcaccgcatgcttctctccttgacagtggcagtttttcaacctagcagcacagtgagggtgactaatgagtggaatccagtaaagataggtcccctgaattgataatttttcaactcctgttcatttacagaaaaacttttcttaatttatgccttgtttttctagccctggggtacaaaaaaggggaagaacagaagagtagcacagggtgcaataacctcatttacttaagatgtcatttgtttggactagctgtttgtaaactaagggcaatgtataaagtagtctaaaagtccagatggattcttcacagttggaaggacctaaatgcctttaaaaaaaaaaaagttaattgagtaacaggatggtctaagttccaggtttactcactcagctgcgtctttcttctcttccttatcgtctttctcttgtttacatgctgggctggaagtctgaaccccttgggaagtgacctcaggtcccctcttgtgctccgtgttactaagtattgaaggggaaatgctggggctattcggcttgctgctgccactggtacagttgctgctgctattttcaatgaaagaatccttagcacttggttcaattttgtctttgatcaaatctcttgatttttctccctctctatttttgtttagtagttgatccatagattcagaagtagaacttggctgtaactaaataaaggaaacaattatacttaaatatcttaaataactttagtaatacatttttgccatgagcacaagctacgtaatattaactatacgcatgaaatgttctgaataaggcttttttcatactttaagagtaatgcttttactataaactaacaataacagagtacctatatagcacaaccacagtcaccaaagcactcaaatgtcctagcctctaaagttcaatatttactgagtgcttaccacatgtcagaaattgtgcctgctgggtgagaaaaatatgaaatagtttctatcctcttatacttgtcatttaaataagatcagacacttcacaataaaatgagtaaatgctaagagagtctatagaaaaagcaacctataaaaaagaaaggtttctcagtaaagtgtcagctagtctaaggtgtgaaagaagtttaggaaaggtgttgggatggagaatagtctaagtaaaaggaagagtatgtttaaaaatccaaagaaaagggagaagctggctctatcacataaaacaatagcaccaatgggggccgggcacggtggctcacgcctgtaatcccagcactttgggaggccaaggcaggcggatcacgaggtcaggagatcgagaccatcttggctcacacgctgaaaccccatctctactaaaaatacaaaaattagccaggcatggtggcaggcgcctatagtccctgctactcgggaggctgaggtaggagaatggtgtgaacctgggaagtggagctgcagtgagccaagatcacgccactgcactccagcctgggtgacagagcgagactccgtctcaaaaaaaaaaaaaaagatagcaccaatgagctgggcacagtagctcatcactgtaattccagccctttgggaggctgagacaagcagactgcttaagctcaggagttcaagaccagcctgggcaacatagtgataccctgtctcatttaaaaaataataataaaataaaataaaataacaaaaataaagaagtaaagaaaagcaccaatggctggaccaagggtgagacacacatgtacaagtgagtcagaaaatgatagactcgtcaaaaggaatatgacaataaaggaacttaaaagctatgttcagggctgcgtgcagtggctaacacctatcatcctagcactttgggaagccaaggcaggtggatcacttgaggtcaggagtttaagaccagactggccaacatggtgaaactccgtctctactaaagataaaaaaaaaaaattagccaggcgtgatggcacacgtgtaaatcccagctacttgggaggctgacatatgagaattgcttgaacccaggaggcggaggttgcagtgagccaagatcacaccactgcactccagcctgggtgacagagcaagactccatctaaaaattaaaaaaaaaaaaaaaaaagttttaaaaagctacgtttaggactttggcttttaattctcagggcaaatgggcagtctatacggaattttaagtagggtagagtactgggcagatttatagttcagaaaggtgaacacagcagctttgtgtgaaatgaactggagggaggctaattaggatgtggagggaccgtcatggaggctggactaagcgctgggcctagtcagcttggaaggtcattaagtaggtgaattcagaatgagacctgactgtacatattggtcagttagacattctaaacccctaagtaaaaaaaggagatggcaggggagaagagacagagcatggtggccaaacagaaccttccagtgatcatccccaacaaggagcaccaaattgaacaactatccacacaagaaagcaccttcataagaaccaaaaattaggtaagcgatcacagtacccagttttgacatcctatcaaggaaaaagacaccaaaaaagataaggaagatagtcttgaactgcccctccaacacccctgacattcccccacaatgcagtgtggggtggagaaagaatctgtgtgctcgggggagagagagagaaatgactgtgggattttgcattgaaactcagtgctgccctgtcacagtggaaagcagcataggacagaattcagccagcacccacagagggagtatttagactagccctagtcagaggggaattgtccatcccagtgattagaatctgaatttcgggctgggcactatggtctgtaatcccagcactttgggaggccgaggcggacggataacctgaggtcgggagttcaagaccagcctgaccaacatggagaaacctcatctctactaaaaaacaaaaaaattagccagaggtggtagcgcatgccggtaatcccagctactcaggaggctgaggtaggagaattatttgaacccgggaggcggaggttgtggtgagctgagattgcgtcactatactccagcctgggcaataagagcgaaactctgccaaaaaaaaccaaaagaatcttaattttggtaagccccaccaccgtgggtaaagtcctctggggtcctaaataaacttgaaaggcagtctagaccagaaggactgcaattcctggacaagtcatggtactgtgctgggctcatagtcagtggacttggggtacatgtgacccactgagacaccagctagggtggccaagggagtgcttgtgccagccttcccccaactccaggtaccacagctcacagctctgggaggagagggaagagtagggaggactttgtcttgcaatgtggatactagttcagccacagtaaaataaagcaccaagcatagttctgaagcctcaattctaggccatagctcccagatgacatttctagacatattctggaccagaagggaacccattgccttgaagggaaatacctagtcctagtaggattcaccaccagctgactaaagagcccttgtgccttgaataaaaaacaaggtgccatgtcgtattgtgccagcttcagatatgaccccgcacattcacagctgtggtgtccatggggagacccacctgcttgaggtgagagaagagtaaaaaggactttatcttgcaagtgggtgccagctcagccccagtacaataaagcagattcctaaagctcccgatcccaggccctggctcctgggcagcatttctagacacaccctgggccagaagggaacctgctgcactgaaagtaaagacccagttcttgcaggattcttcacctactgactaaagcacccttgggccttaaattaacatcagtggtggccagaaaatagctgccacaggccttgggtgagaccaagtacagttccagtgacggtggccatggcagtgcttgtgtcacccttccccaaactccaagcagctcagcacaaagagagactccatttgtttggagaaatgtaagaggacaagagactgcctggtaatacagggaattctcccagatcttccccaagactaccaaggtgatacctctacagagtcacaacattactagtcttggggtgccctctaatgcatgtatggctgcagtgagcgaagacttagatgacaacacttaattccctttgaatacttgaaaaaccttctcaagaagaatgggagccggatgcagtggctaacgcctgtaatcccaacactctgagaggccaaggcggacagatcacgaggttaggagttcgagaccagcctgaccaacatggtgaaacaccatatttactaaaaatacaaaaattagccaggcgtggtggcacgcacctgtaatcccagctactcaggaggctgaggcaggagaattgcttgaatccgggagacggaggttgcggtgagcaaagactgtgccactgcactccagcctgggcgacagagcgagactctgtctcaaaaacagaaaaaaaaaaaaaagaatgcgtacaaacaaaaccagactacaaagaacagaatacccaactcttcaatgcccagacactgatgaacatccacaagcatcaaggccatctgagaaaacatgacctcaccaaatgaactaaaaataaaggacaccagtgaccaattcccaagtgataagagatatgtgaactttcagacagaattcaagctgaatgctttgagaaagttcaacgaaatccaagataatacagagaacaaattcagaatcctataaatttaaaaaagagactgcaataattattagtaaaaagaatcaagcagaaatcccaaagtggaaaaattcaattgacaaactgaaaaatgcatcagtctctcaatagcagaaatgtatcaagcagcagaaaacattagtgagcttgaattcaggctatttgaaaataaacaaccaagttgggcacgatgactcacgcttataatcctagcactttaggatgccaaggcgggcggatcaccctgaggtcaggagctcaagaccagcctggcaaatatggcaaaaccccgtctttactaaaaatacaaaaagtagctgggcgtggtggcacatgcttgtaatcccagctacttgggaggctgaggcagaagaatcgcttgaacctgggagttggaggttgtagtgagccaagatggcaccactgcactccaggctggtaacagagcatgactctgtctcaaaaaaaaaaaaaaaaaaaaaaagttcttcaatctgcaagaaaaggatgttaacaaacaataataaatcacctgaaggtgcaaaaactcactggtaacaagtacacagaaaaatacagaatattgtaacactgtaattgtggtgtataaactactactcatattttgagcaggaagaataaaaaatgaacctttcaaaaataagaactacaattttttttttttttgtgagacagagtcttgctctgctgcccaggctggacggcagtggcgcgatctcggctaactgcaacctccgcctcccaggttcaagcgattctcctgcctcagcctcctgagtagctaggattacaggtgcgtgccaccacgcctggctaatttttgtatttttagtagagacagagtttcaccacgttggtcaggctggtctcgaactcctaaccttgtgattcgccccacctttgccttccaaagtgctgggattaggcgtgagccactaggccagggttttgttttgttttgtattgttttttgagacagtcttactctgttgcccagactggagtgcagtggcgcactctcggctcactgcaacctgggcctcctgggttcaagtgattctcctgcctcagcctccgagtagctgggattacaggcacccgccaccatgtccggctaatttttctatttttagtagagagggggttttgccatattggctaggctggtctcgaactcctgaccttaggtgatccgcccacctcagcctcccaaagtgctgggattacacacgtgaaccactgcgcctggcttataactacagttttttaagacatagtataataaagatataaataaaaacaacaaaagttaaaaagcgggcagatgaagtgtagagtttttattagttttctctttgcttgcttgtttttgcaatcaaagtttcaagttgtcattggtttaaaataatgggttataaaatgttatttgcaacccttatgtgatctcttttttttttttttttttgagacggagtctcactctgtcgcccaggctggggtgcagtggcacaatattgactcactgcaacctctgcctcctgggttcaagcaattctcctgcctcagcctcctgagtatctgagattacaggcacgtgcctccacgcctggctaagttttgtatttttagtagagatggggtttcaccatgttagccaggctggtctcaatctcctgacctcttgatccacccacctcggcctcccaaagtgctgggattacaggtgtgaaccactgcacccagctgtcatggtgatcttaaatcaaaaacacctacaacagatacacaaaaaatataaagcaggaaattaaaacataccaccagagaaaatcactttcaaaacaaggaagggagggagggaaaaaaggagcgaagaggaagtaaaaaagaagggggaagggagggagtaggactacaaaacaaccagataataagtaacaaaatggtagtagttaagtcctcactaatcagtaacaacactgaatgtaaatcgactaaactctccaatcaaaagatacagagtggctaaatggatttaaaaaaaaggctgggtgcggtggctcacgcctgtaatcccaggactttgggaggccaaggcaggcaaatcacctgaggttaggagttcaagaacagcctgacgaacatactgaaaccccatctctactgaaaatacaaaaaatttagctgggcttggtggcaggcgcctgtaatcccagctacttgggaggctgaggcaggagaatcgcttgaactcaggaggcggaggttgcagtgagctgagatagcgccattgccctccagcctgggcaacaatagcaaaactctgtctcaaaaaaaaaaaaaaaaaaaccaaagatccattgcctacaagaaacacactttacctataaaatcacacatagactaaaattgaagagctggaaaacaatattccatgcaaatggaaaccagaaaagaacaggagtagctatgcttagataaaatagattttgagacaaagtctataaaaacagacaaagaagattattgtataatgataaagggatcaattcggcaagaggttataacaagtataaatacatatgcaaccaatactggagcatccagatatataaagcaaacattattagagcaaaaaagagaaacagacctcagtaacagtcggaaacttcaacaccccactctcagcaatggacagatcattcagacagaaaatcaacaaagaaacattagacctaatttgctctatagaccaaataggcccaatacatatttacagaacattgtgtccaacagctatagaatacacattcttctcctcaacatatggattgctctcaaagatagaccctatgttaagccacaaaacaagtctaaagatttgacgtggcacagtggctcatgtctgtaatcccagcaccttgggaggccgaaataggtggattgcttgagctcaggagttcgaaacaaccctgggacacatcgcaaagccccatctctacaaaaaaaaaaaaaatccaaaaatatcagccatatgtgacggcatgtgcctgtagtcccagctacttggaaggctaaggtgggaggattgcttgagccaggaaggcggaggttgcaggtgagccaagatcatgacatgtactccagcctgggtaacagagtgagactctgttacaaacaaacaaacaaacaaacaaataaataaataaaaattcaaaaaagttaaaatcatatcaactatcttctctgatcacaataagataacactagaggccgggcacggtggctcatgcctgtaattccagcactttaggaggccaaggtgggtggatcatctgaggtcaggagttcgagatcagcttgaccaacatggtgaaaccccctctctactaaaaatacaaaaaaaaattagccaggagtggtggtacatgcctgtaatcccagctactcaggaggctgaggcagaagaatcacttgaactggggaggcagaggttgcagtaagccgagatcgcgccactacactccagcatgggtgacagagcgagactccatctcaaaaaaacaaaaataaaaataaaataaaataacactagataacaagaggaactttggaaagtatacaaatacatgaaaattaagcaatatgctcctgaatgaccagtgggtccatgaagaaattaagaagaaaactggaaaattccttgaaacaaatgaaaatggaaacacagcttatcaaaacctataggatacagtaaaagcaacaataagaggaatgtttacagcagtaagtgcctacatcaaaaaagtggaaaaacttcatctgccaatacatcctaaagaactagaaaagcaaggacaaaacctaaaatcagtagaagaaataaaaaaaatcaaagcagaaataaataaaattgaaatgaagaaaatacaaaagatcaataaaacagtaaattgttttgaagagataaacaaaactgacaaacctttagccagactcagaaaaaaaagagaaaacccaaataataaaatgagagatgaaaaaggagacattataattgttaccaccgaaattcaaaggatcattagagactactatgagcatctatatgctgatacattggaaaaccttgaagaaatggataaattcctagacacatacaacctaccaagactgaaccacaaagaaatccaaaacccaaatacaataacaagtaacgagaccaataacaagtaacgagatcaaagctataagaaatagtctcccagcaaagaaaagccatggacctgatggcttcactgctgaattctactaaacctttaaagaagaactaataccaatcctactcaaactattccaacacaatacaggaagagggaatacttctaaactcattctacaaggccactattaccctatacaaaaccaaaggacacatcaaaaagggaaaactagaagccagtgtctctgaagaacattatgcaaaaatcctcaatataatactagcaaaccgaattcagtaacacattaaaaagatcattcatcatgactaagtgggattcatcccagggatgcaaggatggttcgacatacgcaaatcaataaacatggtacatcttaacagaataaaagacaaagactaaaaaatatatatatatattatttatactgtgtatgatataaatatatatcacatgatataaatatataatttatatcacataaaatgccacatccccttatgattaaaacccttggccgggcgtggtggctcacgcctgtaatcccagcactttgggaggctgagacgggcagatcatgaggtcaggagttcgagaccatcctggctaacacggtgaaaccccgtctctactaaaaatacaaaaaattagccgggcgtgttagcggacacctgtagtcccagctactcgggaggctgaggcaggagaacggcatgaacccaggaggtggagcttgcagtgagccaacattgcgccactgcactccagcctgggtgacagagtgagactccatctcaaaaacaaacaaacaaaaaaaccccaaagaactgggtatagaaggaatatacctcaacaaaacagaagccatatatgacagacccataactagtaccatactgaaaagggaaaaactgaaaggctttcctctaagatctggaacaagacaaggatgcccactttcaccattgttattcaacataatactcggaagtcctaattggagcaatcagacaacagaaagaaataaaaagcatccacactggaatggaagaagtcaaattatccttgtttgcagataatatgatcttacatttggaaaaacctagactccaaaaaagaaaaacctattagaactgacaaacaaattcagtaaaattgcaggatacaaaaatcaacacacaaaaatcaggagcatttttatatttaacagcaaacaatctgaaaaattttttaaacgcaatcccatttacaatagctacaaatataataaaatacttaggaataaacttaaccaaatgagtaaaagatttctataatgacaactttaaaacactgaaattgatgacacagaaaaaacatgaaaagagattccatgtttatggattagaagaattaatattgctaaaatgttgataatactcaaagcaatctacagattcagtgcaatccctatcaaaataccaatgacattcctcacagaagtagacaaaaataattctaaaatttgtagggaaccacaaaaggcccaaaagagcaaaagccatactgagcaaaatgaacaaaacgggaggaatcattatctgacttcaaattattgtaaccaaaatggcatggtactggcataaaaaaagatatagatcaatgaaacagaacagagaactcagaaatgaatccatacgtctaagtgaactcattttccacaaagaagccatgaacatacactggggaaaggacagtctcttcaataaatggtgctgggaaaactggatatccatatgcagaagaatgaaaccagacccctgtgtcccaccatattaaaaaaaaatcaaatcaaaatggactaaagatttaaatctaagacctcaaactatgaaactactaaaagaaaacattaaactcccagggacattactctgggcaaagatttcttgagtaataccccaaaagtacaggcaaccaaagcaaagatggacaaatgggatcacatcaagttaaaaagcttctgcacagcaaaggaaaccatcaacaaagtgaagagacagcccacagaatgggagaaaatatttgcaaactactcatctgacaagggatcaataaccagaatataaaaggcactcaagcaactccatagggaaaattttagtaactcaattaaaaatgggcaaaagatctgaatagacatttctcaaaagacgacatacaggctgggcgcagcagctcacgcctgtaatcctagcactttgggaggctgaggcaggtaaatcacctgaggttaggagttcaagaccagcctgggcaacaaggagaaatcccgtctctactaaaaatacaaaaattaggcagacatggtggcaggaggcaggagaattgcttgaatccgggaggtgtagggcgcagtgagccaagatcacaccactacgctccagcctgggcaacaaagtgagactctgtctcaaaaacaaaacaaaacaaaaaaaaaaggaagacatacaaggccaggtgcagtggctcacaactataatttcagcattttgggaagccaaggtgggaggattgcttgagcccaggagttcgagaccagcctgggccaaacagcaagacctcatcgttatttatgaatggcaaacaggtatatgaaaggtattcaatactactgatcaccagaaaaatggaaattaaaactacaacaagatatcatctcaccccagttaaaatggcttttatccaaaagacaggcaataacaaatgctggtaacgatgtggataaaggggaaccttcacacactgttggtggacatgtaaattggtaaaaccactatggagaacagtatggaaattcctcaaaaaactaaaaatagagctaccatatgatccagcaattgcactgctaggtatatactcagaaaggaaatcagtttattgaaggaatatctgcactcccatgtttactacggcactatatacacaacagccaagatttggaatcaacctacgtgtccactgacagacaaatggagaaagaaaatgtggtatatatacacaatagattaccattcagccataaaaaagaatgagatcctgtcatttgcagcaatgtagatggcactggaggacattatgttaagtaaaataagccagggacagaaagataaactttgcatattcttactcgtttgcaggcactaaaaataaaaacaattgaacacatggagatagcagaatggttaccagaagttgggaagggtaatggggagaagaagggaaatgaggtgattagtgggtgcaaagaaaatttagaaagaacgaataagaactctgcaggaccggaggcagaaatgaaaaagatattaaaatgatttaaaataattttaaaggccgggcacggtggctcacgcctgcaaccccagcactttgggaggctgtggcagccggatcacaaggtcaagagatcaagaccatcccagccaacatagtgaaaccccgtctctactaaaaatacaaaaattagctgggcgtggtggcacgtgcctgtagttccagctagtcaggaggctgaggcaggagaatcacttgaaccctggaggcggaggttgcagtgagttgagactgcgccaccgcactccagcctggcgacagagtgagactccgtctaaaaataaataaataaaataagtttaaaatttaaaaagttaaataaagaatgaataagatctagtatttgacaacaaagcagggtgactacagtcagcattaatttgttgtactttttagaataactgagggagtacaattgcaacgttcattacacaaagaaatgatgaatgatgatggtgatggataccccatttaccctaatgtgattattacacattatatgcctttatctaaatatctcacagaccctatgaataatacgtctactatgtacccataaaaaaataaaaacctttaaagtagactgcaaaaccaaggaccatcaaaaagaacagaagacaaagatattagcaaaataagtgatgaggtttttaagtttgcagaccagaaaaaataaaatgctaccactggctgaagatgatttaagatggcatcctctacaaaagaaagaaaacaggaatggctgaaaaaagggggagcaagtacaagcaacaaaaacagaacctaagccacaggttaggacaacggacctaagccacagccccaggtggtgagaaacaagctaaagagaaacctacacagccaaaaaggttgccttaaaattagagagccaagatacctcttcagcctcagtataggcaaaccaatttcaatggtttcattaccaaggctcttggtgtcatggcaaacagcattatgcaactctggcgcatcgcaagctttactgcattaccaatatagctaaagagtcaagtggctaagggcaaatgttgacagggtatttatgtgggcacactggcaatttaagtcacgatgtaggaacttactacttaaactttcatttgttcacaaaaatctttagtagaggcgatccacataacagaccaactatatatattgccaaggacttcggagtttaattatcataagagttcttgagtgaaggcaaaaatcagacttttggtgttgctttttcttacaatgtcaaacacatctgcatttcttactatgggttggacacttttttttttttttccaaacagggtctgactccgttgcccagactggagcgcagtggtgcaagctcacctcactgcaacctccatctcccaggctcaagtgattctcccacctcagcctcctgagtagctggtactattagcatgtgccaccacacctggctaatgtgtgtatttttttgtagaaacagggttttaccatgttacccaggttggtctttaatgcctgagctcaagctatccacctgtctcagcctcccaaagtgctaagattcaggcatgagccactgtacctgtccagacactgttctaaactatttatagacttattcatttagtcttcacaacagccctatttgatgtagatactattattgccatcttacaaatagcaagtccactagttggtatctgaatatagcactctgctgtattggaatatattgttctaatgctatattgctatatatggaatatagcactctgctgtatttcctctctgcactatactaaatctaatggaaaacttaagttctttttttttcttttttttggagacggagtttcgctcttattgcccaggctggagtgcagcggcacgatcttaactcatggcaaccaccgcctcccgggttcaagcatttctcctgcctcagtcttgcgagtagctgggattacaggcacctgccaccacgcctggctaattttttgtatttttagtagagatggggtttcatcatgtcggccaggctggtctggaactcctgacctcagctgatccatccacctcagcctcccaaagtgctgggattacaggagtgagccatcatgcccagcagaaaactgaaattcttatgtgactccacatgaaatggtacaatgacaccattgtacatactctgtacaatactgggtcatctatattttgctagtaagaatgaacatgtattgaatacataccatgtgctaggcactatgctaaacactttataggcaatatctcatcgagctctcacaggaacactatgaagcaggttctaaaattaacccattttggcttgggggaagtagatagcatgccacaatgttacgcacatgatgtatagaggccaacattcaaacctaggtccatttacctctaaaacccacattattaacccaaaacagatcaaattactagcaattcttacacaaataaagctatcagcactctgcatatggctcaaaagggaaggaacaacaaacacacaaggtatttctatttctgcctaaatgaaggactacagatatttgtgaacaaatgcagtttggggctatgagcatgtcatgaagttagctctaatgaatcactgactgacagtgcagcatgcactatgcattagttactattcaaagcactgctagaagcttaaacaccagatggtcagccctcttacttactagccatgtgagtttgggcagattacttaacttctctttgcccaagctgcctaatatacacagtgcagatacaaacagaacttgcttgacagagatgttagacaagatttaacatacaagcatgaagaacagcatctggtacacaggaaatacgcaataaaacataagagaataacattatattatctgaagagaacaattagaaagttcactcttttatttttttttaattaaaatttaagttctgggacacatattttttttttccactctctttttttttctttgagacagattctcgctctgtcgcccactgatgcaatctcggatcactgcaacctccacctcctggattcaagtgattctcctgcctcagcctcctgagtagctgggattacaggcatgtgccaccatgcccggctaatttatatatttttaataaagatagggtttcgccatgttatccaggctggtctcaaactcctgacctcaagtgatccacccgcctcagcctcccaaagtgttaggattataggtatcagccaccgtgcccggcccactctcattttttaaaaaccacttcttttcttcctggtatgcccctatggatcaaggagttattagtaagaggctaaataatacatttggttattcaggcacctaaaagtagtaagactaaaactcctaaagagataagactttttatgttgctccttcttggaatttaagtcaagcattaatgaaggtttacagaaagttgtgctgatagctaaaatgttttctgctaactgaaaaagtacagccttttaaaatacagtaactctaatcaagacagtatggtactgccataaggataagacatagagattcagtggaggacaattcagagtccagtaataaactttcacatttgtagtcaacagacttccaacaagcatgtgaagataattcaatggaggaaagaatagtcttttttttgagatggagtctcactctgtcgcccacactggagtgcatgatctcagctcactgcaacctctacctcctgggttcaagcgaatctcctgcctcagccactacagtagtgggactagactacaggtgtgcgccaccacacccaggtaatttttgtatttttagtagacatgcggtttcaccatttggtcagactggtttcgaactcctgacctcatgtgatctgcctgcttgggactcccaaagtgctgggattacaggcgttgagagccactgtgcctggccaagaatagtctttttaacagatggtgctgggacaactaatacctacatacggaagaatgaatctgaacttacacagtaaaaatggttataagtgtatggttatgtgtcaattagaaataaaaaattaatataaagaatgaatttgaaccccaccttatgctatattaaataactgctcaaaatgggctgagcaccaagtcactctcctatgaccttttttaattttttaataacaatttgtttcacttaaaaaaaatcaaatgttattctcataatattgttataggaaaggggtcccgatccagacccccagagagggctcttggatcttgcacaagaaagaattcagggcgagtccgcagtgcaaggtgaaagcaatttttcactttgggaggctgaggtgggcgtgtcacttgagtccaagtgtttgagaccagcctgggcaacatggcgaaattctgtctctacaaaaaaatacaaaagttattaatagcaaggtgtggtggtgcacacctgtagtaccagctactcatttgagcccaggaggctgaggctgctgtgagccaagattgcaccactgccctccagcctaagcaaaagagcgagattctgtgtcaaaagaaaaaaaaagttgctccaaatggatcacacctctaaatgtaattcttaaaaaaacccagaagagtaataaaccttaatgattgatgaaacagtattttcttagatacgacaccaaaagcttacttcaaaatcagataaattggacttcatcaaaattaaaaatttttgtgcttcaagggatgaaaaagtaaaaagacaaccaacagaacaggagaaaacatttgcaaaccatgtatctaacagggacttgtacacacaatatataaagaactcccacaacccaataataaaaagacaactcaatttttaaaatgggtaaagatttgaacagacatcaatccaaagaagatatataaatggccaataaacacaaaagatgttcaacatcattagccatgaaagaactgcacattaaagccacaatgaggttaacacttcacacccacaaggatgactataatcaaaaaagacaagacaataagtgttagcaaggatgtggagaaacagaaaccctcataccctgctggtgggaatgtaaaatagtgtagatatcttggcaaatagcttggtagttcctcaaaaggttaaacacagttgccatatgacccagcaattcaactcctaggtaggtacacaaaagaaatgaaaagataggacgagaaaaaaactgcacactcatgtttgtggcagtgttattcagaatagtcaaacagtgagaacaccacaaatagctacaaactgattaatggataaacaaaatgtggtattatccacatcaaggaatattagtcagtcacaaaaagaaatgaagtactgaaacatgctccaacatggatgaacttttataacactactctgagtgaaagaagccagtcataaaagccacatattttattattccatttgtatgaaatggaatttgccccaaataagcccatccatagagacagaaagtagattaacggttgcttagggttgggagtaggggaaagagaagggctggaggcaaatgtggaacgactgctaaactgggcacggggtttcttttgggggtgaagagtatgttttaaaatcaactgagaagacggttgtacaacattgtgaatattttaaaaaccactgatttatacactttaaatggttgatttatatatgtaaattatatctcattaaaaaccactgatttatacactttaaacggtttatttatatatgtaaattatatctcaataaagctgttataaaaacatgctaattcacatgcttcaaagtagaaatgttttttcttcatgagatattaaattcaatccaagtgtagtataagaggagactgaatgatgttaaaaaaaataatgctgaggaaaaaattcaaatggggaagaatacctacagcaagacatcattgtccctctccctctccccccctccccctccccctccttctccttctccccacggtctccctctccctctctttccacggtctccctctgatgccgagccgaagctagactgtactgctgccatctcggctcactgcaacctccctgcctgattctcctgcctcagcctgcctagtgcctgtgattgcaggcccgcgccgccacgcctgactggttttcgtatttttttggtggagacggggtttcgctgtgttggccgggctggtctccagctcctaaccgcgagtgatctgccagcctcggcctcccgaggtgccgggattgcagacggagtctcgttcactcagtgctcaatggtgcccaggctggagtgcagtggcgtgatctcggctcgctacaacctccacctcccagccacctgccttggcctcccaaagtgccgagattgcagcctctgcccggccgccaccccgtctgggaagtgaggagcgtctctgcctggccacccatcgtctgggatgtgaggagcccctctgcccggctgcccagtctgggaagtgaggagcacctcttcccggccgccatcccgtctaggaagtgaggagcgtctctgcccggccacccgtcgtctgagatgtggggagcgcctctgccccgctgccccgtctgggatgtgaggagcgcctctgcccggccgcgaccccgtctgggaggtgaggagcgtctctgcctggccgccccgtctgagaagtgaggagcccctctgcccggcagccgccccgtctgagaagtgagaagcccctccgcctggcagccaccccgtctgggaagtgaggagcatctccacccggcagccaacccgtccgggagggaggtgggggtcagcccccgcccggccagccgccccatccgggagggaggtggggggtcagcccccgcccagccagccgccccgtccgggaggtggggggcacctctgcccggccgccccttctgggaagtgaggagcccctctgcccggccaccaccccgtctgggaggtgtacccaacagcttattgagaacgggccatgatgacaatggcggctttgtggaatagaaaagggggaaaggtggggaaaagattgagaaatcggatggttgctgcgtctgtggagaaagaagtagacatggtagacttttcattttgttctgtactaagaaagattcttctgccttgggatcctgttgatctatgaccttacccccaaccctgtgctctctgaaacatgtgctgtgtcactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcactttttatctgctgaccttccctccactattgtcctatgaccctgccaaatccccctctgcgagaaacacccaagaatgatcaattaaaaaaaaaaaaaagactttatagcaaatttaagattatgcaaaatatcatctattgctcacagatatattcatatgcagtataaatataaagaactgcacagaaaagaaacccttccttttggaaggaaacagggggaagcagctgaggaggggcagatacataagaggagtttaactgtgttagaatgctttatttactaagctgggtagtgggcacatgatcatattcaatattctttgtatcatttgtatgtgttaactattgtttaacaaattgaaaaactttttttttttttttttttttttgagatgcagtcttgctctgtcgcccaggatggagtggagtggtgtgatctcggctcactgcaacctctgtctcctgggttcaagcgattatcctgcctcagcctgccaagtagctgggattacaagtgtgcgccaccatgcctagctaatttttctatttttggtcaagacagggtttcaccatgttgaccaggctggtctcgaactcctgaccttaggtgatctgcccacctcggcctcccaaagtgctaggattacaggtgtgagccaccgtgcccgccaacaaatgaaaacttaggttaacaactgttaatagcattaaagctgaatagatacatgtgctaaagtatgaaataataagtagtattttgaatgttaccaataagtcaagaatgaagctattgttaacatttagaaagctaaaacacaggctgaggaaaggctacctttgcctttggttcactcatcctttaattcagctactttttttaaaaggctggtatttagattttcctttctaagaagctaagtttcaagaagatttattggttggtctcaaaatctacctcgatacctatagtaaataacatgcaaaagaatgaaatgacaatcaaggagagatgttaagtaaagcctgtgctaagacagagaaataatgttacagaaagattttgaccacaatatatttgtgtacaaagtataaatctccaactacctcagaacaccagagtccagtacatcttccatttgccacactagattattaatgacttggccttgctctactaatatctagcttcactgaacaaagtacaaatgaccatcaaatagtaagctgtgctatggtggtttcaaatgtcagggctatactctcatttgatacctacatattgttgttaccaaatctcatgattttagttatcccacttaaaggataggcaaagaccactttaaaaatgttctgctttctacatatatggtttgatgtttctgactgtatacataacgcatttttataaatagataaatctttagtaatgcttattttctaaaactcaaattcatcagttagtacaatacttaccctaaaatcattcttaaatttctttaaatcatcaatctgttttctatgttcagaaacaactggtgatatacctgtaaaattaagaactgttaagacacaggtttatttttaaactttaacatcacattctttttagtatgagatgatagaaattagaataagatataagatcagaaaataatttcaaatattaaatttggattttggaatttgtcaagcaatacatttatctatcacaatagtaagaagaaatgttgaacaaaaatattctgtatgggcatgaaattagacatacttcttcctattcctacagttaagcttaatgactctttaaactctaacctttgttttcagcttttgagaagctaggtgatgtttcattgggtttaatattttctttattccctgcaggagagttctgcctctgatcttgaagcctggaatctttagctagaaaacaattttttaaaaaaaattcagataagttagaaaagcaaaacaagaaaacactgaacaataattttgatttcctatgtttttggaaaataatgctttcatttaaacagaggctttttttcctttgcagatgtcatatgaaacaccaataattttatttatgtaggtatttgacacccaggaatgttaacctttgtaacacagacactatattaaattagtagtattaaacaacatcaaaatttacataaacttttaaatgtgcactaaaaatacttgtctatgaataaaaataacctagaattttttcatataatatcaccctctaacattcaatttcacagctgagattatggatccagaagccctttgttacataccctcactagaaggggtaacagctctgttcgatgcaggactagcaggcgtaggagatgcagctggaataggcatggcaacagcttcagttggaataataccagcttggggagaagcaagaactggcccactgggggtatttccaatactgttctgtctgggagacctgggtctatgagttttaggggataatcttggaactagaagaaagggaaaatgtatttattacattctcagttcaaatgttacttcctaaaagaggcttcaggcttctctgaagatctaggtaaataaaactgtcctctctagcccttaccctttatcccattactgttttcttttccaaaatgttaggaatttgctggcaatcaaaaccacaagtatatgaagaacagcagcaattactaacataagtatgattttctctcctaactaaatgtatcaagtgattctcctgcctcagcctctggagtagctgggattaaaggcactcgccaccacaaccagctaatttttttgtatttttagtagagacggggtttcaccatgctggccaggctggtctcaaactcctgacctcaggtgatctgcctaccttggcctcccaaagtgctgggattacaggcatgagccaccatgcccagccctacacattctttatagcaacatcaaggtccactgtgcagtaattaaggaaacttgagacccaagttagtcaaaaggggaagataataaaagcagggtttgtatcccatatgacttccaagtatatatctaataggtttcatataccattataaacctaactgcagagctcagattcaaaggtttagagaaaatggttcgattatttcatttcagtgtttttttttttttaagtcacaagggtcacggaagaaaactattattcaacaactgccatttttccaattagtaaaaagagaaaatctataatgctattctgagtgtatctccaaaactatgcttatactctctcacttctaatcatgttattctcaaaatttatttccagaccatctaagtaatgtcaaaagattaacagaatagctgaagcagatttttttttttttttttgaaatggagtctcactctatagcccaggctggagtgcagtggcgcgatctccgctcaccgcaacctacacctcccgggtcctggttcaagcaattctcctgcctcagcctcctgagcagctgggattacaagaacgcgccacaatgcccagctaatttttgtatttttagtagagacgacgtttcaccatgttggccaggctggtgttgaactcctgacctcgtgatccacccgcctcagcctccccaagtgctgggattacagccgtgagccactgcgcctgaccggctgaagaagatttttaaaatttttgttttcttggtagtcttaagataattgaagaccaaggaagaaaataaaaagtacaaaggaatttaggatacaattacatgaatgtgcatcacatgaagctgagcagaaatgtatagcaactaaaaacagatttaacacagctgagttttgtttttgtttccttaagcttgaagatcttgtttcttttttcttttttttgagatagagtttcgctcttgtcacccagactggagtgcaatggtgtgatcttggctcactgcaaccttcacctcctgggttcaaatgattctcctgcctcagcctctcaaatagccaccacactcagctaattttgtatttttagtagagatggggtttcatcatgttggtcaggccagtcttgaactcctgacctcaagtgatccacccacctcagcctcccaaagtgctgggattacaggcatgagccacagcaactggccgatcttgtttcttttaaaggttctctggactgattaaaagagaaaaagtgttttttttgtttgtttgtttgtttgttttaagtattctttgtaagctcttgcttaccacagttatgggaacaaagcactaaggactgattggcaaagtagcaaaagcagtcagccttattgtaaaatcatgtcaacgtctagtttttaaactttttttttttttttttttttgagacagagtcttgctctgttgcccatgctggagtgcaatggcgtgatctcagctaactgcaagctccgcttcccgagttcatgccattctcctgcctcagcctcccaagtagctgggactacaggcacccgccaccatgcccggctaattttttttgtacttttagtagggacggggtttcaccgtgttagccaggatggtctcgatctcctgaccttgtgatccgcccacctcagcctcccaaagtgctgggattacaggcgtgagccaccacacccagcctaatttttatacttttatagctgctgtcagcatattccttatgctaatcacaaataaaacttggaccctttatttgtatttgatattccttattatggaaatatagttgggaattagtgccatatacagatgctatagaaacacactacaatgtaagccaaaaataaatgtttatagaatgtactgataaacaaagctgctaaaaagataaggaaatacggtccctccaaatagtgttacatactgtgtttgcctcatattagagaggtactttacaaaactttatagttttacaatatatctgtatttatgaaccttataggaatctcatcacaatcccataatgtagactaggcaagaattattaacactttactcactgcgaaatctcaacttcagaatgagtgtctgacttgctttaatatatgatgaataagtggtagagcccagaataaaaatatgggtttcccaattcctggtgattctactatttttaacatatacatacttacacttcctcaaacagagttgtagctcagccctctttatatctagtgtaatgacaaaatgagtaccatcattatgcccaagtgttacctacccccactgaccactgatgaccacgttccccccgagggactggtccttgctactggaggagtagctgcttcactgggtgggttgtgggatacaaattctaggccactggatatggaacccctcccagcagaaactctgtgatttcgaggatgtcgctgggcctttggggacatccttggaggccctaaggaagaaacagtgaacatcacataaattccatgatattcatcagtactacttttctgctaaatacacccattcacacacacatgcacacacactcactcactctacagtttttccttggttaaaaatagaaaaaaaaaaaacaccatacatatttttttggccatactaattctttcagaattattttgtggaatgccacaaagttttataaataaattttattatttccctttatttttaaagaaagggagggatgaagttggtggtaagaaatcaacaataagatgtcaactcttaaaagaactgtagcaatctgtttcaactatgtcttatttgtaaagaaatatgttactagaaattatgactacatgataaaatatttttaactttccatatattttacctttccctgacccgaattttctacattacttctaaaattagaaaaaaaaaatttaaacagaagactattaatccctatacaccccgataccactaaaacatatgtacatacccttcttaaatttctctaaaattttagtttatttatctcttctatcatgatcatcaattttaaaactcggcttaaaacagtaagcagtaacctgtaagcagtttcttaggcttagcaggctgtgagctgaaaattctattaaagggatgacttgtattagtctattaatagatgaccaaaataactgacatttgggggagaaatcagcactatatgaattgtcaaaattctacattattgattctgccatgccactagtgactactctttctaaatcagtctactgtgcattagaccaatctatcaggtaaaagagtggacagaatggccctcatcagagaagcctactggtgttaacaccaagcgaaaacttccctaatgtcaaagccaaatctcctcactctctcacccggctgccaaactctttagaacttcaaattaatatatgttgccaatagaattattattttatttttatttttataagacagagtctgtctctgtcgcccaggctggagtgcagtggtacgatctcaactcactgcaacctctgcctcccaggttcaagtgattctcctgcctcagcctcccaagtagctgggtatttttagtagagacgaggtttcaccatgttggccaggctggtctcaaactcctgacctcaagtgatccacctgcctcagcctcccaaagtgctgagattacaggcgttagccaccatgcctggcttccaacaggaatttaaacacgaacatgatctttagaagaatgctaatgttatacactataattttcaaatggaaatattcaacatctctgaatgacacagaaagtatatttctgtgtgaagttaatacatgagcagtccttaaatcttaatgtaataaagatgttcacagtcattaatgatcatgttttatttaatatattctcattaaataaacatcgcttactcaaatgatggactacaagaaaaatatcaacagaattttgcatttagtgaccactattaaggcccttttgagcaaagaagtcaccttgaaaatcagtggaacttgctcttcaaggttagatgcttcagtcaaagtcatatgacctgcctgcttagatggtaacaatttatttaaaagtagccaatacagttttctccagggaagcaggagaaacacattttgtgcggaaaactttattagtcccaacataagcaatattaactaattttaatgaacaaatcagattaaaattttaacacaaatattcagaactagtatcaaaaggacattatgattcagaaaacaggtttttaatatatgggtggcatttaaattagaatgttacctttctacaacatatccctgtatttgatatgtggcaatgatggatttagcgccaaatactgaataagaattacaagattttattcttatttttgacgaggaaagaaatagctaaatattcaaattcatatgtcgtttttatcaattttatctcagatcaaggacttcttccagattaaagcagcctttcactatgtaagattgcaaagctaactttaaaaaaattactcagttaaatttagaattcttctggcattctaaaaatcaactactttaatctaagggcagacacgcaaagtcagctacatgggctgtcgctctcaaaaaagacccagaaaacaccatccctgcttatggccaataggaaggttcactaggaccttggccaaagagctgtaaaatgaacctaagttcaagactggctgaagaaagttcatttgtttaactactgtatacagtgcaaataaggagggggaaggctgtggggcagacccttctggggctgtaaagaagcataattatcaggcagagataaaccccctttttaacaacaattcaagagagtttatagcttcacacatttatcaaatttctctctaatgaacaaaaggttaatagaaatagttttaataaactaaagttaaaacacagaaattataggttattaaataatgaagaggaaactattttgtaattataaactcacataggagttaaacaaagacaaacaaaaacatgaacaaattgtggtattgtaccttctgaagacatgcgtttaggcatagtagagacaggagctggagaaccatgagcagaggggtgagacgggggtctggatggccgcgaggggggcctggagggcggccgtgtaggggtggctgcccgaggtggaagagagttgggacctgactggtagcgagaaggtgggcgagaggaaggagatgggcaaggcgatggccagggaacacctgacagaacaaatgatatgaaggaaagtataaaaactaaagaaaaaaatgagggaaaaaagtaaacagaaaaaaagtaaaatgacaaaaatgatttcttgtacattttaaccctttgaggacagtcatttgatttgtgataagttttagcataacttaactgacataaattcacattttactttaacctccttaagattaagtctgtttaaatgaatacacgttcccaaagggttaattaggatctatacacactattgaagaagacagttaagactttgcctattaatcctgcttctataactgtttctcagtaactggttgtttaaaggaatataacatacactagataatttcacataataaatcacaataattcctactcaggagtaagattatttactgtattagttttaactctgaggcataacgaaaataagcagtagctattatatccaattagaaatgctggttccttacaattatctatgattttcatcaggtttacacttgaacccagaactcagtttggaatcttattaagcaagtcccatttaagtagaaataaaacattactcttctagagtttgtgactcctgtgagtatcaaatgataatattcattgctatttcaaaaaaaaagtcttgacctcattaaactagaaaaagggagaccttctaaataatttatacagttaaacacttatctaagcgactgcttaataaatactgcaactacaaagcagtcatcaccaaataaatttatactgatggatatgcctaggtaaagatacagctagtatttaacattacatatcacttaccttaatcttatcaaacagtccaggtctcctctccatagggttccacacacttaagtatcatatatttctcagcccccttcaggttttttaactttaaaattctgtttataaacaactaaaatctttcctcagtgagcaaagaaatttcacccccaatattaagtactgaaaatactcaagagtgtccatttggagaggaattctggagaaaagactcaatgaaaacaaatgaaattggaaacttagtgttctctattttcatctaactttccaaatttaaatagctaaaattgaatgtccactcttttcccacaaagttagtaacatactattgctattactatttccataccatccatagaactgttgttcagtatccctgatttatggaaaagatccacaacctacaagatatattcaacctagatttagaggtagagtaaaaaatgtcttcctactaaagattcaggtttcttttacttaagttgctaaactgtaacatccacccttagactaagggttgtttttgttgttttttaagcaaatttctctagtcactttcttcacatgactcttgatcatgtcttgtattataagttacctcagatcctttcttgaagtaagcataatatagaaacaaataatgaaaattgatctatattaaccacagtgttgcacataggttagaattttccatataaattatgtctaaaaaattttattatccagtgtttttaaaattgagaacctacccaaagtttccaatttctttatatgtgaagtgtttttggccaagtgattgtcttgggttaaatgtagcactttatcttagtacatcatgaatatttcatcatgctaaataatatatatgtcaatgacatatacaatgttttactaatttaatatccacaaaagccaattttaagtaatgctgaagtgaaagctactcaccaaatcattaaagtgcacattcatatcagttatgtaaactattttaagtattttaagtatttagaaaactattttatcaatgatattgacaagtctggtcaaaatacttgcctccattaactactctttggtctgaaccagaattcgggttgaaatctgaagtgtgagaagtggatcttgatggcatggagcccgatccaggctggcccatacgcggtgaattctgtctcccacttccccaggatatgacttctctatttctttgtccaggaggaatatatttattttccctgaaaatgagagatcctctaaatcattttattctaaaaggtaccaagccaatgaaacatatctaaaagtcatctagacagaagggaatgcttgttacaaaaaggttctacactaaaccaaactgcctcactcccagatgcccctgttcttccatcttaccctgagttctaacctctggactgtcccttcccttagattctgctcctaagcacaaagtttaacagatgcgtgctcattctcatcccacttgacctctctatggctgattccatcaatcttggtctatcttcacaacattttttgtccttcactttctcaattttattttctctgagatctcttctctcactggctgttctttggtttttcatggctccaatatcggcaatgctgatgaaacctcaaactgaaccgccagtctcacagtgtcaacatctatcagtggacatgtcaattcaaatcaccagactctaagctgactgcctttaagagaggatgcatctcttactttactagataggtagcaggtatttctcaacacgtttatgaataaatgaaagacccacaagcccacatatgcaattagctgcacaaacggagtcactgtttttcccctcaaacttgctccatgtttcctctctctcttaccagtacatccattaagtcacttagttatcaaataaacctcaggctcatcccttaactaggtggttaccaaattctcacagttgaactatttcagtgcactaactgttctctgtgtctcagccagtcctcaatgccccagggtttattcaccccatctccttccaacagggtgctctttagcatgacatgccaagtcctttaatgacctcagttcctactatcaactgccactgctgcacctgacacagatcctgtgttccagacacatgcaacaaccagccctctcctgagctggccaaattttctcatagccatgcttgtacatggcttttcatcaggtgataaactcttctcccaactcttctctaagtgtcaaagaccctattatcttatcacaaaatgtcacctcctcaatgaggttttctctgactctacaggttatgctagctcctcctcattctgtatgttcctagtactttgaacatgcctttaaccaagcaaatcatattgtactgctgtgattgttacacgtgtcccccaccagataactattttaacaagctcttcaagatcttggattgctcaccgtgatataccaacacttggctccacagagcttactctcaaaagcatattttccaagatcaccataaccttttctctaacagatcttaaaccaattctacttgcattctctacctaagctatattaaaggaagaggaaatataataacaatacaccgtctcacacagaccttgagttgtgtatccaaaatactgcatcatgatttcctttaaatacctagtgtttatgctgtgcccctcacgttcactggaatttctctgaactgctgtgtatttttcttcctcactcctatcatcattttccagggccactcgagctttgtactgggcacttgactcaatttcttctgctaactggtttgcccttgcttcccgttttaaaaattcttctgagttatctctttctaagggcactctgaaacatgaggaaaagaaaagcaaaatgagtcctttaaagccacagtttatgtatctgtcataatcaactactaagaaagtttagagtttagaatactggtaaaaacagaaactaaaactaaaactaaaactaaaagttatagtgatctgtgtatttataaatcaaaattctaacttttttttctgttaccttttctccagaggaacatatttcaaaaactggttaaactgttcaccataatctctgcccttgcaaatttagatattttttaacaacttagaagacaaaaccggccaggcacagtggctcacacctgtaatcccagcactttgggaggccgaggcaggtggatcacgaggtgaagagatcgagactatcctggccaacatggtgaaaccccgtctctactaaaaatacagaaattagatgggcatggtagcacgcgcctatagtcccagctactcgggaggctgaggcaggagaatcgcttgaacccgggatgcagaggttgcagtgagccgagattgcaccactgcactccagcctggagacacagcgagattccctctcaaaagaaaaaaaaagacaaaaccaaaatttgtttagagcataaaaacagggtataggcaaactacatttattccctttttttaatggaaatttatcacagttggtaataagagaaaaattatttcatgtaattgtttaacttaaaaactaacaaacatttattcatcataaattaagctgatgaaaatcaaagacaaatgcactaaaataaaaacaaacttttcaaacttacgtatacgaagataaactgctatcatacgtagacactacaccataattttcttcattatatcgaaacatatcattgggatcccatccattagactagaagaaaatgaagcttgtttttcaaaatgtcaaagtagttgttccctttcattcagttataaccaacatctatattaacaatatctaacaaactacttgagcaaaattagcaaattagaaaataggaaaaaatttccttaaaaatgttttagaaaaatacttatcagcccctccagttgataagtaactatacaacacaattatttgagcagttatttttaaagtttagaacattttaattacttcataaaatagccttcagatcagggttctctcttttctctaacctgtaaaagccacctttcagttagagacatctacatttacctgtaaccttcttgagatcacactggtcctcaggtctgtggaggacaggaggtacatattttacttcttttaaacaagggattccacatggaacaaggggtgctttttaacagccaaaaatacttccaatgtttgggagaaagaagggagaagccaacgctttccctcatattcaacgattccaaggtcggactatggtactaggtccctggcaacctccccttcctcctgggaatgctcaaatgggaaggcagcatgaaacggtgaacaggcaatcactggacaaagtcacaagaactgggctttagaaatggttttaccattagcagttgtgacacctcagaagtggcaactctggatctcaataccctaacctataacctcagcataggtaactccacaattctacgaggaaactataggaaattaccattcgcaaaagggaggctgccttctttttttggtgggggggagccaggggcaagcaagtttattaagaaagtaaataaaagaatcctactccataggcagagcagctgaggctgcattctttaacgtaaaagaatcaaccaattgggccacaggctggaagactatttaccagtgaatattactgcctggataattattctctaatgtttcaactccttttttaaagccttactggtgaaaagtataaagtccagtaaaggttgtaatccatcccagaagaatgaacacatcaaccaagcaatgctgatggcaacctcaatgctaaggcttgcctcgaagttcacctattaaccttgggtcctcctgtgctactccaggtaagactataatgtaagtctaccaccaatgcaattccttttgccaaacacatgggcaggaaatcacacttacttatggaggctttaaaattacttaagtaatgtatgccctacataaaaaaaaaaaaaaaaaagcacacaatacggaaagacatccagtaaaaagtaaatgtcttccaatcccagcgtgcataaataactactattaagagttctggccgggcacggtggctcatgcctggtatcccagcactttgggaggccgaggcaggaggatcacgaagtcaggagattgagaccatgctggctaacatggtgaaaccctgtctctactaaaaatacaaaaaattagccaggtgtggtggcgggagcctgtagtcccagctacttgggaggctagggcaggagaatggtgtgaacccgggaggcagagcttgcagtgagctgagatcacaccactgcactcaagtctgggcgacagagcgagactccatcttaaaagaaaaaaaaagagtttcagccgggcgcagtggctcatgcctgtaatcccagcactttgagaggccaaggtgggtggatcacctgagattaggagttcgggaccagcctggccaacatgttgaaaccctgtctctactaaaaatacaaaaaattagccagatgtggtggcgggcgcttgtagtcccagctactcagaaggctgaagcaggagaatcgcttgaacctggaaggcagaggtttcagtgagccaagatcacgccattgcactccagcctggacaacagagcaagactccgtctcaaaaagagtttcttgggtgtaatttcagacatcttctaggcaataagaatatgaacagctctttaaaaaaaaaaaaaaatttcatggccaggtgcggtggctcatgccagtaatcgcagcactttgggaggctgaggcaggtggatcacgagttcaggagttcaagaccagcctgacaaacatggtgaaaccccttctctactaaaaacacaaaaattagctgggcatggtggcagctactcaggaggctgaggcaggagaatcgcttgaacccgggaggcggaggttgcagtgtgacagagcaagactctgtctcaaaaaaagaaaaaaaaaagcaaataggatcccagtgttctgcaatgtgctttttctcttaataaatcttagatatctttccatattggaacaccattctttttgggagatatgtagtgtttcaattgaatggtgacatcataaatctaactcatgctatattgatagacacttagcatgtttccaatttttcactattagaaataatgctatggccaggcatggtggttcacgcctataatctcagcactttgggaggccgaggtgggcagatcacctgaggtcaggagttcaagaccagcctggccaacatatggtgaaaccccgtctctactaaaaatacaaaaattagctgggtgtggtggcgcacgcctatagtcccagctgcttggaaagctgaggcagtagaatcacttgaacccaggaggtggaggttacagggagccgagatcgcaccactgcactccagtctgggtgacagagtgagactccatctctcaaaacaacagcaacaacaacaaaagaaataatgctgaaaaaaaaaaaaatcctggtcaggcatgatggctcacacctgtaatcccagcactttgggaggctgaggtgggtggattacctgagctcaggagttccagatcaccctgggcaacatggtaaaaccctgtctctgcagaaaaagaaaaaaaaaaaatcttcacatataattatttgcatgtcttatggatatatgagggcaaaaataaattactagagatagaactgctggaacaaagtgtatgtgcattttaaattttgattagcattgccagattctctccagaaagactctatcaatttatccacctcaccaatagtgtaaaagaagtctctgtttcctcatatttttcatacaggtgacgtgatgtacagacttgagaaccattatattaggttatatatgatttgttaaagtttgagaattaatgacatgttgcctgtgtatgtccagttttattactagactttaggtcaaagtaggacatttcaggcttcctgtctgaggaagagtgtcattattaagctgttatgccttaaacatcaaacacagatatgttacaaattctctttctactcaatggaagattcttcattctactcaaatattggtaccataacactcatttttggcaagacactttgctttatatctctatgctctctatcctaaagacagagtctttattaagtatttgtttttatttttatttcttagagaaggggtctccttatgtcattcaggctggactccaactcctgggctcaagtgatcctcctgcttcagcctcccaagtagctgggactgcaggcatgtgccagcatacccagctaagcacttcaagtacagataatgcattaaagagagaaacaaaactagtatgtgacaagaggcgttttagaaataaaagaattttgtggagaataatccaaatttaagaccaagaaatttatgtaatgctttaattccaatgtaacctaattatttatcttaatgacaaccttttcttcagacaagaggcttaaaatgtcctacttcaacctcttctctaggtgaagtcaacaattaagacaccactttccttaggctaccttatttggctgggtgttaaagcaaaacacaccggcatttcccatggtttctaattttaatttaagctacttcttattatttattttaatcacaaagaagtaattcatgagcatccacaagaacagacagtactcctgcttaacccctacaagtaaaatgacaaacatttttctttatatattgcttgggagaaagtctctagttatacaacaaacctgctgctctaaatacactcactacaataacaacaacaacaaaagcacatttaaattacaaccaagtgacaggatgtcatactgaccagagtctagcaataattacaaagatgttacttactacgtcattttccaaagcctcaagttcctcattggctgtgagttcacctgcatcccagggctccaggtccttctctttgtgttcgccattcactttagcactgatagcagagtcagtaaaagcatctgcaaagaatggttttggttgaaagtttatataatctggcaatcagttacactcacacacgtgaattaccaacaaagacatatgttaaaaaacaattacgaaaaatgaatttcacataattgtttaacttaaaatctaacagaaacatttattgaacataatttaggttgatgaaaacaaaagaccaatgcactataataaaggtaaacttaaaacttatgtatgtgaagataaactgctatctaaactgatacggaatatatagtattcagtaaaagtatgctttcacgtttaatttagcaaatggaatcacagatgactatcagtaaaggtattttcttttcatataattttaagccacacgaagcattttttttttttttttgagatagagtctcgttctgttgcccaggctggaatgcagtggcgtgatctcggctcactgcaacctctgcctcccgggttcaagcgattctcctgcctcagtctcccgagtagctgggactacaggtgtgtaccaccacgcccggataattttttgtatttttagtagacggggtttcaccgtgttagccaggctggtcttgatctcctgacctagtgatacccccaccttggcctcccaaagtgctgggattacaggcatgagccaccatgcccagcccacatgaagcatattttaatatattgacataattcattaaattatattacaggtaattactctgcatgtctcagaagtgaccaagaaaatttctggccagatgtggtggctcatgcctgtaataccagcactttgggaggcccaggcaggtggatcatgaggttaagagatcgagaccatcctggccaacatggtgaaaccctctctctactaaaaatacaaaaattagttgggcatggtggcacatgcctgtagtcccagctactcgggaggctgaggaaggagaatcgtttgaacccgggaggtggaggttgcaatgaatggagatcacgccactgtgctccagcctggcgacagagtgagaccctgtctcaaaaaaaaaaagaaaaagaaaatttctatcaatccatcaaaaatatctctttttttttttttcttttttgagatggagcttgctctttcacccagaccggagtgcagtgacaccatctcggctccctgcaacatccaccttccaggttcaagggaatctcctgcctcagcctcccaagtagctaagattacaggcgcccaccaacacgcccagctaatgtttgtatttttagcagagacagggtttcaccatgttggccaggctggtctcgaactcctgacctcaggtgatccacccaccttggcctcccaaagtgctgggattacaggtgtgagcaaccatgcccggcctaaaatatctcttttgtttaatggatgcactaattagatataccttcggagtacttgcagccaaatatatgtggattttgtttttaactttccatattcatgtctatgtacagtggtcaatatcccagcaaactcttgccattagtaaatgaagccattctaagtggtttaacccctcccagaacccacttcttcatatataaccactctgctacaaagttcaggccctacagtattacctgtctcagaaagttcaggtagcaggcatacctggacttcctattaacacactctcactttgtgtcctcttctcttctactaatgttattgaagagtactgacttatgaaagcaaatgtagcatccacatgttagctgaccatactgctgtctggcacaggaaattttctctagttgggagttagactcagctaaataaaggcccactgggcaatgatggcactaggaaacgctctgtagatacaggcttgcatttaaatgactggacccatagggtaccacctactacgaactaaggagtaatacttctgctgatctggctctgctgaggaatataagctcccagccactgttccttcccagtactgtaagttgccactaagaggaggaagggacgaatcaacaactaaacacacaatactcctacaaaagaggttattccagatggattttttatttggcaatgcttctataactgtcattgtctccctaatgggcaaagtgatgccaaaataagaaatctgagccagcaaatttaagcatggaacttcaagcctagctaattctaacctcttcttatcccaaactaggtgtgggtaggtatgagtgtgtgtacctgtacatcagggaataaaagcattaatccacctctgggcttagctgccagctccaccagcagcactactcccattgctagcaattctaagagccaagagtgtgctgagggagttccccagagcagcaggactcagctgggggtggaatggagcattcactagaaatggctgaattttggaaaatctctctaagagattctaagagactaatgctatcttaccaacacctcatctttgctgaaagctactgatggcactagaaatctgaccttatttgatactaacctgaatcacgttcttctctacattatcttaaagttatgtggattgctggcaaaaattaatttagccatgtgtattttcaagaatgtaaaatgttccaagaaaacatcaaataataacctaccttaagatcctgaaatccctttaattctcacaacactagacaaaaaactacactataggaaaattccaaacgagtcatattatcttctggaagaagcaacaggactgttcctttacgtctaagatcctgttaatgtcttaatcatactagtttttgaaaagcacacatttaagtaaataaagcatttatttagatagaagctcagtattaaaaacaatactcttttgattcaagaaattaaagctcgaagcagctagagatttttatagaaccatataaacggatttttttctcactacagggtatgtgtgtgtgtgtgaaaatatttagaaagtcttgagtcaagccgtcttcaaaccaaaagatcccaaatgtacacacaaagtagcttaaatatgtttttacagtattattctaaacaaatttctaaaaggatccccaagtaagagccagtgtggaaaagcaagcaagcgtctaaaactttaggacccaggctttattccactgaccagaatttaggttgtgttaagagggcattattaataaatctatttttctcaatgctacattttaatcttaaatcttctgtttacaataccaaactttttttaaaaaaaagtattcacaggttatgtagcagtctgtcgctttcgagacagaaatggggaaggggaaaacacagaagtgtgattctataaagaatgatattccttggttttaaaatttcaccaaaagtagctctttctaaagatgagtaaaggacttaggggaagatgtgcagaagtggagagttagcacgaaatgaggctatatcatcaggatgctgagaaaatccctggctataagtaatgcatttcaggccaacattgcatcattagctagaaaggaagcaagatctgggtatccattctgcactattaataatatccactatcgtaaattctgatttgttttacagtggttacaagtttggatttttgtttctgtttctttaaaaaaaatttgtttttgtttttgttttttcagagatggggtctttgtcactcatgctggagtgtagtgccgcaatcactgcagccctgggctcaagcaatcctcccacctcagcctcccaagtcgctgagattacaggcatgagccactatgcccagcaagtctggattttaaaaaaaaaaaacactgttggtagtaaatagtacaatgttgtaaccaggattcctgcaaagttgagaaaaaaacaactggctctaatctacaggcaactgtgggaatttgcatgcagattttaccaatgccataagtcaaagaatattaattttccatcatcccctatggtgagaaacaaaagcattgtaacaacaagatgcaagaatacaacgtgactattagaaaagtgttacctgtttctgaaggaactacaggtatagagagaaaaaaggaaaaacataaaaaccatcagatgagatgataaagaattagtttttcaatttataaaagcctctagactagcaggcgatgttggaggaagaaacaaaattgtatcacctccagcccctgtatcccacctccatgctacccccacagcagtgggctctcaacaccttctcttctgattctgggcagaaacttagtcattttgggccggtgatgccacctgctggtggtcataaagaaatgtctcgaccaacgtgtgaacctcttctgggtatccccagccccatacccaggaaacagagtacatattcagcttctcaatctttcctcttttacctctgagccaataatgcctctgaaaaatcattcaaacttgtctgagcattttttaaagggccagaataatggtcaaataactaaaatggtagtgttaaacattagaaataaatatacttaaatgtataaaaactataaaatgacataaaactggatgaaataatcattaacatcagatttaacatcacaaaccctcaaatgtgcttccagagaagtcatcaaaatcctcagctaaccatttcttctcaactaaatcagccttttctcaaacatcaaagttccatataaacctaaaaaatcatattgttttgatcaattcctattcctgcggcactttcaacaactttttaagacagtttctcattatgtgtcatcgttatatgtggaccaatctatatactatataaagtatcagtatatagattggtatcagtgggactatttagtcatttttagcacttactgagtacctacaatgcactcataagtctggacgaggtggggattcacatttgactgatacaattcccagcatttcctgtaggaactaggagctcctgggtgtaagagactagttacagaaatgaagcaaatcttttagaatcgaatacaatgagtgctacaatacaattaaaaacaaagttctaaggaacaaaaggctctgggctttctaaagtgacagtgacagcctatcagcaacagctgatctaggccttcaagaacacaagaagaaaataagaaaggggaagtaaaatggttccaacatagactggagtggcattaaaaatacgtgtatagctgggagcggtggctcacgcctgtaatctcagcattttgggaggcccagtcaggcagatcacgaggtcaggagatcaagaccatcctggttaacacggtgaaaccccatctctactaaaaatacaaaaagttagatgggcgtagtggccggcgcctgtaatcccagctactcgggaggctgaggcaggagaatggtgtgaaccagggaggcagagcttgcagtgagcagagatcgcgccactgcactccagcctggacaacagagcgagactccatctcaaaaaaacaaaaaacaaaaaaatgtgtataggcggggtgcagtggctgacgcctgtaatcccatcactttgggaggccgaggcgggcggatcacctgaggtccggagttcgagaccagcctgaccaacatggagaaacccccatctctactaaatatagctgtgcatggtggtgcatgcctgtaatcccagctgctcgggaggctgaagcaggagaatcacttgaacctgggaggcagaggctgcggtgagccgagatcgcaccattgcactccagcctgggtaacaagagcgaaactctgtttaaaattaaatcaacaggctgggcacagtggctcacatctgtaatcccagcactttgggaggctgaggcgggtggatcatgaggtcaagagatcgagaccatcctggccaacatggtgaaaccctgtctctactaaaaatacaaaaattaggtaggcgtggtggtacacgcctatagtcccagctactcgggaggctgaggcaggcgaattgcttgaaccttgaattgcttgaactactagggaggcggaggttgtagtgagccaagattgcgccactgcactccaacctggcgagagcgagactccgtctcaaaaaataaataaataaaaaatatgtgtataaacattttctgaattgtacacaagaacacaggcttccccagggaagtgggactgggggttagagaggagattatcttttcattgaatactcatctgttctaactgaattgtatactacgagcatatactactacaccatgtattatacagattatattaaagactataatactgaagaataacacaaagaaacaagttggggataagaaacacagttaagggtgcaggatgtatggactggaacaacaaaaccaagggcacaggtggagccacgctcctcaggctagaatggggtaggggtatgatgacaaaagaggactgtggggagcctctagattagggattcttagcctttttcttaatccatgggccccttcaatattttagggaagcctatgaaaccgtattcagaatgtacttaaattcgtaaaatacacaggaaatcaaatgagaacaagtaacaatgaaatgcagttatcaaaaactaaaaaaatctgttggcatagtaacatacatgttcttaattaaagcattaaatattaagatccagtaacaggtttaataactattataaatttaaagaggtgatgaacatacataataatttgaagcctggtgcagtggcacatgcctataatcccagctactcaggaggctgaggtgggaggactgcctgagcccacaagttcaaggccagagcggataccatatcaagattctgtttctaaaaataatttgaggccgggtgcggtggctcacacctgtaatcccagcactttggaagccaaggcaggcggatcacttgaggtcaggagttggtgaccagcctggccaatatggtgaaaccccttctctactgaaaatacaaacattagctaggcgtggtggtgtgcgcctgtaatcccagctactcaggaggctgaggcaggagaatcgtttgaacccaggaggcagaggttgcaatgggctgagactgcaccactgcactcagcctgggagacagagcgagactccatctcaaaaatatatatacataaaataataatttgagatacccataacatcaagcgatatgaaattaactgagttctataggtgcttaagtcataaatactgctaatactactagttgtttgttgcccatatttttaaatggcaaaaaatgctaaatttcacttgaaggttagtgtaaataaagatgtaaatttctcttcatccaaggtcatcaatgccctgaattctctccacaaattctttgagaatccacagatccaggtgaagaatcctgcctctttgtactgacaagcaggaagaaagagcctctgccatgaataaagcaaataggtgagggactggaaggagtggtcatcaaggctgcagaaataggtttaaggaaaaaaaaaaaaaaaaaagtctgctgaactcttctgaggctccagcaagagctggaaaccctacattcctaactaatcagccccccagtgggactttctccagccacacccagcaggctggattaggagtagacagagtttaagatcttagaggaacagagaacactgtgaggggcaagaagagaatagaagtgtaaagtttatagctgtggtcagagtagatcttgaaaagcattctggaagagaagcagttccttccgagtgatgacacagtcatgaaagcaggatgctacaacgccgtggaggtgaaagggatgtatggaacagaacttaggaggctatgtttcctaaagaatagtgttctccaaatgatccatttgaaaataaattattccaacacacactacagttgtccttcagcatctatgggggattggttctaataccccctagggataccaaaatccagggatgcttaagtccctgatacaaagtggtgtagtatttgcatactctcgcatactttaaacctctaggttacctataatacctaatacaaagtaaatgctacggaaatagttgtggtactgcttaaggaataatgacaagaaaaaaagtctgtacatgttcagtatagatgcttttgatttcccatataatttttttttttcttttcagacagttttttttcttttcttctcacactctgttgcgcaggctggagtgcagtgacacaatctcagctcatggaaacctctacttctcaggttcaagcaaattgcttgtctcaacctctcgagtagctgggattacacatgtgcactaccatggccagctaattttttgtacttatagtagagctagggttttgccatgttggccaggctggtcttgaactcctgacctcaggtgatccatctgcctcagcctccctaagtgctggaattacaggtgtgacccacagccccagcgtatttcccatatattttggatccatggttggttgaattcacagctgtgtaacccatggatagagagggctgactgtatttgcaaactaacatttgaagacatcagtgtcccagccacaaaactaagaaatgaatggtaattacaattttaatcattgtctatggtatcatgcctatgtaagagaaaaaaaaacagttattccctggtttaggagtataaaattgggtctagtgagtataaaaatattttttaaaatataaaaacataaaaatataataaatataaataaattaagtttaaaaatataagtatttcagtggtggctcacacttgggaagccaaggcaggtggactgcctgagctcaggagttcgaaaccaacctgggcaacacggcaaaatcctgtctctaccaaaaatataaaaaattagccaggcatggtgatgcgcacctgtggtcccaggtactcgggaggctgaggtgggagaatcacttgagcctgggaggaggaggttgcggtgagccaagatctgcatcaccacactccaacctcagtgatagagtgagaccccgtatataaaaaatatatacatgtaaacttttcaaaaatcaatcaaaggaatatatatatgttgaacacctgttatctgtaagtcactgtatatatactagacaccatggttgggggggacgcatttccttaattctataaatttgttttctgaactccagaaaagtttaatgcattgggagagagaaaatataccggtaaaaaagacactacatactgcttcgtgaagatgagtgtttggtacatgatggagaccactggttctccaactgtacttcatgacaccctatgatgtcttcaggacaccccagaaggcaagggaaagtggagtaagtagggagctaggacatcactagctcttcttccaaccaaagccttgttttaactaagagtcagcatgggatctcatcagagggaaaaaaactgacctattctatactaaaaagaaaatgttaaagtctgggcatggtgactcacacctgtaatcccagcacttggggaggctgagatgggaggatcaagtgagcccaggagttcaagatcagcctgtgcaacacagtgagacatctgtctctacaaaaactaaactaaaaaaaacaaacaaaaaaattagccaggtagggtggtgcatggggaggctgaaatgggagaacagcttgagcccaggaagcagtaagccatgatggcgccactgcattctagtaggggtgacagagagagaccctttctcaacaaataaatacatacaaacataaattaatttaaaatgtaaagtttaacagccattgttacaggcaataaaaacaaaccacaatgagcagggaaggtcagagaagactctaaaaaggacagatgtgggcttggttttgaaaaagtatctaaaactctagttagtaaggtagattcttcacgttgggattaaatccaggagtaaaagaagaaggcacagggggccgcggtggctcacgcctgtaatcccagcaatttgggagcccaaggcaggtggatcacaaggtcaggagttcgagaccagcctgggaaacacagtgaaacccatctctactaaaaatacaaaagttagcagggcatggtggcgcgcgcctgtcgtctcagcttctcgggaggctcaggcaggagaatcactggaacccgggaggcagaggttgtggtgagccaagatcgcgccactgcactccaacctgggcaacagagtgagactccaactcaaaaacaaacaaaaaaagaaggcacaaagttggtgatgtctaacacacagaacatgccagcttagtaggtcaataagtagattaacattgggaaataggccgggcgcggtggctcacgcctgtaatcccagcactttgggaggccgaggtgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccaggaggcggagcttgcagtgagccgagatcccgccactgcactccagcctgggcgacagagcgagactccgtctcaaaaaaaaaaaaaaaaacattgggaaataatgagagataaggttgaaaaagagaagttccactgggaagggccctgtatagcatcccaactttattctgtaaacaacagtggccactgaagattttgagcaagggatgagatgatctaataaaagcaatgtctaagaatttctttatgtcaatgcccaagattgactgaaaatgagaaatctggaagacaagttgtttaggagattataacaatatttgccttggtggaagaaaacaaggaccacacttattttctattttcactgttaaatcttttggtacacacgttttgaactttttaccatgtgtgcatatataatttttaaagtaaagttgtaaacagaaaaaaaaaatctacagtgagatactacttcttactctcccactaggatgggtataatcaaagagacagacaataacaaatgctggtgaggatgtgaaaaacataagaaacctcagacactgctagtaggattgtaaaatgatacagctacgttggaaacagctatgtaggattgtaaaatgatacagccactatgcccaggaaatcagcctgtgcaacagtgagaccccaactctattttcaaaaaataataaaaagaaaacaaaacagcccaacagttatgtaaaaggttcaacatagatttagcatacgagccagcaattatcttgcaggtatgtgtatgtatgtatgagtatgcatacacacacacccccatgagaattgaaaacctatgtccacacgcagttttttttttttttttttttttttgagatgaagtttcactctgtcacccaggctggagtgcagtggcgtgatctcggctcactgtagcctcggcttcccagcttcaagtgattctctgcctcagcctccctagtagctgagattacaggtgcacgccaccacacccagctcatttttgtatttttagtagagacagggtttcaccatgttgggcaggctggtctcgaactcccggcctcaaatgatctgccagccccagcctcccaaagtgctgggattacagaggcatgagccaccacacccggcccacacaaaaactttaaaagtcactgttcgcagcaggattatgtataaatcaaaaggtggaaacaatgaaaatgtccaccaactgatgaataaacaaaatgtagtgtacctgtgtaactgtataatggaatatttggccatgaaaaagaaagaagtactaatacatgctacagcatggaagaaacatactaagtgaaacaagcctatcataatatatatggccagatgcggtggctcatggctgcaatcccagcactttgggagtccgaggtgggcagatcacttgaggtcaggaattcgagaccagcctggccaacatggtgcaaccccgtctttactaaaaatataaaattagtaggtgtggtggcaggcgcctatagtcccagctactcaagaggctgaggcaggagaatcgcttcaacctgggaggcagaggatgcagtgagctgcaatcatgccactgcgctccagcctgggcgacacagtgagactctgtttcaaaaaaaaaaaagaaaaaaaaaggctatatattatatgattccattaatacgcaatgtccagaatgggcaaacctatgaagacaataaatcaatagttgcctggagctggggaaaattgaaacaaacagagaggaactgctaaggggttcagagtttcttttcagggtgatgaaaatgtaaattgattgtagtgatggttgcacaatgctgtgaatatattttaaaaaatgggctgggagcagaggttcatgcctgtaatcccagcactttgggaggctggggcaggaggatcatttgaggcccagagtttgagaccagcctgggcaacataatgagacctcatcaaacaaaaaataacaacaaaaattagccaggagtggtgatacacatctgcagtcccagcttaatcaggaggctaaggtgaatcacctgaacccatgagtttgaggttatggtgagctacgatggcgccactgcactccagcctggacaacaaaatgagaccctgtctcaaaatagaagaaaaaaaaaaacctaattttctccctatctcaaatgaatgattaaattttctagcactacgataaagtgagataaaatagaaaaaaaatccctaagagaaaaatatatcctatttaagtaataaaaagcagtatttattttccttactaatacattctgtttgtgagaggtacaaattggattcttcagttaaaattcaagggaaaacatttataagataaaatacatcatcttagtttgactaagcccattaaataagataaaaggcactgcaattagtaacctttttttttttgaaaccagggtctcacttggctcactgcagcctcaatctccctgcgctcagatgatcctctcacctctgccacccgaatagctgggactacaggtacataccaccgtgtctggctactttttgtattttttttgtagaaacggggttccaccatattgcccaggctggtcttgaactactgggctcaagcaattcatctgccttggcctcccaaagtgctgagattacaggaatgagccactgtacccagccagtaattttatgtttttaaagcaattttcttaagctctaaattagctaacttaaaatttgaactgaaaattgtttagaaatggtatcagttaaaatggtgctgtattttacttcaaaatcaactaaaaaataataaaaaactcaaacttactaatcagattcctctgaaagctgagtgaagatcaatagcccatgctctacagaatcaaatatacatcaaattctacagcaaagcctgagtggtgcaaaactaacaagaacaagaaaaaatatggaaattcacttcatgaggtttgctgtatttaaaaaaacaaggtgacagattccacgtacgtaatactagattgctgattcccacactatctcctaaaaagatcaaaagaagttttagaaaagattccaatacaaagatactgtttatgggtgaacattctgttttcattttctccattaggcttctggatcaggatctattttaagtggggaggaggaggaaaagctagctacctgaaagaaatttgtgccatctcaaaatatgaaattagcctaggcctggtgtgatagcttaagcctgtaatccgagcactttgggaggctgaggcaaagaggattgcttgggctcaggagttcaagacagcctgggcaacatagtgggacctcgtctctacttaaaaaagaaaaattctaaaaagagagtgaaagagacagagagaaagagagaaataaggagaaatcagtccaatcatcgtttgagcacttctttataaaaggtactattttcagctcagaagttaaagagaaagaaaaaaagaaggccgggtgcgatggctcatgcctgtaatcccagcactttgggaggccgaggcggatggatcacgaggtcaggagattgagaccaccttggctaacacggtgaaaccccgtctctactaaaaatacaaaaaattagccgggcgctgtggcgggtacctctagtcccagctacccgggaggctgaggcaggagaaaatggcatgaacccgggaggcggagcttgcagtgagccgagatcgcgctactgcactccagcctgggcaacagagcaagactctgtctcaaaaataaaaaataaaaataaaaaaagaaaaaagaagaaaatgattctgtagaagaactaagacaaaaaaagtaaattcagaaatgttcaagaatcaaaaaacagaatttaggaattgaaatgccaatactattagtgaagaatagtagtcattttataacaacttattctcaaacctatggcaaaagtgttcagaattaggttaaggaaaagtcagtaaaatgaaattaattccaattcttacagctgtacaaatatcttttctgtttccctggcaaatatgtaaaacattttatagattcggattcttttctaataaaaaacagaacaactgttcaagtacacatgcccacttaatattctttcccaggagtatgaaatagaaatagaacaaaatagaaattagagataatttatccacattccttctcttgctttattactagttttaatatatctgcatgcataagactccattgaaaccatccaagacaagagaaaaaaataatactaaaactagatagtaagtatattagcattacacaaccctatcagtaaacagtcttactgaaaatgtcctggaaacatatgcattacttacctattctttacctaatagagagtttaagaatgctacttgttttacttaaaccatcccactagcagtgttaagtgttttgcaactccctcagtaccactaagtagtagtaatctttctcacatttaccattcagcgcaagctgatagacaatcatattccactgctttaaaactgaatttctttaaaaatacaataaaataaaaataaactgcatttcttaaatcattacaagtgaggagggccaccttttcatacattcactggtcatttttaaaactatttttctacttttcccagtttgtggcatgtctttttaaatgtatggtacttttggacacgtctaagtcttttttttttttttttttgagatggagtcactctgtcgcccaagctggagtgatgtggcacaatctcggctcactgcaacctccacttcccaaattcaagcaattctcctgccttagcctcctgagtagctgggattacaggcatgtgctaccatgcctgactaatttttttgtatttttagtagagatggggtttcaccaggttgaccaggttggtctcaaactcctgacctcaagtgatccacccgctttggcctcccaaagtgctgggattacaagcgtgagcaccacacccggcctaaatctttaatctctttataatcaaaggtatcgatcttttacttcatgatttttttgctctggtagtcatgcttataaagtccttctccactcaaaattaaacaaattcacagatttgctccagtgtagtctgggtgttgttttgtttaatcacagttttctcattaatctatttggttttatttatcagtgtgaagtaggtatctaatttgtccccaatgtcccagaatcatttactgaataatccacctttcctccagaattaaagtgctatattgcatattaataaaatacccacataaattcagttttggatgctccatacgtagccactgtgacagttataattcttttttttttttttttttttttgaaacagagttttactcttgttgcccaggctggagtgcaatggcgcgatctcggctcactgcaacctccacctcccgagttcaagcgattctcctgcctcagcctcccgagtagctgggactacaggtatgcgccaccatgaccggctaattttgtatttttagtagagacggggtttctccatgttggtcaggctggtcatgatctgcctgcctcagcctcccaaagtgctggaattataggcgtgagccaccgcacccagctgacaagttatgttttaattctgacatattttgtagggcaagtcctcctttatgactcttgtggaaaaaaatttccaaagttcttctgttaatacacataatctaataagctttagaatcattttgtcaatttctacaaaaacggatatatatatatatattataaaaatttttttttttttgagatggagtcacccggctggagtgcaatctcagctcactgcaacctccacctacggggttcgagtaattctcctgcctcagcttcccaagtagctggtacctgccaccatgtccagatgatttttgtatttttagtagagacagggtttcaccatgttggccaggctggtctcaaactcccgtcctcaagtgatcggcccacctcagccttccaaagtgctgggattacaggcgtgagccaacgtgcccggccaaaactgaatatattatctttagagatttatttgaggaaaattgacaacgttgtagtattaaataattccattcaaagtatggcatgtttccatttagccaaatctacttttatgtctccttcagctgtgtcttcataaatcttcaatttatccccatgtcctatgcttatttttgtttttgagacagagtctggctctgtcacccaggctggagtgcagcaccaccatctcggctcattgcaaactccgtctcctggattcaagcgattctcctgcctcagcctcccaagtagctgggattacaggtgcccgtcacctcgcccagctaatttttgtatttttagtagagccatgtcggccaggctggtctccaactccttacctcaggtgatccgccacgcctggctggtttgtttttgagacaaggtcttgcttgtcacccagctggagtgccgtggcataaccacagctcactgcagccttgacttactggctgcaagtgaacctctcacctcagcccaccaagtagctgggtttacaggagtacaccaccacacccggctaatttttgtactttttgtagagatggggttttgccaagttgccaaggcgagtcttgaactcctgaactcatcctcccgcctcagcctccaaaagtgttgaaattacaggcatgagccactgcacctggcctatttctacactttggattctgctcccatgtatcttgaatcaaccttactcttactagtaccacacagtatttttttatcgtttgtccaaataaaattctattttatgctagaggtttttattttttttatatttaataaatgaagttattgttctgactttggcaaacatgatagggtagagaatttctatatactctaaaaattataaaacatgtaactttaataaatggaagatgaccatatcttaataaacatgtaatgcttttctactgtgtaccacgaactattctgtttagctttccattacatagatccgttccacctgtttctttcttttaatctcaataatctctgtactgcctccatactggcctcaataagtgccactctccagttactgcttggccccagaatgaacacatatctgtgtcttaataaaccacagcaaagttgaggccgtaaacagcttttctaatgtcacgccgttcagaagagatccctgtttgttactcgtactctgttactgatacactatcaagaccaaaaagacaaccatatgagaacacaacagcacaccagaataaaacaatctgtagaattttatttctcactgttctctaattacacattaacactccaacttcttccaactactaaaatctacacaattcttttattttttatttttgagatggagtctcgctctgtcactcaggctggagtgcagtggtacgatctcagctcattgcaacctccaccttctgggttcaaatgattctcctgtctcagcctcccgagtagctgggattagaggcgcacaccagcacaccaggctaattttttttgtaaaatctagacaattatttgcatcgctgactccatttgatattcaatgtcatgcagtacaacattccatttttcttgaatttattcacgtgctttgctatctctaactctaaaaatgcttagaatagagtacatggcgtatatgaactccctgaagaaactgtgaacaccatgaaattacattagcgtgggcacagtggcttgcacctataatcccatcacttttgaaggccaaggtagaggattgcttgaacccaggaggtaaaggccagcctgggaaacatagtgagaaccagtgtctataaaatatttttaaaaattagccgggcatagcggcgtgcacctgtagccccagctacttgggaggctgaggtgggagagtcgcttgagccaggaggtcgaggctacagtaagccatgatcacaccactgcattccagcctgagtgacagagcatgaccctgtttctttaaaaaaaagaaaaaaaattaatttttaaaagaattacatgtaaaatctacatgtgtgtaaatttttctagggtgagggtatacagtttcactaggtacacagtttcactaggttctcaaaagggacccaaaatagattcttgtatttctccgtactgtccatagcaacaagcacagcaaggaacacatcccagagctctctaagtatctgctggatgactatatatgtaagaccacttacagctttttcattctttccataaaataatgcttctacaaaagtgtattaaggcactgaatttcatttattcaaacacatttatattgagcctgtactatgtgccaaagcactatactagaccatgagaataaataataaagacagtatcactgtctttacttggagcacaaagagctcaaactgtaacaggggagacaagcatataattttaatacaacatggtataagggcaatgatacacacatgataggagggaacttgtgtgtggtagctggcagtgtgtgtcatgtggcaagagcagcaggcaaagaaacaaacactggggacacacatctaaggggtgtgtgaaggaaaagaagcccaggaatgaggcagggaaggaatgatcaataaacataaaaaatacagaagaggaaattctgaaggagggtgaaaccaacattcaagtgcagcaataaagacagaaaaagattccaaaggacctggcagttagaggttaatcgtagccttaggcaggataatggctagaagaattcaggattaaaaagaatccttttgggcccagtgcggtggctcatgcctgtaatcccagcactttgggaggccgaggcagatggatcacaaggtcaggagatcgagaccatcctagctaacacggtgaaaccccatctctactaaaaatacaaaaatttagctgggcgtggtggcaggtgcctgtagtcccagctactcgggaggctgaggcaggagaatggcgtgaacccgggaggcggagcttgcagtgagccaagatagtgccactgcactccagcctgggcaagagcgagactctgtctcaaaaacaaaaacaaaacaaaacaaaaaagaatcctttttaggatgagcaggaagtgaataggttttcatgctaaagggaaagattaactagaaaggcagatgttgaagagcccagaaacagagaagtggtataaaagagcaaggagaaaaaaaaagatggccaggcgtggtggctcacgcctgtaatcccagcactttgggaggctgaggcaggtgatcacttgaggtcaggagttcgagaccagcctggccaacatggtgaaaccccatctctactaaaaatacaaaaattagccgggcgtggtggcaggcacctatagccccagctactcaggaggctgaggctgcagtgagctgaaatcacgccactgcacttcagcctgggtgacagaccgagactccatctaaaaaaaaagaaaaagaaaaagagaacaaggaggtaagtagaagggagagagtcaagggcatgattgaagttggcttaaaaatcctctctactaaaaccagaggaaaaataataatgaggccgggtgcggtgactcatgtaatcccaggactttgggaggccaaggtgggaagactcttaggcccagcagtttgagaccagcctgtgcaatacagggaaaccccatctctacaaaaaatataaatataaaaaattagtcaggcatagtgatgtgcacatacagtcccagttatgtaggaggttgaggtgagaggatcacctgagcctgggaagtcgaggctgcagtgagctgtgattgcatcactgcactccagcctgggcaacagagcaagatcatctgaaaaaaaaaaaaaaaaagatggcacggaggaagaagataaatttgtagataaggaaggtagtggttagttgatggagatcttttccattaaccaaccttccccttttatgatttttcactaaatgtgacaaagaatctgttaagcaaaagtaattcttcagactaaatccaattagaatggtcatgaataagaatcgcaggatattatacagtattagaatcaaagcatgcaattagttgtaagtttaaaggacagagcacattctgttacttcaccaaagccagtatagcatgtatttttgatcagtcctaaaaagccctaaatgcagcggaaaatatgatttaggccaagagctggcaaacttttctgtaaagagacagtcaaattttctggctttgcaagtcctacagtcagctacaactactcaactctatggctacagccatcaaaacagccatagacaatgcacaaacgcatgggcatagctatgctacaataaaatttatttactgatgagcagatttgctgacccctatcatctaggctgagaatactgcaaagaaaatgaagcagtaggaaaaagtatgaggaacaatggaataaggaaacagaagtaaagccatagttgagttggagtaaagaggaaaacatgaataatggcgcaacaggaagagcagaaagaaaatgaaggaaaaaaatagaggagaaaggaatactggaaatggatggaaaatcaagtaaaaaacaagcagagataacaggacaattccaaagatacacgaatacagagccaaaagcgactgaaggccctaagaagttttagcaaaatgaagagaacctcagatctgtctgcactggaattcaaataaaggataaatacaaactgattttccaatgataatctgatggtctcttctaattatgaatgtgccaaggtgactcacagctcatatgacgtaaaggtactttcagtttctcagtaaatcaaactggaacatgtataacattcaagagaccaaaggaaacttattcactgtaccgtaagaagtcactatttcaaagccttttattcatttgcatatatgcatgaatataacttttaaactttattgaaatcaatgatgttagcatcaagaacttaaaagtcacactgaccttactcatgttaaaaggtttccccagcagccgagtgtggtggctcacgcctgtaatcctagcactttgggaggccaaggtgggtggatcatgaggtcaggaatttgagaagagcctggccaatatggtgaaaccccgtctctactaaaaatataaaaattagctgggcatggtggcagacgcctataatcccagctcctcgggaggcttaggcagaagaattgcttgaacctaggaagcagaggttgcagtgagctgagatcacgccactgcactccagcctgggtgacagagcgagactccgcctcaaaataaaggtttccctggctgggcgcggtggctcacgcttgtgatcccagcactttgggaggcctaggcaggtggatcacctgaggtcaggagttcaagaccagcctgaccaacgtggagaaacccagtctctactaaaaatacaaagttagccgggcatggtggcacatgcctgtaatcccagctactcgggaggctgagataggagaatcgcttgaacccagaaggcggaggttgcagtgagcgaagattgcaccattgcactccagcctgggcgacaagagcaaaactccgtcccaaggaaaacaaaaaagaaaaaaaaggtttccccaaaaataaagccaaagattaaaaaaaaaaaaaaaaaacttgaacaacataatagtctgcatcttatattgcttgagaattttttttttttttttttttttttacttttagctttatttgtggagaaatcctttaacaaccatggaacttactggctgggcacagtggttcatgcctacaatcccagcaatttgggaggcccaggtgggtggatcacctaaggtcaggagcttgaaatcagcctggccaacatggtaaaaccccatctctactaaaaatacaaaaattacccgggtgtggtggtacgtgcctgtaatcccagttattagggaggctgaagcaagataactgcttgaacccaggaggtggaggttgcagtgcgccaagatcacgccactgtacccagcctgggcgacagagcaagactctgtctcaaaacaaacaaacaaacattaattcgacttatgacaactgagataaacaacaaaccaaaccacataatttatgtcactgcagtataatgttaagaacatgagttagagtagaaaagctagatttgtgtcctcactttagcaagtttcctaaatatgcctgtttcctcatctatgacgtggataatagctgtatctactacagaaacaacttgtgatgattatgtgaacaaatgtaggtaaatctgttagcacagagtctggcacatagaatatgcactcaaattttagttaatattatcaaccttaataatttgacagactattacagaagagaattataaaagctcagaaatgaaatcaattcatatcttttaggaaaatacaatgtcatattagtatactctaatcattcatccacttctattataaaaaacactctatctatccattcaagatgtggaaaagtactatcaaatgataacagcagagactatttcaggcagttgccaattctgagacagaaaggggactgtgaggcaagaaaataaagcacaaattctttttttattctgttgcccaggctggagtgcagtggcatgatctcgcaatctctgcctcccgggttcaagcgattcttctgcctcagcctctccccaagtagctgggattatagacatgtgccatcacgtcccgctaattttttacttttttagtaaagacggggtttcaacatgttggccaggctggtctcgaactcctgacctcaaatgatctgcccaccttggtctcccaaagtgagattacaggagtgagccaccgcacctggcctagaaagcacaaattctcaaggccacagaacagagccactcctgggatctcatcacatgaaacccatagctcacaccctgactgtccagagcctcacccaggctaattataattaaaccaggatccctagaagtgagaacatttttaaaaactccccaggtgactaaacgtgaacccagcattaagaagcattgattaaaccataccttcctttactttgggagtaatctgagtaagtctctaataaaaaataaaaaaaatctagatgcagtaataaatgccttaattttgttattaaggaaaaccatgcggcctggccaacatggtgaaacccagtctgtactaagaatacaaacaaaaaaaaaaattagcagggcatggtggtatgtgcctataatcccagctactcgggaggctgaggcaggagaatcgcttaaacccaggaggcagaggttgcagtgagccgagatcgcaccactgcactccagcctgggaaatagagtgagactccatctcgaaataaaaaaaaaaagaaggaaaccatgccaattaataattctaaaatggttttctccatactgatagtacttcctaattaatacttttcttcttttatagaagagggcaatttctgcctggatagtcttagcttaagagacctgatgtcctaaacacatgacttaatactattttcaggatactacgcactggacgcaattgtataattcactaaaccactgtaagttttgaaataagatacctgcccaggcgtggtggctcacgcctataatcccagcactctgggaggccaaggcaggaggatcacaaggtcaggagttcaagaccagcctggccaacatagtgaaaccccgtctctactaaaaatacaaaaattagccgggcatggtggcacatgcctcagtaaccagctactcgggaggctgaggcaagagaatcgcttgaacccaggaggcagaggttgcggtgagccgagatcaggccactgcactccagcctgggcaacagagcgaaactccgtctccaaaaaaaaaaaaaaaaagagagagaaaagaaaaaataagatacctgaaattactccaatagtggatgtcctcatcaagaaaactaattttgtaatatatagcaaaatacacccatccccttatgagtagagtgagattttcaaagttgtcactctgatctgtattttcttgcctttctataatgaactaaaattatctgagaaatgaagatctaataaagtaataaaaatttaatgacattaattttgaagaggagcaaggaatggactatcacaaacatctcaaagtaatattcactcttccacatttgggaaatatcaattcatcataaaaacaaaaagacaatgcataccgtaaatggctgttaaatgacctggtatccaatagagtagggaacctttttttttgttgtggccaatactctttccagagtgctatgtattaaattcaactaaaattttatcttccaaagtcaatttttgaatttataacagaggaatatttcaatagtataagtataaataatttagtgctcctagacataaacaaaatcaactccaaaggtagcagctaaaaaaagacttgtttccttgtatgggatgctgaaggcctcttaagacaaaaagttgtgaatcaaagacaaggacatttgagaagattcaaaaacagaacactgtgctttcatcagcatatcaagacagttaaagaatacccagtactgttagcctctgaaaaagcaagcaaagagaaagactcctaagtctaagagaaagaatcctggtatattattatttccaagtaacagtgtagaagaatcagcccaacaataaaaacagcttttggtatagatttgaatagtgaaaatcaaattgtactgaactacaatttacaacagaattacgtatttcactacagaatttggcatatacaaataaataaaagaattttagaaccggctgggtgcagtggctcatgcctgtaattccagcactttgggaggccgaggcgggcggatcacgaggtcaaacaatcgagaccatcctggccaacatggtgaaaccctgtctctacaaaaaatacaaaaattagcttggtgtggtggcacacgcctgtagtcccagctactcaggaggctgaggcaggagaatcgcttgaacctgggaggcagaggctgcagtgagccgagatcgtgccactgcactccacccaggggacagaacaagactccgtctcaaaaaaaaaaaaaaaaagaatttgagaaccaagttcaggattgcccagaagtgccttgcaacgtgttactgaacactcaataatgccttgcaaatgagtaacaggaattcccactttgttcatcaatggacacttaaaaagagactaaatttttaatataactacataatcgcttttaaattctcaaaaccttgtctcatactctgaatatttttaaaatacgtatgttctacttcttcaccctttttcattttcattagacaattgttttctaccaaccgttctctacctttcttccttagccttatactttgatttctttccagatttgccacatgcccacttataaactaaagcattgtaggccaaatgggacaagaaattttcagttgaatataatcagtagcattcttgaccacaaaactgtagaaaatgctttacaaactaattttttaagagatcacaaaaactctatttaatttttctctaaagttctaattgttttccaacaaaaatgcattaacattctcatttttctaaaaaattaccttacttgggctattctagaaagtagatatttcttttttctttctttttttttttgaaacggagtcttgctctgtcacccaggctggagtgcagtggtgcggtatcagctcactgcaacctctgcctcctgggttcaagcaattctgtctcagcctccctagtagctaggactataggcgcacgccaccacacacaaaaataaatttttgtatttttagtagagacggggtttcgccatgttggccaggctggtctcgaactcctgacctcaggtgatccacccgcctcagcctccctaagtgctaagattacaggaatgagccgccatacccagcccagatatttctttaaaaaaagtttgtaagatcactgtgaaaatctttgcttgaataaatctaataaaccatgaggcatatttaggaaatcaaaacccacctctttttgcataactggagtccatatctttaaactgtaccacaacaaagtctgaacatttgaacaaaatactctccattatttcttcacgtttcggccccgaactggattctgtacttttctcatgtgcggcatcaagtaccaaatcacactaaaatgaaaaacacaagtaagtactccaaacctttacaaaataaaatttgttaggaattctttagctcatcaaggtaccagttcttatatgcctttgacaaaaataatctcaagagaatcataccctttttcccaggcatatgatctattatccattccatcatttaaaaatcctcatatctaaatgttttttgtttctatggtttgtcttaagtacattaataataatttttaagaggaaaaaacaaaccaccacatccctctattagctcacaatgcttaaaaatggttgaaatattttaataagcacacacatcaagaagcctctctgattacacaaaccagtctataaaataatcagtatttgaaactgagaagtaaaatcattcaaagtggctttaaaaactaggtaaaacactgactatgaaaatgttcttttactttgtaagaaaaagaaaaaaagtaaaaattaccttcggactgtaagttttaaaaactccttcatatatacctccatttttcacttgtacttcacatttggagccctaaaaacatataatttatttatcaaagaaacagtatactacccggtcaccagggatatttgttttcattttactttttatacctcatcaggcttcattcaatattaggtattcactaacaaaacaataaaaaaatttcaaaacattaacaatacactgaactcttgaaattcttcaggaggctctactcagagtttgcagtacgaattttaatactgaagtcaaacatttctgaccccagctattttaagtgacaaaataatgtacaaaagacaatcaactactaacattattttacacacacagcagggttaacaagaatacagctatctgttgttattggtaggggactggttccaggacctccttcagataccgaattacataatacttaagtcacttacataaaatgtaatagtatttgcatataactaagcacattctcccaaatactttaaactatccctaaattacttgtaatacctaatataatgtaaatgctatgtaaattgtcatactgtattgttttaggaataatgacaagaaaaacgtccgtacatctttggttcagacgcaaccatgcctcttttttctcaaaaaaaaaaaaaaaaaaaaaaaaaaaaaaaatttttttttttgagaaggggtctgtctggcactgttgaccaggctgagtgcaggggcattatctcagctcagtgaaacctccacctcccaggctcaaacaatcctcccacgtcagcctcccaagtcactaggactacaggcacgtaccaccacgttcggctagtttttttactttttgtagagacggagttctgccatgttgcccaggctggtcttaaacttgtgagctcaagccatctgcccacctcaaactcccaaagtgctgggattacaggcgtgagtcactgtgcctggcctttttaacaaatatttttgatccaaggttggctgaatccatgaatatggaacccacagatgcagaggaccaactgtacttttacaatgaattatattagactggataaaaggagttctaatctatttctctaaatcatcctgactaaacatgatctaagcaatgttactttgacaatcatttatccacattttaacttcatggaattactttattctacccccaaggcagtttatccccaataatctaataacttacaacaactgatgtaagtatatgaaccatcctcatatttgcatagattccatcaaaagaaatctggaatattaaaaaaaaaaaaaactattagaaattagtacaaactgaatcttcctcatctaaaatgcttgggaccagaagtattttagactgcggatttttttcggatttggggatatttgcattatacttagtgcttgaacatccctaattcaaaatatgaaattttggagcatttccgattagggatgctcagcctgtatttacatttgcatataaagctaacgtttattatttgttgcaaaatgtttagttaggtttatgatatcttacatgtattaagggaagattttgtttatttaatattttgcttccatagagaacagaaggaacagaaggtcaggttttcaagtgttatcagtcaaaccaactaatggtgttttgactaaacatgacataaaaaagcaagagtaaacttccatagaggaggaaggacacaaaccgtaaggatggaagacaaatcaatggttggagagagaggagggttcactgaaaagtgatttgagggattttggtgggcaatgaaactgttctattaacttgattgtggtggtagttacactgattgtatgcaattgttaaaactcacagaaatgtaccctaagaagggtgaagtataaataaatggggtaggaagccaggtcataccttcatagaagaaccctgactaggttctcccagcatatcagcatcagtgacagtgcttaagtctgatcaaccacactactccatattactaccatatacgtgtatatcttcctgattcttgtaaaacaatctaataaaggcaaagtctcaaaaatttgtgatagcttctcatttatttcttccatcatgtgggacttatagtttctgcccttcatgtccggttcaatttcattgataacattccaaaatttaagaccagaaagccaaaggagaaaaatgaaagcagcagaaaaaaagcacattaattcaaaataaaaagcataaagaactctgcagactccactcttggtgttctacgtatcttttggaggtttttcacttagatttgcacttagtcatttagaaaagaacaagcgacttgttcttgttattacacgtgacaaaaatactatttacaaatgatatggtttggttctgtgtccccacccaaatcttatctttaattataataattctcgtgtgtcaagggcaagaccaggtggagataactgaatcatgggggcagtttcccctacgctgctctcatgatagtgagtgagttctcaggagatctgatggttttataaggggctttccctgctttgctcagcacttctctctcctgtcgctatgtgaagaaggatgtgtttgcttccccttccaccatgattgtaagtttcctgaggcctccccagcaatgcagagcatgagtcaattaaacctctttcctttataaattacccagtcttaggtatatctttattagcagtgtaagaatggactaatacaacaagtaattgtacattttatacagagtcattaaaaaaacacatataggctaataacatacttaaacagtcaagttatctatgacaaaattcaaaagaagggaatcttttgccttggcatttggtctgtggttagagatcatgttttagctactaattttccccaataagtaacattaaagttactcaccgtagactgaggcagtcctttgttactgtttcgacctctgaaaagattaaatattatttttattaaattcaacaggctaaataagctgaaaaatatttccaaacttaaaatataattccattcaaataaaggagaggctatctgtggggagagctcacctaatattaagtctaaaggctacctaaggatggctctacctatgcactgcttgcctggagacccacaacaggtaggggtcatagaaggaagcaaactagaaataatcaaacttcatcaaaatcaaataaataaagtaaaatagcctactggaagaaaaaaactaatgctaaacgtaaattaataataattatagccaggcatgtggcatgcacctctagtcctagctactcaggaggctgaggcaggatcaccagagtccaggagtctgaggctgcagtaggctacgatcattccactgcagtctagcctgggcgacaaagcaagactctgtctctaaataataatctttactcccaaagtaaccaatcactgttataaagagctattcagaagcaaaacacggattatattcttgatttaaccaacacagatgactgacaccaagtcacttcccatatttctcccccatctataaaagaaaaacaggtcatatgggccgggcgcagtggctcatgcctgtaatcccagcactttgggaggcagaggtgggcagatcacaaggtcaggagttcgagaccatcctggctaacacagtgaaaccccatctctactaagaataaaaaaattagccaggtgtggtggcatgcgcctgtagtcccagctactagggaggctgaggcagaagaatcgcctgaacctgggaggtggaggttgcagtgagctgagaccgccccattgtactccagccggggtgacagagcaagactctgtctcaaaaaaaaaaaaagaaagaaaaacaggtcatatgattacaactgcagaaaaaaaaaaactgaaaataagctaaatcattcaaagcactttcatttctaaataatatgcgtctatatgtgtggatcgttgtaacaagtgcctttccttgccaactctctccctcagaaaagatgcagtacacaaaatttggctgtcaagtaaagatgaattctattttcaagtgaattatagaatataatacaacctaaagcttattccactgaaaaagattaggccccttagaataattaaaaaacatcattaaagtgaaatgttatatttctcataaacattagtcatgacaataggactggaatctcattttaataaaataatcacaacactcaagccaaaattcaaaacattcaaggaaaagcacaattcagatccaaaaagtctagtaacacgactggtcgatccctagaagagtactcttaacattctgaggccagtcctagcttggtctccaactctgtcacttttcctcactttcttctctcatccagaaaacaatggacttgaattaaatgacatctaggattcctttcatttctaacattctaattctgtaactgtttgcctcaaacatggcacagagataaattcctgaagtctaaggaatatgactaataatttatcttttatagatcttactacaaaaccagacaccatactaagtacttcacatgcaacatgtctaatctatcacctctactttacaggtgaggaaactgaacctcagcagtcaagtatcttgaccaaaatcatccagttcatgagcagtagagctggtatttaaaccaggtgtatctgattccacgtctaagtttttcattcctaggttatgctgcctctctggaactgtatcacaaggaataaactacctcgcctaacaaaaattctatgctttttcaaacatcatttgaatttacagttttggtaggggtgtgggggggtgtacttatagtctgtacatgaaggctaaaatgcctaaatcttacttagaacgatgatctggtatcctggtggctgctgagatgccaagttacaaaaccttgaacaaatgccacgaactgtccttaaactcatatggcctccctacaaagctatataaaagacttaaaaacataatcccctttaaataagtcacactgttctttttagtgattatgtggttacatctttgactaataaaaagtaattgtttgaccatggagtttactcaaaagaacgaatcattcaaccaggaaaatattatcatataaaaaaacagtacagtaaagtgcagaaaccactaatttccactgatctatgacacggttggacacccaacaggaatgttagcatatcgaagcagtattctctgaaatccactgaagtctaaattcttgtttctttttgtatccattcaagttatgctttacttttaatcttttcattagtatctcaaaccaaatattttactatttaatatagtaacaaatactgaaccgcaataaacaaaggccaagagcatattttagacctaagtatatttatgattagatagatcaggtttaacaaaacactaatatccaggactctatgcttttaatagttgccaaatatgaaattcaagtgtgacttaaaatgccagtcaaattaatataaagaaatttacatgctgaatgtggtagctcatgcttgtaatcccagcactttaggaggctgaggcaggaggatcacttgagtgccggagtttgagatcagtctgggcaacaaagcaaaaccctgtttctacaaaaaataaaaaactagccaggcatggtggcacacgcctgtggtccccgctacttggtagggtgaggtgggaggatcacttgagcccaggaggtcaagacagcagtgagctgtgattatgccactgcactccagcattggtgacagagcaaaaccctgtctcaaaaaataattaactaaataataataatacagaagggagaaatgaatggggttgtaaatcaaacaagaatggtatgagctgataactattaaagctgggtgataggtgtgcaggggttcactttaccattctgtctactttcacacaatttcccttaaaaaaaaaaaaaagcaccttctgcttctgatgtgatacaataggatagacctaatcaagtttacagatctaccagtttacgagaaacattaagatggaagaatatattaactgataccatgaggttcctcacagtttaaatccagaatgcagtaaatgcaacataaaaaatgacagttttttgtttttttttttttctgagacagagtctcactctgtcgccaggctggagtgcagtggcacgatcttggctcactgcaacctccgcctcccaggtagctaggactacaggtacgcgtcaccatgcccagataatttttgtattcttagtagagacggggtttcaccatgttggccaggatggtcttgatctcttaaccttgtgatccacccacctcagcctcccaaagtgctgggattacaggcgtgagctaccacgcccggccaaagatgacggtttaacaaataaatcacatgggacaaaaacatcataggaggagaacttatgaattttaaaatacatataaaagcaatgcataggccaggtgtggtggctaaggcctgtaatcccagcactttgggaggccgaggtgggtggatcacgagctcagaagttcaagaccagcctgaccaatatggtgaaaccccgtttctactaaaaatagaaaaattagccaggcgtggtggtgcacacctgtaatcccagatatttggggaggctgagaccagagaatcacttgaacccgggaagtggaggttccagtgagccgagatcgtgccactgcactccagcctgggcgacagagcaagactatctcaaaaaacaaaaaaaaaaaaactacaaaaaaaaaaaacacttaatacacttaaaattgttaaaatggtatattacttatattgcaccataatttaggagaaaaaaaactcacaatctcttcccaaagaaatttcatttgcaacaaggtatgaaagagttaatgatgctttcaaaggcacttggtaggaggagaatcattggagataagtgctaaattgtagttgtctagtttggtggccagaactagggaaagagagctgggaggactcctctgtggattggaacaaatttcaaacactgatctcagaaactatcccttcaaagaagcgcaaatttgatcagatcagtctgtggagcagtttaggcccaaagctccacggaaaacaatgcaggccctccatatctgcagatttcacatcctcagattcaatcactcgagattaaaaacacttaaaaataaatacaataaaaataagacaaataaaaaatatataacaactatttacctagtgtttacaccatattaggtattataagtaatctagaaatgacaaagcatacaggaggatgtgcaccggtatatgcaaatactgtgccattttatgagggactagagcatccataaatttttatatccaacgggggggtcctgggaccaatcccccaaggacaccaagaaatgactacacagcatcacctagtaattagtgtagcttaacagctgggtacagtcaggaaaagagacaaagccatgccaaaatcactgtgattctagagtgatggtaggcatacccaaggctgcatcccaagaaaactagcatcagacgtgtcacactgtacagggagggaagaaggatagaacactaaaatcattcagccagtcattagacaaataagcaaataacagtaacaaccaccacccccaaccataggctaatgaggtatccagagttactacattacttaaaatgtccagttttcaacaacaaaaaaaaaaacgacaagctaagacacaggaaagtataaccccacccactggaaaaagaagtaggcaatagaaattgcttgtataaccagatgtctgacttaataagaatttcaaaagtggtcactataaacatgttttaagaacgaaagaaaaccataattaatgcagtaaaagaaggtatgattggccaggcgccctgactcacgcctgtaatcccagcactccaggaggccaaggcgggctgaaaccccatctctactaaaaatacaaaaacaaaattagccaggcgtggtggcaggcacctgtagtcccagctactcaggaggctaaggcaggacaatggtgtgaacttgggaggcggagcttgcagtgagccgagattgtgccactgcactccagcctgggcaatacagcgagactccgcctcaaaaaaaaaaaataaatgaacagtctctggccgggcatggtggctcatgccttaatcccagcactttgggaggccaaggcaggtggatcacctgaggtcagaggttcaagaccagcctggcaacatgctcaaactccatcactactagatatacaaaaaattagccaggcatggtggcaggcgcctataatcccaactattcaggaggaggtggctgagggaggagaacggcttgaacccaggaggtggaggctgcagtgagccgagatggcaccactgtactccagcttgggcaacaagagcaaacctccgtctcaaagaaaaaaaaatcataaaattaaaatactacataagcaaatactcacttggctgggcacagtggctcacactcataatcccaccacttcaagaggccaaggcgggtggatcacctgaagtcaggagttcaagaccagcctagccaacatggtgaaactccacctctactaaaactataaaaattagccacgtgtggtggcacatgtctgtaatcccagctacttgggaggctgaggcacaagaattgcttgaactcaggaggcggagttcatgccactgcaatgcagcctgggtgacagagcaagactccgtctttctgttttttttgagacagagtctacctctgtcgctcaggctggagtgcagtggcatgatcttgactcactgcaacctccacctcctgggttcaagcaattctcctgcctcagcctcccgagtagctgggactacaggcgtgtgccaccatgcccagttaattttttgtatttttagtagagacagggtttcaccatgttagccaggatggtctcgatctcctgacctcttgatccacccacctcggccttccaaagtgctgggattacaggtgtgagccactgcgcccggcctcgagactccaccttaaaaaaaaaaaaagaaaatatgcacttgccaggtacaatggctcatgcctgtaatgccaactaatccagaggctgaggcagaaggaccacttaagacccggagttcaagaccatcctgagcaacttcgcaagaccccatctctaaaatagttttaaaaaacagtcaggtgttatgcaggtgcctgtagtcccagctacagatgggaggttcacttgagcccaggagtttgaggctgcagtgaactatcatcatgccactgcactccagccttggtgacaaagcaggactctatctcttaaaagagaaaaagaaggcctggtgtggcagctcacgcctgtaatcctagcactctgggaggctgaggtgggtggatcacctgaggtcgggagttggagaccagcctgaccaacatggaaaaatcctgtctctactgaacatacaaaattagccaggagtggtggcgcatgtctgtaatcccagctactcgggaggctgacgcaggagaactgcttgaacccgggaggcagaggttgcagtgagccaagatcaggccaccgcactccagcctgggcaataagagcgaaactccatctcaaaaaaaaaaaaaaaaaaaaaaaaatgtagacagaatgatggaagaaaagggcatcactacttggtaacaccatagtaaataactgtttcaggcaaaagtgtccacagaagctaaatatagtaagggaaagtagaaacagagtatttatataaccacaaagtaactccccacaagatactgatgaaatgaccaagtgaaaaataactttatagtgaagaaacttagtagacacaactctaaccaagtgatcaaagttaacaaccccagtaatgggataaatatatacaatgcactttctgatatcatgcaatgagaaaaacacacaaatcatttctgttgtattcctgccaaaaataaatatctgaatctaatcataaggaaacctcagataaaccctagttgagggacagtctacaaaataacctgtaatcttcaaaagtgtcaagtcataaaagacaaagaaactgctttggattaaaggagaccaaagatacatgataaccgaaggtaacaatcctggattggttcttggacagagggagtaaatacgtatattccacatatatatgtagaatatatgtgtgtatatatatgtgtatatatatatgtagaatatacatatttactggttcttgaccagaaaaatgttgatttgttgattgttttaaaggacattagaaggtctataaacagaataacagtttgacacaattattaatttccttattttgacaactgtactgtggttttgaaatagaatgcccttgttattagtacatacaagttgaagtatttagggctaaagaggcatcatgtctctcatatgtttaataagaatttttattttatattaaatcttacatatacaattaccaatacagagaaaatgttaaggtgaatatggtaaaatgttacttgaagaatacaggtgagatatataggagaattctttataatatctttgcaatttttctaaaagtctaaaattatgtttaagtaaaatgtttttaattggagactataagtgatgtgatttgttaactctatttaatgcattgtccaaggcattttttaaataataatacttaatcctactcagccttgaaactcaaatgccatcttttcaggaagtcttccttcgattatctcaatcaaatatacgatgctgttttcaactctccagtttagatctgtattataattactagtgtatctgtcatatacccactactcaggaccatcacctgaccatattatgcttctgtgaaaatcagaaaatgatgcctcttccagggggtcatagccccacattagacaaaacagtgtggtcggcaagcagtgtctttgtgaaaattaaaagaaggtaccagaagcacatagatatagcccccaaaggcacattgtgtggccaaagaaacaccttgatttcaacatccattcacacttggtcaggaactcttggacaaatgaaaacctaacaaccaagcttggcaaaagtatctttctaccactaccaaaattagcagaggaatcatgcctcatatgatacacactgagtaaatacctaatgaattaacagcccaatcagaacaagggaaagaaaaaaaaagaaagttaaaactttccatttcaaagctatcaatctttaaatcaggggtcaggacactacagcccacaacctgttttggtctggcttctgggctaagaatgatttttatgttcctcaagagttgcttatggtaaaaggaatttgaggggaaatggaaaaaaaaaaaaaggatatgcaacagagaagctatatggccctagagcctaaaatacttattacctgagactttacataaaaagtttgcccatcctcacactgaagaaaaaaaaaaacatagctgcaacagcaatacaacaattaaaaatcaagcagagccaggtgcagaggtgcagcctgtagtctcagctactcaaaaggctcaggtgagaggatcgcttgagcccaggaattaaaggccagtctgggcaacgttacaagaccctgtcttttaaaaactgaaagataaagttgtttattattttacatgaatcagtatttactacttctgcatgggggcatttctggtaaagactggaaaacctgctagacaaattctgtaagagctgcaacactccagtacttcttttctcttttgtagagatggggtcgcactatattgcccaagctggtctccagctcctgaactcaagtgatcctcctacctcagcctcccaaagtgctgggattacaggcataagacaccatgcctagcctccagtacttctaaaataaactgctggatagcattaaattattttcatgaagttttatgtacatataagaaatgtcatgaatgtccccatattctcctttaagtaatgctttatattaaaatttgaggttgatccacctactgaaaaaaaaaacgtattttactagtgtacatgtgatggcaatacatgcatacctcattttattctgctttgctttattgaaattcacagatgctgcatttttgacaagctgaccgtctgtggaaaccccgagtcgggcaagtccattagtgccgtatttccagtaacatgtgctctctttgcgcctgtgtcacattctcataaatctcacaatattttcaaacttttccactattattgtatacgttatagtaatctgtaatcagattgtattttacaataattgtaaataataaagaaaagattgtattttacaattgtaaataataatttacaattattattgtatctgttatagtaatctgtaatcagtaatcgttgatgttaccctgatttcttttaaggcaccacaaacggtccatataagacagcaatcttaataaatgttgtgtgttatgactactccacgaaccagcagtcagcttgtctctctttctcctcgtgcctctctattccctgagatataacaatattgaaattaggccaattaggccaggcatagtggctcacacctacaatcccagcactttgggaggccaaggcaggtggatcacttgaagccaggagttcgagcccagcctggccaacatcgtgaaaccccatctctactaaaaatacaaaaattagccagacgtggtggtgggcgcctgtaatcccagctactcagtaagctgaggcacgagaattgcttgaacctcagagttgtaggatgcactgagctgagatcatgccactgcactccacgctgggaaacagagtgagattctgtctcaaaaaaaaaaaaaaaattacttctcattgacaaaaagctatgatgggaatgtacaaggacataaatgttttcataactgctaacacaagaatcagtccatagcccagggatcaagggataattttgacgtttaagccattttatttaagaaatacggccgggcgcggtggctcacgcctgtaatctcaacacttcggaaggccgaggcaggcagatcacctgagatcgggagttcaagaccagcctgaccaacatggagaaaccccgcctctactaaaaatacaaaattaggtgggcatggtggtgcatgcctgtaatcccagctactcaggaggctgaggcaggagaattgcttgaacccgggaggcggaggttgcggtgagccgagatagcatgccactgcactccagcctgggtgacaagagcaaaaaaaactccatctcaaaaaaaaagaaaaaaaaaaaaagaaatacattctgtaaggctactactgccattcatagccattctctgatggcaaaataaattgaaaactttctaaaaagtattcaccattctagatgccactgagaatgccatccatgagcatgggaggaggttaaaacatcaacattaacaggagttttagaggaaattgcttttctttttttttttttttaagatagagtttcgctcctgttgcccaggctggagtgcaagggcacaatctcaactcactgcaacctccacctcccaggttcaagcgattctcctgcctcagtctcccaagtagctgggattataggcgcccgccaccacatccccgctaatttttgtatttttagtagaaacggggtttcaccacgtttgccagactggtcttgaactcctgacttcaggtgatccgccctccttggcctcccaaagtactgggattacaggcatgagccaccgtgcccaaccaggaaattgcttctaatactcatgaatgattttgaggggttcaggacttcagtagagcaagtaactgcagatgtggtaaaaaagcaagagaactaaaattagaagtggggtcagaagatgtaactgaattgctgcaatctcatgataaaacttgaatagatgaggtgttgcttctcatggataagcaaagaaagtggtttcttaagatggaatctacacctggtgaagctgctgtgagcactgttgaaatgacaacaaaagattatgaatattccagaaacaggccgggcgtggtggctcacacttgtaatcccagcactttgcgaagttgaggcgggcagatcacgaagccaggagttcaagaccagcctcaccaatatggtgaaaccccgtctctactaaaaatacaaaaattagcctggcgtggtggcatgcacctgtagtcccagatactcaggaggctgaggcaggagaatcacttgaacccggaaggcagaggttgcagtaagctgagattgagccactgcactccagcctgggagacagagcgagaccccatttcaaaaaaaaaaaagaacgttccaaaaatgaaatggcctggcacagtggctcatgcctgtagtcccagcactttgggagaccaaggcgggcagatcacctgaggtcaggaattcgagaccagcctggccaatatggtgaaaccccatctctactaaaaatataaaaattagccgggtatggtggcgtgcacccatggccccagctactcatgaggctgacacaagagaatcgcttcaactcaggaggcagaggttgcagtgggccgagattgggccactgcactccagcctgggcaacagactgtctcaaaaaaataaaataaatgtacattttcgtatgtttgtctgtcttattcactgtgttacttaattaacaagcaaaacaatatacacaaacaatctaacacatcctgataactgaaaaacattaaataatctaagaataaaattaccttccattattgtttcaacaactgggggaggccgggcgcagtggctcacacctgtaatcccggcactttgggaggctgaggcaggtggattatctgaggtcaggaactcaagaccagccttgccaacatggtgaaatcccctctcaaataaaaatacaaaaattagccgggcgtggtggcacatgcctgtaatcccagctactcaggaggctgaggcaggagaatcgcttgaacccaggaagcagaggttgcagtaagccaatatcacgacaatgcactccagcctgagtgacacagtgagactctgtctcaaaaacaaaaaacaaaacaaaaaaaaaaactggggagaaaaaacatgcaatctctattggtactgtcaccatacaatataattatagagcttcatgtctttttatttttcaccattctgctcatccatcaccatttttcaacactcctcctctatatgtccttcagtagtttctaatgctatttcaacaagacctgggtaacagatttttttatataatcaaaatatttcattgatccaggtttctagaatcagactggttgtatagaagtaactaattttctttggcataagggtaccacatacctctaacccccttccagtaaaactgtaagaatgctcttccctccagctattcacatggctgcccctttcttgttagttaccaacttaaatgtcacctcctgaaagaagccttctcaaactaccccctctacagcagctccccaactattatgtctacccgttttaatacttaagtaactaatatttagtacatcagttagacaattaactaaaatctagaaatcaagttccacctcttaaggttaactcacttaggtgagtcattttgttcttccaatttcagacttcttgttgttgtttacattattattagaaagggaaatcctataccacgtattgaatattttctccctaaaaagttgagtcaaatgaggtggcaagagggggtaggccatgacaacccaaacacagtgaagctagagttttttttgttttgttttgttttgttttgtttttaggaaactgaggtgggaaggcaactctaaattcacacagaacaactgccagattaatccggtcatataatcatctaggatcattgtttcaaaacaattaccattcacacaagaactaatatcagcattaattgcttgggttcaaattccggctccatcacttctcagctctgtggccttaatcctgtgacttcagctctctgtgtttcaatttcaacatctatgaaatgaagatgaaaatagtaccttctcaaaagaaaaaaaatagtatcttttcataaggttgtggaaattaagtaatattccatacagatcgcatagcttaaaacagtgcctggtatgttattaagtgtttaataactgctagctaatataattatttcctcatattccagcatacactagagtagtaaaggagaaaaaaaaggccagtcgcagtggcccacacctgcaatcccagcactctgggaggccaaggtgagtccaggaatttgagaccagcctggacaacatggcgaaatctcgtctctacagaaagttttaaaaattaggcaggtgtggtggctcatgcctacagttccagttacttgggagctgaggtgggaggatcacttaagcccaggaagtcgaggctgcagtgagccaggatcatgccactggactccagcctgagtgacagagcgagaccctgtcttaaaacaccaccaccaccaccacactcttcatatgaagttttaccccttcagtgcctttaccccttgagtccctctagagaaagggataaaaggcttggtcatgaagccatgaacaactagatccaacctagacacaccaaaaaatccaaacaactcaggtagaaaaggatcttagggctctagtcccatgctgtccaagagaactttgtacaatgatgaagatgtcctatgtcatgctgtccaatattgcagccattaggcacatgtggcagctaagcacttgaaatacgattagtatggctgaggaactgaaatatttaaattttaatcaacataattttaaatttaaagaaccatgtgtggaagtagccacaatactggacagtgcccattcccatcttctcgagttctccagacagtaagccacccccttccacggcattcatatcacctctgacttatgcaccaagaatgcttcctgacaggaaactcaagtctctcccaacgatctacccgttgctcataaacttatccctttctggaggccacaaaacaattgtattccccttcaaaagactatcagtggaggagaggggagtatagctgaaacaacgttggccatttactgataactgctaaagctgagtgacaggtacataagattcatccagctgttctctttctaaatacgttgaaattttacattttaaaaaccttattagcgtttactttaagctcatttcattttctaactgaaacatattcttccaaatgtgtttccttactttcagtgaggaccccctccaattcttctatcacactgtgaaccaaattttttctacatacaccatgtgtatagcaatccctgtactttagcacaaactcttcccgcctggaacttcctcctctcttcatggccttactgaaaactgcttatcttccttgaagatccatctcaactctcattattttgaagccctttttcttcactgcccacccatggcagtcccctcccagtgctaccaatttaaactatctgcatgcctgccttctctactacactgggtaacctggaagcagagataatgtttcattcatctttgtctctgtcctagtctgacagcatcaaatgtgtaatgaattaatgaatatacaaacttaatgaaacgctaaactgtagccattcatactgtactaccccaagcccatcaataccacttttcaaccttaacttgctggtgtagtttctactggtttccaaacatgctaataagaacagctaaaagttactgagcacttattacttgccaggcattgctttaagcgtgttacatgtttaattcatttaatcctcttccatcccctttttacaggggaagaaacttaagcataagtgaaaataacttgccttacatcacgaagtatgaaggagcagggatgcgaatactaattgtaaagtccctgctcctgtgtacaacaaggaagacaaatcataatctcaaatgcaagcttcaaatcccaaaattcagatttgggaaaggggattaggatgccaaataggaatactgacctgtaaaaagaaaaagtaactttaggcattctccacaaaacagtgtgagggaaaatggtaatctttttattcttgtaatttatagtaagctactactgaataagaaagctaacttgtactagacaaagttaagttctacaggaagtttttaattattagaattagtttcatggaaaatttgggctagatcttaaagggtaagtatgaggatctcgaatggcagaacaatgatggaggagcaagcaagaggcagacactgggcactggacctccacaagcagtgaggaaggagaccatcttgatttaaatggaggtcatatttttgaagagttaatgggaaacatgatcagaaaggtaaaatggagttctattaggggtcagcaaatgcccatggcctattttcacatggcttaaagctcagaatattttttacactgtaaagagcttttaggtcaggcacggtggctcacacctgtaatcccagcactttgggaggcagaggtgggcagatcacctgagatcaggagaccagcctggccaatgtggcgaaaccccatctttactaaaaatacaaaaattagctgggcgtggcagcatgtgcctgtaatcccagttactcgggaagctgagacaggagaatcgcctgaacccaggaggcagaggttgcagtgagccaagattgcaccactgcactccagcctgagcaacacagcaagactctgtctcaaaaaaaaaaaaaaaggggcttttaaaatatgtaaagaaaacgtgcaaacatacacaaaaaaatgggactgtatatggactgcaaagcctaaaatatttactatcgggctgggcacggtggttcacactggtaatcccagcactttgggaggccgcagcaggtggatcacctgaggtcaggagttcgagaccagcctgaccaaaatggtgaaacccccatctctactaaatacaaagaaattagccgagcgtggtggcacatgcctataaccccagctacttgagaggctgaggcaggagaatcacttgaacctgggaggcagaggttgcagtgagccaagatggcaccattgcactccagcctgggtgacaagagcaaaactccatctcaaaaaaaaaaaacaaatttactatctggccctttacgaagtttgacaggccttggattaggtcatagaaagctttgaaggtagactccctcaggcttgggaatagggtgatttttaagcagaggggtaacccaacacaagtagagttgaagtctaacagcaaaaggtaggctaggttaaacccatggataaaattaatgtatcgcagtaattaagaataaaatgtacaacctcctgatattgtttggcccaaataaataacagcatagccaagaatttgcctaaagtcacagaggaaaggaattattctctcaactattatattccttccctctggaagactaacatgtactgctgaagtcttgttcagtgtccttctagccccagactttgcagcctaccaacatggactgagacagggaaagcgtgggcaagtgagttccatactctaattttcctacagaagcatcctaagtggtgtgtgggttctcagatcaagtcacaaacacattcacagcccatgatatcgtacaacactactttttagttcaaattaattatgagtaacaacagactatctgccaaaatagggagctgcagaaaactaaccatcatttatgatgttgtttccaaatttcaaaattttaaaaaaaaaaaaattataaacaaactttttgattgaaactcactgatagagaactgccaggactaaagcatggttgattgaagaaattttattgctgacaataatcaccggattgttttcttcattattgttattatttttatttatttatttatttattttttgagacggagtcttgctttgttgcctacgctggagtgcaatggagcgatctcagctcactgcaacctccacctcccaggttcaagcgattctccttgcctcagcctactgagtagctgggattacaggtgcttgtcaccacgcctggctaacttttttgtatttttagtagagacggagttttgtcatgttggccaggctggtctcaaattcctgacctcaggcgatccacacgcctcggcctcccaaactgctgggattacaggcataagcgactgctcccagccttcttcactgatttttacttgtttttgtcatatctctatattagaagcaatggaacagttattaaaaagcaaagactttgaaatctcacaaggttaaaaatctcagctttgtcacttcctatctctttgacctaaaggcaatttccttaatttctccaatccatcacttcctcatctgtaaaacagatatggcactaccagcctgacaggctgggctgttgtaaggcttaaaagatatacaagtaatgctcttggcacagctctcctgaaacctaataggcacacaataaatggtattttatgacataacatttattacctaaataaaatgttcatcttttcacatcatagatagctaaatgtgttttttctttctttttttttttttttccagaaaaaatggccactactaccacttggctcagaaatgctagtctttattttctgaaatgttttatatagaaaaaatttaataataaatagacattcttatatatttccttaccattttagattgggttaaaaagtatggagacttccggccgggtgcggtgattcaagcctgcaatcccagcactttgggaggctgaggcagacagatcatgaggtcgggatctgtggctaacacagtgaaacctcatctctaccaaaaatacaaaaaaattagccgggcgtggtggcgggcacctgtagtcccagctactcgggaggtggaggcaggagaatggcgtgaacccgagaggcagagcttgtagtgagccaagatcgcaccactgcactccagcctgggcgacagagcaagactctgtctccaaaaaaaaaaaaaaaaaaaaaaaaaggtatggagacttcttatagcatttatagactatgaacaactaaattccctgaattccgtatctgtcacaaatgtaaattcctcattttcttttcttttttttggcggtggggggatagggtctcactctgtcgcctgggatggtatacagtggcgcaatcatagctcactgcaacctccaattcctgggtttaagtgaccctcctgagtcagcctcccaagtagctgagactatacgcatgcaccaccatgcccagctaatttatttttgtagagatggggcctcactatgttgcctaggctgatcttgaattcctgagctcaagcgaccctcctcccttggcttcccaaagtgctagaattacaggtgtgagccactgtgcccagccaaaattcctcattttcttttccgtttttcatactgttgaagtatagtccttcacccagagaagctagtgactcaagttcctggttgattaaaagaaactattaataacattttttaataccatcactagttttctttctttccagagatccaaaatacaatgatagtaactcatctctgccaccttctgagtgaatttgaataggtcatttaacctctctgggccttcatttcctcatgggtaaaatgaggacaggataacagattatctaacagggctatgtggtaatcacatgagattatgtatgccctgggagaataaactcacggtagcgtccggttcactcaatcctgtttccctccctttttaattatgaccctaatcaatttttcaagctgaggtcagaaagcttctcaaacatacttatttctgggcatagccagtggctgtccctgaagcactaaaaagaacaagacccttagcaacataccagactgctgataagaggggctggagcgcagtgctgtgatcatagctcctgcaatctttaactcctgagctcaagcaatcctctcgcttcagcctcgtagtagctgcgactacaggtgtgtgctgccatcccccattaattaaaaaatattttttgtagagatggggtcttgttatgtttctcagcctggtcttgaactcctggcccttcccatttcagcctccccatgacgtggggaggtttacagacatgacccaggcccattcttctgattttgttttcctcttcatctaaaagaactcctttcaagattttatgagacagaagtaaacatcagcatctcaaacacctcaatgccataaggtggcaggggcaatgagaactttctgcctagtctatactaccacataagctccaaaaagagagagacctcatctggcttattcactactgtattcccaagcctcacaagcaggaggtactccaaaaataaaaaaaggggaggaaattaaacgtggtatgcctataaatgccatgctttctacatgacagggtcaactactactgcttaataataaaaccaatagtcagccaggcgcagtggctcacgcctgtaatcccagcactttgggaggccaaggcgggtggatcatgaggtcaggagttccagaacagcctggccaagatggtgaaaccctgtctctactaaaaatacaaaaattagccaggcacggtggtgggcgcctgtaatcccagctacttgggaggctaagacaggagaatcacttgaacctgggaggcggaggttgcagtaagccgagatcatgccgctgcactccagcctgggcgacaagagacaaactctgtcttaaaataacataacataacataacataacataacataacataacataacataacatcacaccaaaccaaaccaatagtctggccgggcaccacggctcacacctataattccgccactttggaaggtcgaggtaggcggatcacttgagaataggagtttgagaccaggctgaccaacatggtgaaaccccatttctactaaaaatacaaaaattagtcaggcacggtagtgcacgtctgtagtctcaggtacttgggaggctgaatcacctgaacacaggaggcggaggttgcagtgagctaagattgcgccactgcacgccactgtactccaacctgggcaacagagtgagactccatctcataaaaataaaaattaaaccaacagtcacatattcaacaaattattattattattttgagacacagtctcactctgtcacccaggctgaagtacagtggcacgatctctgctcactgcaacctctgcctcccgggttcaagagattctcctgcctcagccttctgagtcactgagactgtagatgagccacgcacaaatggccaatttgtgtatttgtaataaacacagggtaggccaggtgtggtggctcacgcctgtaatcccagaactttgggaggccgaggcgggcggatcacaaagtcaggagttcgagaccatcccagataacacggcgaaaccccatctctactaaaaataaaaaaattagccaggcatggtggcgggctcctgtagtcccagctacttgggaggctgaggcaggagaatggcatgaacctgggagtcggaggttgcagtgagccgagatcacgccactgcactccagcctgggcgacagagcgagactccgtctccaaaaaataaataaataaataaacaaacaaacaaacccagggtttcaccacgttggccacgctggtctcgaactcctgacctcaggtgatctgcccgcctcggcctcccaaagtgctgggattacagtcgtgagccactgcgcctggccacgacaagttaattgataacttactaagcatacaaagttgtacaaaacacttgttcctactgtcaagatgctctaaatctagaaggaagataatgcaaatatttccaaacaagtcagatcgcaaataaacacatgcaccgcatgtttcaattatttatttatttatttatttattttgagacagagtctcgctctgttgcccaggctggagtgcagtggcacgatctcggctcactgcaagctccgcctcccgggttcacgccattctcctgcctcagcctcccgagtagctgggattacaggcgcccgccaccacacccggttaatttttagtatttttagtagagacggggtttcaccgtgttagccaggatggtctcgatctcctgaccttgtgatccacccgcctcggcctcccaaagtgctgggattacaggcatgagccaccgggcccggcccgcatgtttcaattaacaacagacctatatacaatgatcaaccagtaagttaaggtaaatttactcttaaagaaagatatttttgaccaggcgtgatggctcacacctgtaatcccagcactttgggaggtcaaggtgggcagatcacttgaggtcagaggttaaaagtcttaactcctaaccacagtgaactttctgtctgcagaaaagagcattggtcaacagttcacaaaacggctaggcatgatggcgtgcacccacagtcccagctacgtgggaagctgaggtgggaggattgctggagcccaggagttcaacgccctgggcaatacagcaagacctcatctctggccaggtgcggtggctcacatctgtaatcccagcactttgggaggccacggcgggtggatcacctgaggtcaggagttcgagaccagcctggccaacatggtgaaacccccgtctctactaaaaatacaaaaattagccaggtgtggtggcacgcacctgtaatcccagctattcaggaggttgaggcaggagaatcgcttgaacccagaaggcagagactgcagtgagccaacatcacgccactacactccagcctgggcgatagagcgagactccatctcaaaaaacaaaataagaaagatatttatcaatttagtgtatcctaactgttcagtgtttgtctacagtagcatacagtaatgtcctaggcctgcacattcacacaccactgataaatgactcatcccaagcaacttcctgtcctgcaagctccattcatggtaagtgacctattcagatataccacttttatcttttacgctgtatttttactcaccttttctatgtttagatatgtttagattcacaaatacttaacattatgttacatctgccaacagtgttcagtaccgcaacatgctatacagatttgtagcctaagagtaatactctgtacgacagcctatgtgtctagtaggtataccatctaggcttgtgtaagtaaactctatatttgtacaatgataagatcaccgaaaaaatttctcaaaacacatccccatcattaagcaatgcataaacatagtttctcatcaccaaagatggtatgaatgtcaaataaacacatgaaaaaatgctcaatatcactgggcattagggaaatgcaaattaaaaccacaatgaggccaggcacaggggctcatatctataatcccagcactttgggaggctgaggtagatgaatcacttgagcccaggagttcaacaccacccagggcaacatagtgagacctcttctctactaaaaatcaaagcaaactaccaggtgtggtggtacatgcctgtggtcccagccaggaggctgaggcaggaggatcacttgagcccaggaggtcaatgttgcagtcagacaatatcgcaccactgcactccaccctgggtgacagagcaagaccctgcctcaaaaaaaaattcatacactgctagggaaagaaaatatagcagtcactttagcaaacagtttagcaattacttttaaaattaaataaacactcacaggattatatgtaccctggaaaaataaacacttgccacaaaacccagcaatctcatttctatgcattccaaccaagagaaataaaatcatatgttcacacaaaacctgtacataaatattcataccagctttatttatttatttttttgagacggagtttcactcttgatgcccaggctggagtgcaatggtgcaatcttggctcaccacaacctctgcctcccgggttcaagcgattctcctgcctcagcctcctgagtagctaggattacaggcatgcgccaccacgcctggctaattttgtatttttagtagagatggggtttctccatgttggtcaggctggtctcaaactcccaaccttaggtgatccgcctgcctcggccttccaaaatgctgggattacaggcgtgagacatcgcacccggcctccagctttatttttaatagccaaaacctgctaactcaatgtccaccactagatgaacaaactggtacatgcatacaatagactactactcaacaataagcagaaagaaactactaacatgcaatagtacagacgaccttttttttttttttttgagataagagtctcactatgtcacccaggctggagtgcagtggcgtgttcttggttcactgcaacctcctcctcctgggttcaagtgattctcctgtctcagcccccccgagtagctgggattacaggagcgcgccaccgtgcctggctaatttttgtacttttagtagacacagggtctcaccatgttggccaggctggtctcgaactcctgacctcaggtgatccacccacctcagcctcccaaagtgctgggattacaggcgtgagccactgggcccagccagagataaggtcttgctgtgttgcccagggccttgaactcctgggctccagcgatcctcccacctcagctccccaagtagctgggactatgggtgcacgccatcacacctagccattttgtgaactgctgaccaatgctcctctctgcagacagaaagttcggtgtggttaggagttaaatgggaagaaagaggaggctgggtgcagtggctcatgcctgtaatccctcccaacactttgggaggccaaggcaagagtttcacttgagcccaggagtttgacaccagcctgggcaacagagcaagatcctatctccgaaaaattaaaaataagaaaagtaattagccggacatggtggtacacacctgtagccccaggtactcagcaagctgaggtgggatgatgggatgattgcttgagcccaagaattcgaggttacacagttacagtaagctatgatcgtgccactacactccaccctgagcaacagaggaagattctgtctccaaaaaagaaaaaaaaaaaaaagatgacaacggaacgggaggtgggtgtagtcccagctactaaggaggcagaatcatctgggctcaggagttcaaggtcagcctcagcaacataaggagaccctgtctcttaggaacaaaaggggagggggagagagaaggggagggagggggggagagagaaggggagggagggagggagagaggaagggttgggagagacagagaaagaaaaagaaaggaaaaaataaaaaggagagaaaggaaggaaagaagggaagacaggaggaggcagcggggaggggaaaaaaggagaggagggatgaagagaaagaaaggaaacgacaaagaaaggccaggcatggtggctcatgcctataatcccagcactgggaggccgaggcaggtggatcacctgaggtcatgagttcgagaccagcctggccaacatggtgctaccccatctctactaaaatacaaaacctagccggctgtggtggcaggtgcctgtagtcccagctacttgggaggctgagacaggaatagcttgaacccaggaggtggaggttgcaaggagccaagattgccccactgcactctaggctcggcaacagagcgagactccatctcaaaaaaaaaaaaaaaaaaagaaatgtattagaaataaaagtacatcagattctaatgccagttatgcagccaatgatgagatactctggtaaataaccctcttggtctcaatttcttcacccgtaaatagaatgagtactaaaaaaccaccagagccagagaaatccaaactaccagggaaagggaggggcccactgagaaccaccccagcaacccgaccacagctggtcttccctggacaccatgaaccacaatgtccaaacctcttcactcctgccaacatcggccatccccctaactatgagatgctcaaggaggagcaagaggtggctgtgctgggggcaccccacaaccctgctcccccaatgtccaccgtgatccccatccacagcgagaactccgtgcccgaccatgtcgtctggtccctgttcaacacccacttcatgaactcctgctgcctgggcttcatagcattggcctactccgtgaagtctagggacaagaagatggttggcgacctgatcagggcccaggcctatgcctttaccgccaagtgcctgaacatctgggccctgattgtgcgcatcattacgaccattctgctcagcatcatcccagtgttgatctttcaagtctatcaacagatcaggaggcattatctaggccaggagctctgcccgtgatctgattcccatgtactccatccaccctccattcctcgccctgcccccagagccaagttctctatcagccgtttatcctcacacacttttctacaatggcattcaataaactgcacgtgtttctggtttaaaaaaaaaaaaaaaacaccagagccattccaactccaaatgcgtttgactctacattgttgaacatctactatgtgccaagaacagaacataagaagaatttaggctgggtgtgctgcctcatggccttaatttcaatactttgggaggccaaggcaagaggagtacttgagggcagaagttcaaaaccagcccgggtaacagtgagactgtctctacaaaaatttttttaaattgtagggcgcagacactttgggaggcgaaggcgggcagatcacttgagctcaggagtttgagaccaacctgggcaacatggtaagaccctgtcactactaaaaatacaaaaaattaaccaggcatgatggcacacacatgtggtcccaagctactcaggaggctgaggcagaactgcttgaactcgggaggtggaggttagagtgagcagaaattgcaccacgcactgcagcctgggtgacaaagcgagacggtgtctcaaaaaaaaaaaaagaactgcagggtgtgatgttgcatgtgcctgtggtcccagctactcaggaggctgaggtgggaggatcacttgaacccaggagttaaaggctgcaataagccatgatcacaatactgtactccaacctgggcaatacagcaagatcccatctcaaaaaataaatacataaaaacagaaaatattaagactttagtatctcagtttttttgtttgtttgtttgtttgtttgagacggagtctcgctctgtcgcccagcaggctggagtgcagtggcaccatctccgctcactgcaagctctgcctcccgggttcacgccattctcctgcctcagcctcccaagtagctgggattacaggcgcccgccaccacgcctggctaattttttgtatttttagtagagacagggtttccccatgttaggcaggacggtctcgatctcctgacctcgtgatccacccgcctcggccttccaaagtgctgggattacaggcacgagccaccgcgcccggccagtatctcagtttttttttttgtttgttttttttttttttttggagacagagtctcgttctgtcgcccaggctggagtgcagtggcacaatcttggctcactgcaacctccacctcctgggttcaagcgattcccctgcctcagcctctcgagtagctgggactacagatgcgcaccaccatgcccagctaattttttctattttagtagagatgaggtttcacaatgttgcccaggttggtctcgatctcctgacctcgtgatccacccgcctcagcctcccaaagtgctgggattataggcgtgagccaccgcgcccagccaaggaagatattctttctcttttaataggtaaataaactaagcctgagagtggctgagtaacttgcccattcaaacatgtgaccaagcagttaagtgccaaccattcaagaaatagggatacaatcaatagtgaacaaaacaaagttcctgctttcatagagcttaaattttagttactgaagagtgaaccatggccaggcacggtagatcatgcctgtaatcccagcacgttgggaggcccaggtgggcggaccacctgaggtcaggagttcaagaccagcctgaacaacatggcgaaaaccccgtctctactaaaaatataaaaattagctgggcatggtggtgggtgcctgtaatcccaactattcaggaggctgaggcaggagaatcacttgaacacaggaggtggaggttgcagtgagccaagatcgcaccattgcactccagcctgggcaacacagcaagactccgactcaaaaaaaaaaaaaaaaaaaaaaaacagtgaaccatgattccagcttagactggagttgccagataaaatacaagatgctcagttaaatttcaactttagataaataacttttttctatgcaatttaatacacaattatactaaaaaactggtcaatgttcatcaaaaattcaaatttaactgagtgtcctgtatttctatttgccaaatctgacaaccctagcttagatataacctcaaaactctttctcaatccttttactgcgtttctctggctctaaagcagtaacttttttgactatatcaataaaaaattacttaaaaaaaaatttttggctaggcacggtggctcatccctgtaatcccagcatttctggacaccaaggtgggtggatcatctgagctccagagttcaagactagcctgaacaacatggcaaaacctcatctcttcaaaaaatacaaaaattagccaggcatggtagcgtgctcctgtactcccagctactcaggaggctgaggtgggaggatcgcttgagcccaggaaacagaggttgcagtgagccgagactgcaccactacattctagccttggtgacagagaccctgtctcaaaaaaaaaaaaaaaaaaaaaaaaaaaaaaaaaattcattgaactgttgctgctcgtggcagagcaggactagtccataggcaatgtgcccagagttggccaaaaattacattttgaattacaatgcggtatatatacattaactcaaaccaaagcttaaaacaattcttggcagctgggtgcagtggctcacacctgtaatcccagcactttgggagtcgaggtgggcagattacgaggtcaagagatcaagactatcctggccaacatggtgaaaccccatctctactaaaaatacaaaaattaggccgggcacaggggttcatgcctgtatccccagcactttgggaggccgaggcaagtggatcacctgaggtcaggagttcaagaccagcctgaccaacatggagaaaccccatctctactaaaactaaatacaaaattagccaggcatggtggagcatgtctgtaatcccagctactcaggaggctgaggtaggagaatcacttgaacccgggaggcagatcgggccattgcactccagcctcggcaactaagagcgaaactccatctcaaaaacaattatttcaataatgcaatgcatcctaacacttcttattctttttcatttttctaaaaatgcttgtcataatccactaatgtgtttcacaatctactaaggggtcatgatctgcagattgaaaaatacttctttgggagatataaaaaatcatttaacctggtgttatgagtcaccattatgagcacattaactaactacactgtgctataaaacagtaatgcccttagggcctaagatatacagctataaacttacagtcaaaactcccaggccgggagtggtggctcacgcctgtaatcccggcactttgggaggcctaggcaggtggatcatctgaggtcaggagttcaagaccggcctggccaatatggcaaaaccccatctctactaaaaatacaaaaattatccgggtgtggtggcgggcacccgtaatcccagctactcaggagtcagaggcaggaaaatcgctagaagctgggaggcagaggttgcagtgggccaagattgtaccattgcactccagcctgggcaacagaacaagattctatgtcaaaaaaaaaaagccaggtgcggtggctcacgcctgtggtcccggcactttgggaggctgaagcaggcggatcacctgaggtcaggagttcgagaccagcctggccaaaatggggaaaccccgtctctactaaaaatacaaaaattaacccggtgtgtgaccaatatctgtactcccagctactcaggagtcaggcaggagaactgcttgaacctgggaggcggaactacagtgagcagagatggcgccattgcactccagcctgggtgacaagagcaaaactccatctcaaaaaaaaaaaaaaaaaaaaaaaaaaaaacctcccagaatggtatacttgttgagctcttgtgtctgttttttagtagttcccattttagtagttcccaggctctttgctttgtttttttgagataaggtctcattttaacgcccaggctggagtgcagtggtgcaatcatggctcacctcgacatccagacttaagtgaaccacctgcctcagcctcccaagtagctgagactacagaagtgcacgaccatgactggctaaattttttgtattaatattttttgttgagatggggtttccctgtgttgcccaggctggacttgaactcctgggctcaggtaatctgcctgcttcagcctcccaaagtgttgggattacaggtgtgagccaccatgcccagccaccagtcttccaaactttttttttttttttgagacagagtctcactctgctctgtggcccaggctggggcacagtggcacaatctgagctcactgcaaccttcacctcccgggttcaagcgattctcctgcctcagcctcccaagtagctgggattacaggcgcccgcccagccccaagtctggttttttttttttttttttttttttagacggagtctccctctgtcgtcagtgcagtggcccgatctcggctcactgcaacctctgcctcccgggttcaagcaattctcctgcctcagcctcccgagtagctgggactacaggcacacatcaccacgcccatttaatttttttgtatttttagtagagatggggtttcaccctgttggccagaatggtctcaatctcttgaccttgtaatccgccctcctcaacctcccaaagtgctgggattacaggggtgagccaccacgcccggccctttttctgtttttcagtagagacagggtttcaccatgttggccagactggtctcgaactcctgacctcaagtgatccaccctccttggcctcccaaagtgctgggattacaagcgtgagccaccgcacccagctaagtctttcaactttctatcacgctactgttatttctcattgctgttaatatatctgcctctgaaaacattgcttttctacttgctgccaatatgtacatcagaaaagaaagctagatagaatcatgtgtaaagtaaaagttctcaaagaggccataaagaactctccagaccagaggctaaagcaggaggacagtttaagcccagaagttggaggccagcctgggcaacataacaagacccccatttctaccaaaaaaaaaaaaaaaaaaaagaactcccctttctaaaatctgctcaagcttcagtgaaaagacatttagtcttcaattcctgatttcgaaatgtgtttcaggaatgaaaatagttaactgcacaaagtccacagcaaatgtttataaacccgaaaagaaaaatgcagtacttgtttcaaaacccgccctttataaaaaactaaaattataatcaagattaattccacttagaaaaattattaagaatattttaacatgactttaaaaagcaatatgaaaaacgtcaatgaaaaatatttgacctggccagccacggtgcctcacacatgtaattaaagcactttgggaaaactaggtgggtggatcatttgaatttaagagtttgagaccagcctgggcaacatggctaaaccctgtctctacaaaatatacaaaagccaggcatggtggcatacacctgtagttccagctactcgggagactgaggtaggaggactgcttgagcccaggatgttgaggctgcagtgagccatgaccataccactatactccaacctggccaacagggtaagactcagtctcaaaaaaaaggaaatttaaaaaaaaactgatcattggcaacactgttcaataaagcctctcaaggcaatggtttcaggagaccaacattctaaagttctgatacagttaataaaaataaaccacgttcacttatattgccgacaagcctcataccacaactaatgagttttacaaagacttcattatagaatgaaattttattacattcccaaaatgtagttagctattaatcatggcacgaaactgacattttcgggctggacacagtggctcacacctgtaacaccagcatgttaggaggcctaagtggggtggatcactcgaggccatgagttcaagatcaacatggcaaaactccacatctactgaaaatacaaaaaaactaggcaggcactgtggggcgcaccagtagttccaactacttgggaggctgaggtgggaggatggcttgaacccgggagacagaggttgcagtgagccgtatttgcaacactgcactccagccttagcaacagagccagatcctatcacaaaaataaataaataaataaataaataaataaataaaacaaattgacattgtaaagtcacttgacacaacttcagggttaaaattacaagcaatctatgtaagaatctttaaatgttaatgagaatttcaaattttcacatgaatgcaaacacaaataattaccagcaaataaaaagttaaggttgccaggcatgggaggccaaggcaggtggatcacttgaggccagaagttccagaccagcctggccaatatggtgaaaccccatctctactaaaatacaaaaattagccaggcgagatggtgcgtgcctgcagtcccagctactcaggaggctgaggcagaaaaatcgctttaacctgggaggcagaggttgcaatgagccgagatcgcaccactgcactccagcctaggtgacagagcgagactccgtctcggaaaaaaaagaaaaaaaaaaagttaaggttaacagctgtgacaagttttcataaacaacccagactcataaaaaaaataccaaaccaggccggacgcggtggctcatgcctataatcccagcactttgggaagccgaggcgggcagatcaagaggtcgggagattgagacaatcctggctaacacagtgaaaccccatctctacttaaaatgcataaaaaaaattagccgggcatggtggcgggcgcatgtagtcccagctactcgggaggctgaggcaggagaatggcatgaacctgggaggtggagcttgcagtgagctgagattgtgtcaccgcactctagcctgggcgacagagcgagatttctcaaaaaaaaaaaaaaaaaaaaaaaaaaaaaaaaactaaaccaaactggtcacggtggctcacacctgtaatcccagcactttgggaggacgaggcgggtggatcatctaaggtcaggagttcgagaccagcctggccaacatgatgaaaccccatctctactaaaaatacaaaaattagccaggcatggtggcacacagctgttatcccagctactcaggaggctgaggcaggacaatcacttgaacctaggaggcggaggttgcagtaagccgagatcacatcactgcattccagcctgggtgacagggtaagatcctgcaacacacacacacaaacaataataataatttaaaaaaccagccaggcatagtggctcacacctgtaatcccagcaccttgggaggccaaggagggcaaattgtttgaggtcaggaattcaaggccatcctgggcaacaggtaaaatctctgtccctacaaaataaaaacaaacaaaaaagctaggcgcagtggcttatgcctgtaattccagcacttcaggaggccaaggtatatggatcacctgaggtcgggagttcgagaccagcctggccaacatgataaaaccccatctctaccaataatacaaaaattagccaggtgtagtggcgcatgcctataatcccagctactcgggaggctgaggcatgagaatcatttgaacgcaagaggcagaggttgcactgagccgatatcctgccactgcaccccaccctaggcaacagagtgaaacaaaaattttgctgggcatagtggcgcatgcctgtggtcccagctactcaggaggctgagataggaggatcacttgggcctgagaactcgaggttgcaatgagccatgatggcaccactgcactcccgcctgggtgacagagctagaacctgtctcaaaaaaataaggcgaggcgcagtggctcatgctgtaatcccaaaactttgggaggccaagacaggcagatcacctaaggtcaggagttcaagacgagcctggccaacatggtgaaaccccatctctactaaaaaaaaatacaaaaatttgccaggtgtagtggtgcatgcctgtaatcccagctactcaggaggctgaggcaggagaatcactggaacctgggaagtggaggttacagtgagccgagattatgccactgctttccagactgggtgacagagtgagactctgtctcaaaataaataaataaccaaggatttaacatttatgtagatttcacaccacgtaagtacagaaccacatacattaaaaacaaagaaaagaaaatagacctcctattttagcaagccaaaatcaaggttacaaaaagatatcctgaagggcaagtactgtccgtgactgtattccataaaacaagcctgttagggggccggacgcagcagctcacgcctgtaattccagcactttgggaggctgttgggcggatcacaaggtcaggagatcgacaccatcctggccaacatggtgaaaccccgtctctactaaaaatacaaaaattagctgggcatcacagtgtgcgcctgtagtaccaactacatgggaggctaaggcaggagaatcgcttgaacccgggaggcagaggttgcagtgagctgagatcgtgccactgcactccagcctggtgacagagcgagactccatctaattaaaaaaaaaaaaacaggcctgttaggaaccagactgcacaacaggagctgtgtgagcattagcacctgagccccacctgttagatcaggtgcagcattaggttcttatagaagcacaaaccctactgggaactgcatatagcaagagatgtaggttgtatgctctttatgagaatctaacaaatgcataatgatctgaggtggaacaatttttttttttttagacggagtctcactttgtcccccaggctgaagtacagtggtgctatctcagctcactgcaagctctgcctcccgggtttcatgccattctcttgcctcggcctccggagtagctgtgactacaggcgccctccaccgcgcccagctaatttttttgtatttttagtagaggggggtttcaccatgttagccaggatggtctcgatctcctgacctcgtgatctgcccgcctcggcctcccaaagtgctgggattacaggcgtgagccaccgtgcccggccggtggaacagtttcatctcaaaatcatcccctgcccctatggaaaaaccatcttccacaaaaccggtccctagtgttaaaaaggttgaggaccattgccttaaaatacacagcatgatcttgtgtatatattacgtttctatttatttcaagggaggggccccagaacttaaaatttaaaaataaaaataaagggagggggctcggtgcagtggctcacacctgtaatctcagcactttgggaagctgaggcaggaggatcacttgagcccaggagtttgagaccaatctgggcaacatggcaggaccctgtctctacaaaaaatttaaatgttagccagctggtgtacacctgtagttccagctactcaggaggctaagacaggagaaatgcttggccccatagattgaggctgcactccagcctgggtgacagagggagaccttgactctaaaaaaataaataaagggagaggtgtaataaaatcctacaaatattgctttgggcaagtcccctaatctctcaaagcttagagtttttgccttccatttttaagatttaggattttttgttgttgttgttgttgttactgttttttaagagacagggtaggctgcgcacggtggctcatgcctataatcccagcactttgggaggccaaggcaggtggatcgcttaaggtcaggagttcgagatgagcctaaccaacatggtgaaaccctgtctctgctaaaaatacaaaaattagctgagtggggtagcaggcacctgtaatctcagctactcagaaggctgaggcaggagaatcgcttgaacccgggaaacagaggttgcagtgagctgagattgcaccactgcactccagcctgggaaagagcaaaactgtctcaaaaaaaaaaaaaacaccttagctcatgaggctgggcgggggtggctcacgcctgtaatcccagcactttgggaggccgaggcaagcgaatcacctgaggtcaggagttcaagagcagcctggccaacatggtgaaactccatatctactaaaaatgcaaaacttagccaggcatggtggcgggtgcctgtaatcccagctattcgggagggctaaggcaggagaattgcttgaacctgggaggcggaggttgcagtgagccaagatcacgccactgcactccagcctgggcgacagagactctgtctcaaaaacaaacaaaaaaacccttagatggtaacagtaacatcatagatgacccagatatcctttggaaaaaaacaaaaaaaacacaagtactttcatttaaaaagatacggcagcggccaagcacggtggctcatgcctgtaatcccagaactttgggaggctgaggcaggtggatcacctgaggtcaggagtttgagaccattctagccaacatggtgaaaccctgtctctactaaaaatacaaaaattagccaggcgtggtggtgtgcgcatgtagacccagctactcaggaggctgaggcaggagaatcacttgaacccgggaggcaaaggttgcagtaagcagagatcgtgccactgcactccagcctgggcgacagagcaagactccgtctcaaaaaaaaaaaaaaaaaaaaaagataataggtgtgactgttaataaactgtttacatctccgttgaagttgtcacaatcacttgaaatagctaaaaaaaaaaatagggttttgttcatgctcaactatttacacaacatcaaaatactatcactagtcaaaacagaaaattgtaattctagagaacaatcttctaaaaccttaaaattcgtttcaaagtaaaaaaacaatactttgctaaggtgacagttctaacacggctgtagctatttaggacaaaaaaatgagatcctcctttttttgtttgtttgtttgttttgagacagagtctcgctctgttgcccaggctggagtgtaatggcatgatctcagctcactgcaacctccgcactcattgcaacctccgggatcaagcaattctcttccctcagcctcccaagaagctgggattacaggcgcccaccaccatgcccggctaatttttgtatttttagtagagatgggggtttcaccatgttggccagactagtctcaaactcctgaccccaggtgatccacccgcctcagcctcctaaagtgctgggattacaggtatgagccaccgcgcctggccttgagatcctcctttaagtcaaaatatatggctattaaatagctacaatatgagttaacatcccttatgtagaagtataaaccattgctaattagagtaacactgaaaatacaagtttacatttaaccaaaaaaaggaacaccatgactgatcccatgttttcactgtttcagaatgtggaatctttaagcaactacaggcttacatttttctcttaaaaaaaaaaaaagaaaaagaaaaagaaaaccaaagcaagttttggcccaaacttaaaaagtttattttctccacatacttgaaacaaaaactaaactaattaggtaaaatacgtaagcccaaaagaaaaacaaaacatgtctctttggttagtaatagccatctacaatttacctctaatgaccctcaatgtcaattaacttttttggtctaacttcagagatggttagtatcaatgtgcacataaaagaataacaaaggatgatgccatttaaaccttataaattactaatgaagccacatgactaattaacctagataaaaagcaaacggctaaatacccaaccttcaaatctttgctcaaatgttagctcctcaattaagttcccccaatccatttaaaattgtaactcattcccctccccacactccctatacctttaatctgctttcttctaattccatagctcttatacactattatacataggctggtaatttaatgtctcattgtctgcctagtcacattagaatgtaaactccaaaaggacaatatgtttgctttattcactgattcatcccaaaaaccccatgtacatagatgcttcaataaagctgtattcaacgtagatattttaggcccttctacaagatatttaactgcaaaagatgaacagtctcactgaaatttaaatggaagcatgatgaacaactacattaaatcacagcacattttttttttttttgagatagagtctcactctgtctcccaggctggagtgcagtggcacaatctcagctgactgcaacctccgcctcctgggctcaagtgatgctcctgcctcagcctcccaagtagctgggattacaggcgcctggctaaacagcacaatttttaagttgcaatgcctcaagagaaagaagcagtaaaaatactaagctgaaaatcactaaaagaaaaatattttattcagactgaatcctgtatcccaagcaattctaatgtcatattatttaggtttaggaatagagtaacaattgtaaatccatatttttatttttaatggggaagggaatgtagaagaagaagagtcaaccagcgaaaattcccaatagtgccatgaaattacaaaaaagttaccaaaaataacttggtcataggctagcagctaataaaaaacactttcagatgaaaaagaaaggttaacaacaacaacaaagctttagaacagttcctcaggaatttcattcctgcactttactcagtactatcagcacgacagataaaccaagtaccctcattaataataatggttacaggtttcaaaacatcttcacatatattaccttattaaatcctcagaggaaccaaattaaactcaaatatcaataatccagtaactaacaaaagcacttaataatatatgcacttgacagtaaaaatgcaatttttcctttaaaaattccccacaatatttgacaaactacaaagaaaccattccatggaagagcaaccttcttgacactggaagtaatacaagtcttctaaagaataatagagcaccgctagcaagagccataaaaatcctgaagccctctgaactagtaaaaccactcttggtaactttctctaaggaaataattacactgaagcaaaaagctatttaaaaatgttcactgcaccactatctataacaaaaaagtggaaacccaattcccaacaatagaatggttaagtaaaaaccttacagccgggcgcagtggctcacgcctgcaatcccagcactttgggaggccgaggcgggcgcatcacctgaggtcggtagtacgagaccaaactggccaacatggtgaaaccttgtctctaccaaaaatacaaaaattagccaagcgtggtggaacattcctgtagccccagctactcaagaggctgaggtgggagaatcgcttgaacccaggagtcagaggctgcagtgagctgagatcgtaccactgcacttcagactgggcaaacaccgagactctgtctcaaaaaaaaaaaaaaaaatttacatttacaatacaacgttcaggggaaaaaagctaactacaaaataacatacacaatcacctctactacataaaaatgaaaaggtaaaaagcaaaaataagaattagactgatggttgggggcagtggctcattcctgcctgtaatcctggcactttgggaggccgaggctggcgaatcacttgaggtcaggaggagttcgagaccagcctggccaacatggtgaaaccccatctctactaaaaatacaaaaattggccaggggcagtagctcacgcctgtaatcccagcactttgggaggccaaggcaggcggatcacttgaggtcaggagttcgagaccagcctggccaacatggcaaaatcccgtcctcactaaaaatacaaaaaaattagccaggtgtggtagcacgaacctgtaatcccagctactggggaggctgaggctggagaatcacttaaatgaacccaggagacagagactgcagtaagctgagatcaggccactgcactccagcctgggcgacagagtgagattccatccaaaacacacacacacacacacacacacacacacacacacacacaaaattagattacagtaaaattatgttctaatattgtgattacattatctttcctaaaacagccaccttcaaaaatatatataacaaagaacaaaataaatcacttctgaaagtcatgaaaaactattcacacacacacacacaaagtcaaattatgaaatgtttcttaaagcagatgtgaatttccagactttcaagcatattttgctatctcgaaacttgtcaaaccgaatgctgcattttttttcacccttgctctcagagacttattttcactgttgatacgcacaaacctaagtgaggagattctagaagctgaaacttatttacaaggaatgcaggaaagtgattcaaattcaaagtaattctacaagtacattaacgatctgttcaagaataaaacttcacattacacaaatccaacacagtaaacaaaatttcacctattcatcagaaagaataagggctgccatttaggtctcaagtaaaagaacttaaagcaaggaaaaatctaaattaaccttaaattgttgtaaagcctcaaggaacagaaaaaagaccttgtggtactaaaacattccaaatatctttgatcactcaaactactcaggagcaaattctcttataatctaatttttaagcctagtagtcaatgcaacttaataaccttagttttaatgtttatatatttgaacatgttgaattatctgccaaatctcttcctaatacctaagaaagtaaaaacagaatacatccttttctataaaagttgtattttaaattttttcatttttcgctagatgccaacgaaaaagggaaactgaagttaccctacttggggaaacgatcacttcatctgaactagtttggctaagtagtgtttgggatgcttcagactcagagaaggggaagggggggcggggcgtgtaaagtcaaataaccgactgtttccgccccctttgaaggcagcagaattccttaaaaaccagctgattcctcttgatggggaatttctgctgtaaataaaaattctttggaaatgggttgctgaaaatgtgttttcaaaaagaaaactcgggtgaatgaaaaatcctcttattccaccttccaaagcccaagatgcctatttaaggaggacgccggtcacccgccgtcaagccggcggcctaggcctaaagaaggcacagtagtgcctacaacacggatggacttgaggcacaagggaaatggacttgcgtgcccttggtaagctctggcggcactcccgaagttaaggacaccggccacaatggaatggagtctattgacgtttccttctccctttgaacactaagcattttcttagttcgtgaaatacgaactgacaaccgcccgccacccccaacaggccctcctgcacaaacacaccctcgagtcaaacccagttagccgggacaacactgagcccccagcccctactacaaccccggcttaggagggaaaaagacgctagtaaacacccgcctttctgccttcaggaacccgaccacgtcccctgctgcaatctctctctcctagcatttccgaaattggggcgggggttgggataagtgcgcagggtgcccgccccctgccaccagcaccgccaccccggatctccagggtccagcctgggtccagccctcacccaccgatgttccacaggcgccttctccactgcggcctcgaacagcaatgcggatcggccaccacccgcgcgccggagaggtctggcgggggaaggaggaaggccgggacggggccgggcactccccaccccttcccttccccaggtgggggagggtggaacgctgccggaggccacatggagccccacgatttcaggggagttcgggagcccccgccgccgcctcggacacgaacgcagaggggtgcgggggccaaggcccacttgtctccaccccgtcctccgatctttcccaggactcggagggggcggggagagagccccgacagaccctgatgattccggaggagcccggtgcctacccctttaaccggcacgggggacgcggccctaacttctcccctccagagatgtcccccatggagggggacatgttccggaaaacgccaccacagcctccagacccctccaacgttcacacctaaaccgggagtggaggagctgcccgagcatccccacgctgcgggcggaggatcgtgcggaagggggagccggggctgaccatcgccgctacccgagaacccctcccaacacgcgtggggaggggaggccgcccgctccctccatcttgaccgccgggggagggggcggggatgctgcgggaggctggacaggcctgacaatcccagaggaccccggctgcgcccaccggccgagcctcggggctcaggcccgagcgagtctcccccgcgctgccggcccccagcccaccccgggtagcccggcgggtcacggggcggggacggcggcgcgggccgcgggggaggggacgccgggcccggagcggagggggctggggtgccgacacccacctgcccaggccgggcctcccgccgccggaggtcgccgcgaccaccgaggagggagccgtggccgaggacgaggagaccgaggacgaggacggcgaaggcgcggcggcgggcgacgctagaaggccgctgccgccgggcttgcggacattggcagccgcgggcggcggctgctgctgctgctgctgctgctgctgttgctgctgctgctgctgctgctgctgctgctgctgctgctggggcttcagcgacatggtgaggggcccatacaccggctcgcacgccgggcggggacagccgggagccgggcgcgccaaggagacgccggaacgcggcggggacgcgcgggcgccgagcggggaggcgcgggttggcgcggccggaggggcgcccgggctggcgagggggagaaggaggacgacgaaggggcggggaggcccgccgagaccaaggagccgccgggagccgggccgaaacgcgccgccgccgttgccgttgctaccaaaacagtctgaggcggagggaggcgagctctgccgggagggaggggggccggggccgggcgggggaggggcggcggagggatacggtcccggggccgcgccaccgccgccccgcccgctccgccgcgccggccgctggagcgagcgccacccgggccacctggctgcggcgaagcggcgagactcggtggccaccgcgggactccgaggagctgcggccgctgagcgcatcggagggcgggcgcgccgaggcgccgggtgggagcggaggtgcggatagggactctttaccggaagtcggaggggtcagacggaagcagaacgtgaggtggccccggggccgggagggacacgtgaggagcgggcggcgcgctgggttgctttctcgggggt

SEQ ID NO: 1396 - DNA, 362684 bp, Homo sapiens
attttacaaatccaatatttattttatcttgtatgtacaaaaagtaaactccaagtgaacatcaaatcaaatctaatccttttggccacatgactggttgttctttatctcatagttacaatgaatcatataaactgtagactgccactaccacgatacttctgtgacacagaaggaatgtcctatttgcctatctatctgaggaatgttaaatagagaaaaatagattataaaacaacctggaggtcacaggattctgagataatccctctgttaaaaaacatctgaacagcaaatgtccaatctgtaataaaatagttaaaggtccaagtcaagtccacttctacttggctggcccagcacaagaaatctaacagcactttgtaatcattttgcttttctaattttcccggaggacatgggccattgacatataaggaaaaaaaacaaaaacaaaaaacgattaagtaagttgtgtgatccctaacctgtgagttcaaaggaagattttgcagggcaccattatttccatagaagattcttttaacagagatgtcatttcaaatctaacgtagcaatggtgtgttaggatcacccagaatgaaatgactctgctgatttatggcaaaacagacataccttgggtaagaaatgaagccaatgataacatcacacatgcaaagatttttttaaataaattgagctatatagttttattctttttgctaaactcagttattaaaaggtttcttaagaaacttaacatctttgcgcaactatgtcactcaagtgatttatctacaggtttgttttaaaccgctaagcatcctgagtccatttctttgcctggtgcttgcacacacaattttcttagaaggaggcaacagtttcattaacataactgaggacagaaatcaacttgttctggtcaccaaatgtcttgtgtatatttaaaaatataacacgagaaaaagaagatactttttaaaattcagaatctgtagtttgtaaaactactatcattttagcataagttcagtgctgaccttttcagatcaatcataaataataaattctctcaagagaaatatttctagtggaaatgggaaagatgtgaactaaagctataacccctgtaccctaaatatcagccactttgggcttagcactcttttgcggggcggtgataatactgcattagagcacatatgaatatataccttagtttacgcagacagaatatatgacatttttaagtgatatacatttgcttgcggtatcatttctaatattatcagtactgtcattatacaaaaatttttttgagcaatgattgatagtaacccatcatacatgcagcttatgcctttctgtggcaggatgaaaatcaatttataaacatcttgtgacaagctggaattcagttatagatcaattacagattgctcactggacaatcaaggacattattagaaaacggtttccaccactagaaattcatctacattgacatccacctaaatatccagaaggtcatccccactttcgtcgctctccacagtcagctgccgggtccaccacttcttaacttcagaaccgcaggaagccgcgtcagtcatggggttcattttgcacacgacagatttcatggttgtccttcctccaaaccgtaagttgactgaggacactgaatggcttattggttttggggctgtggaattaatgagtcctatgagccacttggtattgcttcaccctattgtaatcactcctaaaaacccatgatattcccatcagtgatacttttggctaacgtgtcctagccacagatgctaagtaaacatccttttcaggacttgattctttatgttcacgatagattttttttttaattgtgctcatggacaactaatgatgtcatttgggaaaaaaacgtgctgctcacccctttcattttgaaataattaaaaaaactagaaaatcactaaaaaaattccaattcgggaactattaagtgtcacagaaacctgtgcattcattagcatatgcaataaaaaaaacaaaaaggaaggagagtgtgacccacagtaaaggcgaggggggatgcagtgagggtatgggaggaaaggtgtggttctggggcctcacagtcatggtgttgggacccacctctgcaacctgtggatatgtagctatgggcaacttcacgtctctgaacccaagtttcctccattgtaagatgaagacaatgaaaatgtcctaattagactattgtcaggattaaaacaggttacatgagatgacttaggaaagtgcatagcatgacacctgtgacattgttgctgccccctcaaaatactatttttcttctcctctgcctcctcaaactcagcctgaccccaagagcatgtctatttcacgatcaccgtttttggtggggaccacctaggcatggaccagtggaagtacttttttttttttttttttttttttttttttgggagacaggttctcactctctcacccagacaggagtgcagcggcacaatcttggttcaccacaacctctgcttcccaggctcaagtgattctcctgcctcagcctcccaagcagctgggattacaggtgcacaccactaccggtcagctaatttttgtatttttagtagagacagggtttcaccatgttgaccaggctggtcttgaactccaggcctcaaatgatccacctgcctcggcctcccaaagtgctgggattacaggggtgagccactgcgcctggcccaatggaagtacttttgacagcatcatttcttttgtccatttaaatgaataccaaggactgtgcattctccccaggtcacctctcctatctgtccctgcagtatctggcccccagctctgtccatgcctttgttgccttgtgctcacaccacggtaacttcctccagcttgtaacctgcctccaggctctgtcatagacaattccctcctttgctgccaagtcaacttcctaaagcacagattccaaaagtcacatactgctcagaaatctttgctagctcctaattgcctacaggataaaattgaaccgactcagcttgtaatttatgacctggcaccaccatctacgttgtcttgatgctgtcattctctgctgtgtttgaatcaggaggaacctagatcttctctgatctctgaaaaataagttcctggatatgaaaggggatactttccttggtggtagtcccagtgaagacccactgaacatcgtcagcctcaaaatgtaagctgtgctgtcatctgctttgtggaacacatatgctacacatcttctcctttcaattgggctgaagttggggcacagttaaagagcattataaagctcctgctttagcatgaacttagttatctatagaaaaaaacatgtacaaggacactgggctgtggggagcattgctctccctccattcctgagtgctcttaatgggattatcctggctttccaaaaccctatagagaagaagctcatagaagaaaattctcttactgaatcagtaaaatatggaaaataatgggactgtttattaaaggattgaatgagagaacacaagtaatgcacttagaagagtgactggcatacagtgagtactacgtaagtgtttgttgttgttgtttgttattgtatggaggtaaagcagcttgcctaaagccagtgaccggctcagctgcaaagtgtgctgagagaaatcgggggcctgtcccttttttgagaacttcgtggcattttctgaatgattgcatctgcccactccctcttcagttgaatacttttgcccatgtttgagcatgccttgaggcacacagaaagcccttggaaatttctccctcttgctgaatcttgtctttttcataggtgctggcttctcaaccatgatagcctgaaatgtacccggaaaatgggggctaatgtaagtcatatttagagaagttattttgggggacaatgtttttgacaagactacatttttcattatgttgctgtctgtaaacaactgtagatgcagacttgcattttgaaaggcaagacccaaaacacacaaacagagtaaatacctttaaaatgcctcgatcgctggagaaatgcctggatggacctacctgagggcagacgccactgcccaaatttcctctggggtttccctgcgtcggctgcatcttgccgacttcctcctcgatccgacagcgtggggctcaggagctgctgctggctgcttgtctgcatgggaggagaagcacacagttaccgtctttttaaccctgcgctctcctccttttactataagaaaggaaaacacatggcaggaggacaagtgggaagaacaacatggactcagagtgtccacaatggggaaaagtgaaaatgggtataaagggtcacagaagaaaaagagccaccactgcacgccctgctgaaggagacaccactcttcctgggacatcttgtcctgggtaacccccactgcttcgttcccctccatgcctgagaatgtcattgtttcccttcatatcttcgctggcaaaccagggggtaaggaaggggaactgcaggaaggaaggtggggcagtggggacgggctgggcgggggcagtctactgtcaccagcctggagatccacacttagagcttcagggaaagagttctctgcaggcaaagctgtatgatgggccctggtggaggatggagctgataacaatctaagctacagtgaaagaaagagagatgccaagacttcccacacatttcacctgttctcaggttcacctgtcacctctccctttcctaacaaaagccttggtcttcacatctctttagtatccttttttttttttttttgtcacctctttctttcttaggctttttcatctaaaaacagagggctctgaaatcatcactttccccaacctcattagccctgtctcactgtctgtcctgacttcagcctgcctccctctcccatgcgagacattgccaaccatcttcagggtgaccagtggcaaggccactgcagatgcctccccttgccccttggttgactaactccgcagaagtccctgcagtcggtggcagatgatttctaaaggctggggagcccaaaacatgagatctactgaaaactgagctatggcaccagtgggcctcctggagcaccctgctgggccgtggagccttaggcttccaaaggtactctggcccctggctgcgttgctgcacaccatggagcctggtgctgctgggggctctgcacagagcacgggatcagctccacgttgttaacctcaaatcgtaattgctgcctcataaaggggcaggtcctcccagccagctgcttctcacagcacaggactctccaggacgctgataactccttgtacttttttatatagacacatacatagagtttgaaaatgaaaatatgctgtgacttaataaatagaaactcctcaagccaattgtcctgaattccatatgttcttctgatacccaaccaggaaaggatatatcttcaatgagtctgattatttaaggaggttgaaagctaattacaaacattttcactgattttactgcaaatttctatgactttagagaagggaggaaaatatttagggcagagcttcctgtaaaccatactccatgtaatatacccagattcaaatgcagcccttagagctgatgttaactctttagacaaaaataaaactacagaattatgaagttcagggcattcactttttttggcattcatatgagtcagactctttttaaataacctcaactgcatccaagatggcaaagacatagacataatctggatcaatggatttccgttgccttttttttttttaatgaaaatattcctattagaaatattgtcaccttgtttgaatgatctgaccagcacccattttatttatttttattaaaagaaagaagcccacagagtgtcctgggacagaggacgcctcgtgcccatacctcaggttgcatgctgttgtcctgactgttggcattcgtgtcctcactgggctgggtggtctcgatgctgggcgggttcagaaaccggctcagctcttgctgctgactctctctcaggctgtggatgatactgcacgactgctgctgtttctatggaaatgcgattgtttgttcagtaaaataagcccagcatcctgcctgccccaccgccacacaaatcttattttcttctcccctctcctaagacctgcatgacgggtgacctcttaggaatttccaagtaaggatcctgaactaatttcaatgttcaattaaggtaggctgatgcaaaggtgggcttagagaggtatgcattgacttcccagtccattttcatttgtgtaacaatcagaatagtgacggtcattgatgcttgtattttatttatttgtttttctttttgttgttggtgttttctgtttttttttttttttttttagataggatctcactatgtcccgtagactagagttcagtggtgcgattattatagctcactgtaaccttaaactcctaggctcaagctatgctcctgcctcagcctcctgagaagctgagactaaaagtgtgcatgactgtggctggctaattaatttttttttttttttttttttttcagagaggaggtctcactctgttgcccaagctagtttcaaacttctggtcttaagcgatcctcccgcctcagtttcccaatgtgctgggattacaggcatgagacactgtgcccagcttatgtcttatttaaaattactaatgtggctattctattttttctcctcttattttattctaggctcattaagccaatacaatcccaacccctttcccactttcctgcaagttgtaagaggcaaagagccttgggtggatgagaaaacctttgtgcttgtcttggttctgaagttttcaggtcaatccaggagaccaatctgtctcggcatatactaaagccaggactccttgtgccctctcagagccagaggaggacagattgatccctggagctaacatagctacagtggccagcagtgatgggacatcactgggcagctggccttgctataggaggttgagttgtatcttttctctgggaaccttttctcctccaatagaaatacatgtgtctgcaattgacgttgttgctctgaggaagaggattgaaacaatctctgttatatataaatgtttagtgattgctttgggttttttccctgtctgtgaaacatgccaaaagcattcataaaagtaattatctcatagaaacattcactgtaaatacagtatatgtcaatgcagtatacattcattaatttatgagttagagaatcttataggcttataagtcaggaagcaggaaacatcattaatcttgagaggtggtcttttcagaataaatgacattatcacagtttgttgaaatttttagcagcaatttaaagtagttttgcaaattcaatatgtggaaaattctagaattttgaacagttgagtttaataaatggacatcatattttaatatcaataaactttttttttttttgagacagattctcactgtgtcacccaggctggagtgcagtggcatgatctcagctcactgcaacttctacctcccaggttcaagtgattctcatgcctcagcctcctgagtagctgggactacaggcatgtgtgccacgcctggttaatttttgtatttttagtagagatggggttttgccatgttggcaggctggtctccaactcctggcctcaagtgagttgagctccccccttgacctctcatagtgctgggattacaggcatgagccaccacacctggccaataaactgctttttaagtcttcatgtcatattataaaaatgggattccatggaaactcctaatggactctgctaaagagggcagggctgactgtggactagagtgaaagtctgcatcatgatctgaccactgtaagtggaggtagtggacatagtttaaagggatagaaggctgatcacagaaggagctaatcccatgttcacgaagctcttttctttcatcctcctgcggggcagggcggggcggggcggggacccaacctgcatgtgtgcagttcactcacagctctgatgcgcttcaggcacttcttgagccacatgcggatggtctgcttggccacctcctcctctatggtgtactccagctgctccctcgccaggagttcctccagctgcaagctcttccggatgtccacggaccggtatgaaagcatgctggtgggagaaacacacctgcaatcgcagctctgattcacctgagatttacacccttagatacgtcaaaatccagagaggacatcactcagtctaataagtctagtgttttgacgccacccctcgccacccgcatgtcttgggctggtcctgtcacctctctgtgtctcccttccctcgtctgtaaaacaaagatgatagatagtcctggtaactcctttatttaatgactaagtgagttaatatctgtgaggctcttatagtagtaagtgccatctaagtgcctgtaaagcaaaagatccaggctaggaaaaggctcgcgactttctctgcagaaggaagaccgcacctcccatactttcttcacacttagccccccgaggtgatggttaatatgctcggctgtgcgtcacacatccctactccctgcatcccacttccctctctgtttctctcattcatccttctgtatcttccttattaattaattttttctttttttgagatggagcttcactcttgttgaccaggctggagtgtaatggcgtgctgtcagctcactgcaacctccgcctcctgggttcaagcatttcttctgcctcagcctcccaagtagctgggattacaggtgtgtgccaccacgcccagctagttttgtatttttagtagagacgagttttcaccatgttggtcaaactggtcttaaactcctaacctcaaatgatccacctgcctcagcctcccaaagagctgggattacaggtgtgagccaccatgcctggtcttccttattaatttcagaggctaccaaacaaacccagggttgaatatccactcccatttaacccttgacacacagcaggcccatgcagttgtaggtaaagccaacacagcattacagttcatggggcaataaggcagctcccaggatgcctggactgagcagtccaccaccagaggagaagacagcccctcttggcagtgtgatgcacccaggtgtagccacaggattccaggttatggctcagacccatgcaccctggtgcacctgtgagctacccacttctgtgagctcagttccatcctagagcccaaatcacagcctggaggctcttgagagcactggtacattgggcttctctttgctaaatctcttcccaccacagagggaaaaaaaatgaattttctcttcctctcttccctgactcatcaagaatcccatcaaagcttcattgcttttatcttcactgtttgtttttatcatatactgggctaggggaataaataggaaggggagagacagccccatcacagattttgcctgggtctatttttattagatacatcggtgtgttccaaagaggctgaatattaattattaatgacaacagtatgcctatctgcctcatgtcaaccaaaaaaatttgccactaggaggaaagactcagaaacattctgacagagatgacctcctttgtgattcacatgcatttctccgtcccatgtttttctgctttttagcttgttggtggaagaactggatagtgggaggtgaaattgataacttgagagaacttttcccagattcttcctgtgctgatctgatcctttttttttttcagcttctggccacaagcatatttctgtacacctgagttctcctgaaatttgagacacaacacaatatcccacacactccttgtaggtactgctatgtgattaaaatagctactgctagtcagtcgctcttatttttttctgtggcatggacccctgtggcagtggagcttatgggacatttcttgaaataatgctttaaatgcacggaatgaaatacaccgtattacaaaggaaaccaattatattaaaatacaattctcaaatttactttaaaacggcagtgataaagtaacataagtaagtgcttcctttattattccattaaataataccatctagcagagctcaaatgactaccataactcagaagcactggtgagcataaatgatattttaagatgtcagtcaaggcagtcagttatgtcatctgaaaatatctatgatttctcctggtaacaaagacatggatattgctaatgcgactgtggtttgttgcctacgttcatcatggaagagaatgacacatttcaaagagtgattagtgaaaataaagatgtaattgtttcccccttgcaagtccatgggcctctgttttatccatggactcctgcttaagaagctgttatgggttaaatgtttcctcccaaaaaaagatatgttggagtcctaacctctagtacctcagaacgtaaggttatttggaaatagaacattgcagatgtaattagtaattaagttaaaatgagatcacagtggagtagaatggactcctaatgtaatacgacagatgttcttataaaaggaggaatttgaacatagatacacacacacacacacacacacacacaaacagaatgccatgtgaagatgaagggagaccaagctgatgcttctacaagccaaggaatgaccaacattggcagcgcacctccagcagccaggggagaggctaggctagattctccctcacaggcctcagaaggaatcagccccgcaatacctccatctcgggcttccagcatccaggacttcgagaccatacctttctgttgtttaaatccctcagcttaaggtgctaagttacagtagcccaaggaaacaaatacagaagtctcccaggaagaagaaaaggcagagactccatttgaccctctgtcctgtctgggcgctcatgaaatgtctggaaaatctggtgttttagccaacggggcaaccatcacagagcaggccaggcaaattctcatcagacccatgcaagtgaggtgctctgcatgttagtcccagctttgccagagccctgtaaccgcaagcaagtcactcagctcttctgggcagttcccgcatcacagggaaggggtgggactgtgctctcccagatcccttccacctctcccctcggggtgcacctcagtgggcaggggtccctacgggacatcagggcacagccgcccagccctcccctgcgaggcacctacttggaaatgttcactggaggacggcaggaaagggcacttagcgcctgggacatgtgaccccacttcacgaccacagcagatgtggcattttgggttggaaacacacttgttaattgtactgcagaggccttgaaggctgacagctgtggtttctggcccccattcagccctgcgaaagcctgccttgtacctcaggacatcatggaaggtgacgtcgccgccattgtggagcctctccatttcgtagcacatgtgcttaaacaggagcttgtccttgtccaggtccacctccagcctcccacgcagtagccgcagcaggaacttgacgcggaacgtggggatcaccccctgcggggcagagcacaagaagtagcaaatcatcaggcctcgatgattcacttgggtttctcaaaagaaaaaaaaaaaggtgctatttctcaaaagctagcataattagcaccagatgtgaagaaagctggtcacctccttggagcctggtagaattaagtgcactaagaagagcagaggatagaaaactgagtgataaatttctgctggtgcttctctttctgggatgtcaccacattgcagcatttggagtgaggcatgggaagctccccttcagccccccaggaccctactcttgctctcaccaggctgatgcttgcatagcctgtcccacagacgccacctccaacacatgcactgagtgggccataatgtactcacacaaggtaatggacaagacacacacgtgtaatcctcctcttcactcaatcgggatgctaggaacgtctcaatgtttattacatgtttttctaccattaaaagataactcgtgttggatcatgcctgtaatctcagcactttgggaggccgaggcgggtggatcacctgaggtcaggagttcgagaccagcctggccagcatgatgaagcccagtctctactaaaaataaaaaaattacccggacatagtggtacatgcctgtagtcccagctatttgggaggctgaggctggggaatcacttgaacccaggaagcagaggttgcaccactgcattccagcctggagacagagtgggactccatctcaaaaaaaaaaaaaaaagagctaactaactccttttcatgtcttcttcaggattagaaaaactatatacaagagaattaggccttcagctctgccctcttctggggtcagaactgatccagacactgagaatctaagatgtgttgctaccttccatgcaacacaaaccaccatgccccctggctgtatctttgaatgaaagtgctgggcggaacactggcgaccatgactgcctgccagttactgacatctcggtgtgcagggcagtgggtcttcatgtgtgtattgcatgaaagcaggttcccgtgggtgacagttacagagagacaggtggatcctgaggagctgagagtgagctcagatgccctgcacgcagggctctcactaccttgaaaggaaagccctcaagactgaagcctgggcgggcaggggtaccaagaagagggagcaaattggggtgagtgcactgccggagcccctcatttatgatgcccaggctggcttcttggtctttgtgcccttcatcaactcttcttgaactatttccagatctcgccccaaataccctggcagaactttccttgttgttcagacatgaggtcccacagcacccctcaggcctccttcatggtcattcctgccggcgcagccccaaccccaactactgtctatagttttaacttctggaaatactgcactatttattattatttcactttttattatttgtctccacctattagactgtaagctctgtgagtacaggagctgttccatcttgttcactgctatatcctcagtgcctagaactgtgcctgagtgtttgcttggatgaggaagagagaagaggagagggaggaagaacaggaggaagtggagaaggaggaggtgggggaggagaaggtagaggaaggggtagaggaggaggaggtaggggggaagatgaggtggaagaggaggtggacgaggaggagggggaagaggagggggaagaggagggggaagaggagggggaagaggagggggaagaagagggggtagaggaggaggagtaggaggaagggaaggaggtggaggttgatgacgacaatgacaagaagaggaagagcagactgcagctactttggctaattttaagaaaccttgggtaaactttatggttaaaacattcaagtagtaactcaaaaataatccaatacacaccttcagatgccacttaaataactcctttgtacttttaattgggattgctgcttgagtttgaggtgatcatgaatttgtaatatactgtccctttggtagtttcagtgtcacctctttttctggcctgagcccaaggctgattcctacagagtccctttggcttcctttccctgctggccttcggaaagtctgaagaagaggatgttcatggttgaagatcatgtaaggaggaacgatgctgtctcccttcctagaggattctgctgaactgtaaatgatggctttctgcaattcaccatttaaaaattcaatctgtgtcatttgccaacctgaaaaccatttaagtgtttgagacatgttgataagtctctttgaggtgaggcatgaaacaacaacccactcccatacctctcttttatcatccaccatgttccatattatttgaaagtggcgaagatcattgtaacttaaaagctggtcctcctcagtggaataaaacaaggagaaattctccacaattatggcttttaaaaaaagaaaaattcagaagttagaccattatgctaatctgtcatattttagaaagagtaaaacatctattattaataatggattctatcacctatatcataagccaaatttttaaagtgcttttagtatggtttccaaattggcatgtttacacttggactaagctatttctccagctcctgcctttccaaaacatgagggtcgtaagcacaaacacacattctgtgtatagagatagtcatgccagctggctttaactcttagttgagagttccagggccatttttaaaggtcaaattgagttctgggtgggcccacatctgggtaaataaggtgtacctttcaaaaacataaatgtgatatttcaaggctagaaagatagtcctctctgatatttgttcaactcaatccatgagaagagcccttttgaaattaatgatcataataaatgctacaactcttaaaattgcagtcaactgtcatttacgtgcctttcaaaggtcttttcagcttctggattgagagacaacaatttataattaatgccatgaaacacccaccccaagaaatccagggtaattgcttgaaaataatacataattatctaagtacctgagtttaaagagtaaaaagtattcaactaacatcacttacctacaagcagatttagcatgatgtaggcaatgatgacataaaatgaacagaaatacataagtgccccagcataatttccacagtctgttgcccagtatgtaaattcatctggagtacaaaacggaggctgaacctttggggcattggggtggaagaaggagaggataagagtagagaatacaaatttcttttagctgactatagttaatgaatagattcctaaacatatagcatataattaacttcaaagtaagctttcaaaagccacatacattgggtacatcatctgtagcagaaataaagaagaatatttcacttatgctatgctgttatcttgtagaatcccaaggttattgccatttttaaaagcacaatgaaaatgaactgatctccactagatattctttctgccaccaccaccagccccaagtgataagtagccactgtgatcaaactgcagaaaatcaaataaaaagacatttgcaagtttttctctgactgaagtaatgggttaagatttgggaatatagactctacaggtatacctcggagacattgcagtttcagttccagactgctgtgataaagtgaatattgcaataaagtcctatgcatgttttggtttcccagtgcacatgcaactcatgtttataccatactgtggcttattaagtgcacaatggcattatgtccaaaaaggtacagaccttaataaaaagtacttttattgctaagaaaagctaacaatcatgtgagccttcagtgagttgtaatcttctgctggtggtggagggtcttgcctcaatgttgacagctgctgactgagcagggtggtggctgctgaaggttggggtggctgtggcgatttcttaaaacaagtcaacatggaagtttatcatatcaattgactcttcctttcatgaaagatttttctgcagcatgtgatgctgtttgctagcattttacccacaatagaacttctttcgaatttggagtcaaccctctcaaaccctgctgctggtttatcgagtaattttatgtaacattataaatcctttgttgtcattatgactatgttcatagcatcttctgcaagagtagattccatttcaagaaaccactctgatcatccataaggagcaatcttcattccttcaagtttgatcaggagactgcagcaattcagtcgcgtcttcaggttccatttctaattctagttctcttgctatttctaccaaccacatgtgcagcgacctccttcactgaagtcttgaacccctcaaagtcatccataatggctggaatcaacttcttccaaattcctgttaatgttgatgatattttgacctccttccatgaatcatgaatgtttttttttttttttttttttgagacggagtctcactctgtcgcccaggctggagtgcagtggtgcaatctccgctcactgcaagctccgcctcctgggcttacgccattctcctgcctcagcctcccgagtagctgagtctacaggcgcccaccaccatgcccggctaattttttgtatctttagtacagacaaggtttcaccatgttagccaggatggtctcgatctcctgacctcgtgatccacccgccttgacctcccaaagtgctaggattacaggcgtgagccactgcgcctggccatgaatgttcttaatggcatgtagaatagtgaatcctttccagaaggttttcaatatactttgcccagatccatcagagcaatcactatctatggcagctattagccttatgaaatctatttctgaaataataagacttgaaagttgaaatgacttcttgatccatggacagaatggatgttgtgttagcaggcatgaaaacaatgttaatctccttatacatctcctgatacagctcttgggtgaccaggtagatgcattgttaatgagcagtactactttgaaagcaatcttttttttctgagcagtaggtctcaagagtgggcttaaatatccagcaaaccatgctgcaaacagctattctgtcatccaggctttgttgttccatttatagagcacaggcagggtagatttagcataattcttaagagactgtattagtccattctcacactgctaataaagacatacctgagactgggtaatttataaaggaaagagatttaattgactcacagttcagcagggattgggaggcctcaggagatttacaatcacggcggaaggggaagcaaatatgttcttcttcacatggtggcagcaagaagtgccaagaaaatggggggaaaaacctcttataaaaccatcagatctcatgacggctatagtgagaactcactcagtatcacaagaacaggatggaagaaaccacccccatgattcaattatctctgcctggtccctcccacgacacatggagattaagggaactacaattcaagatgagatttgggtggggacacagtcaaaccattgcagggtcctaggatttttggaatggtaaatgagcattggcttccactgaaagtcaccagctgcattagtccctaacaacagagtaagtctgttatttgaagctttgaatccaggcattgacttctcctttctagctatgaaagttctagagggcatcttcttccaatagaaggctgttttgtctacattgaaaatccattgtttagtgtagccaccttaattatttgagctagatcttctagataacttgccacagcttttatatcagcagcacttacactttcatattatggagatggcttctttctttccttaaacataatgaaccaacctttgctagcgtcaaacatttttttctacagcgtcctcacctctctcacccttcataaatttgaagagagtaagggccttcttctgcatttggctttagcttaagggcatgttgtggctagtctgatcttctactgagaccggtaaaattttttctccatatcagccataaggctatttcttatcagtcatgtgttcactggagtagcattttaattcccttcaagaacttttcctttgaatttacaacttgagtaactatttggtgcaagggacctagcttttgggctaactcagcttttgacatgccttcctccataagcttaatcatttctagcttttgatttgaagtgactgatgtgtgaatcttctattcacttgaacacttataggccattgtagggttgtgaatcggcctaatgtcaatattgttgtgtctcaggacatagggaggcccaagaaaagagagaagagttggagaaacagatgttcggtgcagcaatcagaagacatatgacatttatcaattaaattctccatcttattgagcatggttcatggcacccctcaaaaaaaactacaaaagaaacatcaaaagatcactgatcacagatcaccaaaacagataataatgaaaaagtccgaaatagtgagaattaccaaaatgtgatacagaaccagaaagtgagcaaacatgctattggaaaaatggccctgatagacctgctccacacaagattgccataaaccttcaacttgtaaaaatgcaatgtctgcaaaaggcaataagggaagcacagtaaaacaagatgtgcctgcacatagaaaattcacattcaaattgtgtgaggagtaagccccattcttggaacactgttatgggatgctatggaatagcacaagacttaagtcatcaaaaactctctcattgtttacaggctctataaaatgccgacacctctgagagaactttctggtttttctcagccagataaactagctctctcttctataatcccagcattctgcttgtatttttatttaagattcattaaattttgccttgtattctatttgatttggcaaattctccttgttaattcatgcatgaagtcccagcactcctactgtgtgctaggtttgtgccaagtttggggagagactggtaagaaagacataggcggccctatctcttcttcctactgacagttgagtgctgtgcagtccaatatggtgaccactagctccatgcagcgatgtaaatttaaatttatgttaattaaaatgtaataatataaaattaaaactaaaattcagttcctcagttgtgttagccacattttaaatgctccataaccacatatggctagtggctcccgaattggacagtgcagatttccatcactgcagacattttttaacacagcattggtctgtcctacggtgagaaagagataaaataaatgaatgtaagccagtaattcactacagctccttattacaaaggagaactatagagcagcataagaacatgtagctggctgtcttagcttaaggcaaaagacctgtttaaactgagaccagaaggatgatgcttggggaagacaggatatagtaagaaggaagtataaagtatactttatagtataaaggaagagtaactcagagcccttgaggtaagctccttgagtgtgccttggagttgttgaagacctagggcctagcatatagctgaggggcagtgaactatccactgaacacattaaattaaagggcttcctgtttgactttcattaccaaaatattaaagatgggagggaaagaacaacactcacaaaatgcatatttgttgaatggaactacaatagctcaagttgggttaattgagtattttgccctaaatattcacacattggaatgtataataatgcaattttatggactgaagtgtcaggatttatatttcatacataaagtcttaacgctaacaaggatgatcctgccaacattgtgttgcaagagtttcatgctgattctaagtctaagccttgttcatgatgagagatatttaccatacagtcatgcataatcttgttccagtcttcacctgtgacaattcggaacagtacggtaatagcttttccagccgaagaaaaatttgcatgcctaatttaagaaaaaaaaattaacagaatgtgaattatagaagggtttgtcatgaaatagcatggtttgccaacaccaaaacaagtggaggttgtagcaaatttggttgctaagtcaccttttccaaaggttatacctttttattaatttgtcatttatacttgcctccaagtatagccgtctgaacacccaactctagcatggccactaatttattaccattcatcttgaatgactaagtaggcaggctttggcaactaagtgattccttctttcacttggacgatgctataaaaggtggggcagccatgtatctaattcctacaacttgacatatcggtatatactttgttgtatcaggacttgaaaaaaaatgatgcatctataaaacttaggcaaatcgttgaaaactgcttttcatatattacaaccatttggggggctctaaattcccatattttgctgagaaagaaacccagagttatcttaaaattgttccatctaaaaataatatatcattttttggcaatatgtagatagaaaaagtgctggaattaggagtgatgattactgaatgttggtggaattatagattctttttgttttcttttatttctaatttttctaaggttttgaaagtagaccttttcagttgaataaccttttcaactggaaaaatatcatttaaaacttggctattttattttaatttccaactgattacttccctttcccctctcctagactttaatagacaaaaaacatttgtttatttaaaattttattaccaaagggtttgcttgataaatgaatagaaagataagtatataccaacctgttaatattctccccatatttcacagtaccaaataaaacaactccagcaaaagcgtaacacagcagcaagagaaacatgcctactatgataaagaagctcttgtacatgctgacgaccactgtcaagaggagcatctttagcgttacctggggaccaggggtgggaagcggggagacagagagagagagagagagagacagagacagagagagagagagagagagagaatattcaatctattaagctatggaagacctgggtagcaactaatctttaagcagattggctcaaaatcactcttaggtgtatcatttgaaagttgctttctataaggtattacatcaaaatattcttcaaaacccaccaggcgttgggcgaattttatttttacttcaaacatttcagcctcttcacacaaattaataagagtaacactaagcattttcaccttccattttctcttctgctcctcaattctctatgataagggctacacatttttgactgacagcaagtaaactcaggtttcttccacaaacagactttcacaaaaacaaacctaagcaatggtataatactaaataactatcaaatattaagtatattggttatgtgtatatatggaatgtatatatgaaataacgtttgtaataaaaaaggaaacagcattgtaaaaaatgaaaaatatatgtggaatatacccatggacattaacaaataatattaaaaaatctggaatctcatcctggctaacgtggtgaaaccctgtctctactaaaaatacaaaaattagctgggtgtggtggcacatgcctgtaatctcagctactcgggaggctgaggcaggagaatcacttgaacctgggaggtggagaaaacagtgagccgagatcctgccactgcactccagcctggtgacagagcaagactccatctcaaaaaaaaaaaaaaaaaaaaaatctggaatcatggaaacataaaaattcattaaagattatttttctttgaagttacttaactttattgaaaataaaaataaaaatgcattaagaaagaatattggtttttgttttcatgactggttatctttaattaattaaattaataaatttaaataatttacttaattattgaatataaagaataagcaacataaatggcaggaaacacatcgaatgataactaagctactgattcatttaacaatgtttaatatttgttaatcttgacttatgatgtctagtaatttgtgattacatccctaaataaccgaggtaaggctgtaatcaattaatcaccattctttcattaacacatatatgacctttaagataagattcttaacaatgtacttacatgttttccacagatggagaaaaacctaaatacaatcacacaagcgcccatcatgtaagtatatgcattctgaaatttaaacagaagacagcttctcataatttgcacaaaagatcttgttacagttccattttttaagccttctgtgaagtatactgaataattagcttaatatgtgtaaattattataagaaagtgatctaaaaaaggtgctgaaaaggtcactgcaaaaactcatgaataaatattagatttaaaattcagtctcaaatgaaacttcgggttctgttttgctcagctaaattctgtattttgaaatttattttacataaaatggtgaccagctcttttgcatacagggtgtgaaaaacacaggataacagtgcaacataggaaggtcaactgacataggaggtaaaggaatcctggcaaagagaaagggctgatggtggaaaagattgccagaagtcagattctagacaccactgaagaacaaacatacactcattcctctaagctgatttcagagaggtcctccctgctcaggaacacatccagctcttttttcaagggtgtgattagcaggaagagatgactgcactttatgaataagaaagcttcatttgagaaacaaagatcccaccagctataactgcaataacaaccttgacattcagccgatgccagagtgtgattactctcaaggaggcttgcctagccaaatgatgacagtcacagatgggccccgcgaagggggtccagtgagatccttggtgaggtccaagcacatgaatgtgtgcacatagcatccttggatggggaactttccttcccaatagtccactgcaaaatacggtggagaatgagcatccttccaagaccaaagaggttcttggagaagaacaaaggcaattaggcagaaaagggaagttggtctttgggtttaagatttcctctctgaggttatctgggattagagagtctacttgacttttgcttggactcagtagctttaggttgcatttcgatatggtttggctatgttcccacccaaaccttattttggattgtagttcccataatccccatgtatcctgggagggaccaggtggagataattgaatcactggggtggtttccctcatcctgttcttgtgatgattaagtctcaccaggtctgatagttttataaggggcttcccctttcactggtcactcatacttcttcctgccaccatgtggagaaagatgtgtttgcttccccttccaccatgatcataagttttctgaggccttcccagccatgcagaactgtgagtcaattaaacctcgttcctttataaattacccagttttgggtatttcttcatagcagcatgaaaaaggactaacacagtaaattcgtacttagagtggggggctactataaggatacctgaaaatgtggaagcgactttggaactgggtaacaggcagaggttggaacaatttggaggactcagaagaagacaggaagatatgggaaagtttggaacttcctacttgttggatagctttgaccaaaatactgatagtgatatggacagtgaagtccaggctgaggtggtctcaggtggagatgaggaacttattgggaactagggcaaaggtgactcttgttatgctttagcaaagagactggcagcattttgcccctgccctagagatctgtggaactttgaatttaagagagatgatttagggtatctggtagaataaatttctaagtgacacagtgttcaagaggaagcagagtataaatatttggaaaatgtgcagtctgatgatttttatagaaaagaaaaccttatttactagggagaaattgaagccagttgcagaaatttacataagtaacgagggactgaatgctaatcaccaggacaatggggaaaatgtccccaagggcatgccagagaccttcacagcagccccttccatcacaggcctggaagcctagaagggaacaatggttttgtgggtgggccccaggctccctctgctctatgcagctttgggacatggtgccctgccttccagcagcttctgctccagccatggctaaaaggtgccaatatacagctcaggctgatgcttcaaagagtgcaagccccacgacttggtggcttacacatggttttgggcctgtgggtgaacagaagtcaagaactgaggtttgggaacctctgcctagatttcacaggatgtatagaaacaactggatgtccaggcagaagtttgctgtgggggtagagccctcatggagaacctctgctggggcagtgcggaaggaaaatgtgtggttggagtccacacacagagtccacacacagagtccccactggagcactgcctagtggagctgtgagaagagggccaccatcctccagactccagaatggtagatccactgacagcttgcactgtgtgcctggaaaagccacagacactcaataccagtccaggagggggtctgtaccctgcaaagccacaatggtggagctgcccaaggccatgggagcccacctcttgcatcagtgtgccctggatatatataagacagagtcaaaggagattattttggaactttaatgtttaatgactgccctattggattttggacttgcatggtgcctatagcccctttgttttggccaatttctcccatttggaatgggtatatttacccaatgcctgtacccccattgtatctaggaagtaactaacttgcttttgattttacaggctcataggcagcagaaactttcctgttctcagataagactttgggcttggacttttaagttaatgctggaatgaattaagactttcggggactgttgggagggtatgattgtattttgaattgtgaagacatgagatttgggaggggtccaggcagaatgatatggtttaactgtgtccccacccaaatctcatcttgaattgtagttcccattatctccacatgttgtgggagggaccaggtggagataattgaattaagggaggcagtttcccccatcctgttctcatgatattgagttagttctcacaagatctgatggttttataagggacttccccctttgctgggcactcattcttctctctcctgttcccttgtgaagaaggatgtgtttgcttccctttccaccatgattgtaagttgcctggggccttcccagccatgtggaactttgagtcaattaaatatctttcctttataaattacccagttttgggtatttcttcataacagtgtgagaagggactaatacaaattttatctggagaaaggaaaaacatgggccttgctgccttttcttcccatgttagctaaagatctattgcagataccttccctctttatgttttggaagtaatgacaaccaatagtttttaggatgagaatctgaattcttcacctggactgcaaggtcctaagaggtctgataccttcttacccatccaaatcttgtactatgctagtactatgtatctatccttcttccagctctgtcatctttccatcacagggacaactacctgaaatgccctccccttatcctacagatggagccatcactcccttggggatgtcttccaagacctctctgatgaagccatctcccactattatctatgttgtcacaggaacacaggctctccttcatctccctcatcatagtcattatactcatagatttgtgagcaattgatgactatctatctacttttctaggatataaggttcacaagagcagcaactatatttgttttgcttattacattcttctcagttactagtactgtgtcttgtactaggaattgagaaccatttattgctgagaaaatacttcaggatgactgagagctcacctaggcttcatacagcccctgatgctgaaggtaaccactggtttaagaaggacgctcactatgttcatgagcacagcgtctcgtattaaggcaagccctttaggatgtgtaaatgagtctttcccagcatgtctctaacactaaggggatgggagaatggatagaaggaaacagggaaaaaccgataatattccttgggatgagatcaagtatgactaacaaaaagaaggtaattataataatgcctacaggcttgtataatctttctagttcaagaaagcctcaaatatattatctcacttgatcttcataatgccagagggaataggtggattatgaagttatattggccattcagagcaggaaacaaaggatcattgaaggcaaataaattagtcaaggctggaaaatggtggaacctagactaggacccatatcttccagagctgtgctatccaacatggtaaccagcagccacatggaaccacatgtggttactgagcacttaaaatgtggcaatttaaatgaagatatgctgtaaatgtaagatacatactcagccaaagacttcacacacagatacaaggatactacttatctcaataattttatattgcttacacatgaaaataataatactttggatatagtttagaaaatataattattaaattgttaataattaaattatataaataattataattacataagtataattacatacataatagttataagtatataaataataattatacataaataattataaccaaataattatataattaaataattattaaattaattatataatcaattaaattaattatttaattaaatatattaatatataatatataactatataaataataaaaatatatacatacacatacacataatgcatcttttaattaatacatattttaaataataaaatatattacataattaaataattaattattatttatttaataattattaacaatttaatagttatattttctaaaccactacttttttattgtggcttctagaaaatgttaagtgatatctgtggccacattttattttcattggacaatatggccctagattacagttcagtacacccatagctgcagattttgagtgggatctcagactgaatggagggtgaaggcactttaggtaaaatagtgagaacacagatatagagatggagaatcatatgctttagagaagtggaggctaaatgtcttatagaaaatgaaacagtggaagcacttgagaatcacattgtgaaatactgattataacaaagtggaacaaatgctatatttcagctgagaaaacaggaaaacaggactatagtcttctgatactagcttgtgtgaatttggacagttctcagtctctgttgcagtcttcctctctctttcttgttttcccctttggtaaaatgaggggctaaaccagaagatcttgaaggtccttctctttctagcttgcatcgtctaggtctttgaggggccaggttttgcctgtgtgaagagtgtgggggtgtgtacatgtagacacaagcatgtctgagagcccatcacagtcaaagctgggctttagggaggtccatctaacacctcagagcaggttgatgtggagtaaaatgagactggaaacaggactgagcagaactgaaccaaactgaaataatcagctgaaatcaacttgacttctatgcttaccaggagggcaaagtgaagcaccacccatacaacgccaagcgacgtcaccaggagatcgtatcggtttcttctgctttgccagaagccagcaggcgacattgctatgatcttcatggtaacctggagaaaaagcaaagaagaaaataaacagagagagtgtttagtacatatttaaatgtattaacttgagatgcattatgtgtatgtatttttttcaaatgaagaaaattttaaattatttgatgtggacacagtatcttttccattgaaaatgagacaaacactttaatgccctttgaggtttccttttaggccacgtgcctacactatctatctgtctgtctgtctatttatttattattattttttgagactgagtctcgctctgtcacccaggctggagtgcagtggcatgatcttggctcactgtagcctctgcctcccgggttcaagcaattctcctgcctcagcctcccgagtagctgagattataggcacgtgcaaccactcctggctaatttttgtatttttagtagagatggggtttcaccacgttggccaggctggtctcaaactcctggcctcaggtgatccacccacatcggcttcccaaagttctggggttacaggagtgagccagcatgctcggttatactatctatttaaagaataattgtaaacatgtagtaactaaaaataagagtttattaccaagatatatgattttatttttgaagctaagtagcttacaaatctgtgttctctacactctttcctcttcgttttatgactagttctgatcatgggacatttttcttccttaagcaaaaggccatagattttgggaaacatcaaccagtgtagggcaaaataagaatctgcttgtatttcaggaagactgccctggaaagcaatattatgagaatcacatgttaaaataaccttgtctgggccaacttgttttgcgtctctattgcaatttgagtcaatgaattatagtggcttgcaccattccctctaaatatcagaactcgcataactagacaggccaatgttcagacacaacaatcgacagcagcatttctgtagttagaaaaatctgatggataaagtgatgtctttgttcgagttaagcagaaccgcttaagtaggaaatatcctaagggcaaacttcaaaggcaatggaacacagagaggagagtaagtggcatcaaagagggaggctgatttactttaaaactgtgcacagattcccccagagctagctgactcattacagtacctccagaacaaagatgaaggtgaaaacaactgacattgttgccaaaggtacggtcaccgggtcctcgacgtcccactgcaacagaaacagcacacgagtcgttgcccacgtccatcggacacatacaggcttgcccctcttctgcccactttgccattgacagtgaatcttaatttttacacccaagaacataaccgtgaatgcatatagcagcttgtgatactctcggatgtagcagtgaatacaaaattcattcccggagtcttagggtgaaacgaagtaccttgacagagagcaacaccgactgggccaggacgagtaatgcgattgtcctcttaaaaaatggatgctgggttatgtcatacattttagctctaaaaccatcattatctagaaaagaaaggtttgggcaagggcattttagacacaggtcacatttactttcttgtcgtttattttcttaaatgcttatcttaaaacccattacatttttctccccaaacagttccgtctattgtgaggtgtttttgcagcaatggctggctctgaatattcaaaacgacagtgcatgatgccgtctatattggaaggagaagtgcatcattcaatttctgtcagtttaatacatttcacttatatttttaaaaggcaagagcaaatatattttatttaaaaattcattttttcattaaggcttagtctgagagcactgaagcacagcctttgggtggttgattttaatagccttatggagagatctgtggtttggagcctgtttctgtattaccttatgcacaacctcccagcggcctcacgattattattttaatttaaatctgagactcctggggaatcgtgcacactagtgcccaacatgaataaaatcagagcattttgggtacccgggcgaggcggaagatgaagaggctgtgcgatcttcagtcggctcttcaggtcttcccatcttctctgatcgacggtcagcaaagccgtccccttaacagacaaaagaaagcaggaaaaggccttttgtcatgtgcttgcaccaagaacatggcagatggggtgccgagacaaacaggactgatgtgagggcttgcactgaccatgttcttccaaccgtggtggtgagagaaacatggtcagaatgctcaaagttggtctcgggaggagttcccaaaatgatgaccaggtgtttcagagagaattcagcagccttcgacttgtatctttggagatgtgtaatattcaggtttgggaaaatgtaaagaggagtttctacataattacattttcaaaaaaggatactcactaatagtagttagtttcctttcatttcatagcagcaaaattatagcttgtcaatgctgtggcttccagttaagggtatgttgtctttctttaaaaaatgtctaatatgtgcaattgcaaaactgtttttgagagatacaaagtcatagagtttgcattttaagaaagtagtgctgtgataactgcctaaatggaattccatattctgtataatagagtacttgattaaaatgcatatgattaaaattatattatattgtattgcactgcactgcattatattttatcataaaagctgaagtgtaattttaaaaactagacaaaaaccccactctccctttccttacccagagctaaccactacccttcaggcgtgcatcctccttactatgttttcagacttttgtgcttacgcatgaatcaatacgtaagaatttgttctgaattttttaatatttatagaaatggactccaacatgtgattatttatgctgtttctttatatctgcattgaacagtatactttccatacaactagattactaaatctaatttgtttaactgctcacaaacaccatccactgtacgaatatccgaagttattcatttttgatttatggactataaccaatgctgcaataagcatccatgtactgtctcacagtaaatatctatgagggtttctccattgttgatctctaggagaagaattgatggggtctaggaatttaagcatctttacatttaccagatgttgccaacttgctttccaaagagcaaaaaccaaaacaaatttcctaccagcaatacacaggtgttaccatatcctaatattcttgcaatacttgatattgccagacattgtaatctgaccattttgataggtgtgaaaatgtatctaatgttgttttaatattaacgagatgaaacatttgcatgtgtgtaaatggtgatgcttgtatcttcctatgtgaattgcccattcatatcctttgctcatttttgtattttgatatttactttttaatggtttgtagagattctttatacatgctggatactaatcttttatcaattatgtaagttgtacatattttctcttagtcttggcttgtatttttattttgcttagagtgtcttttgtcattcagaacattttaatttaaatataatcgagtttataatttttttcctttacagatttcacttggtggctaatgggatgaaatccataactactccagggcaaaaaacaaatgcttactaggggtggggaggggaactagaatagggatagtcaaatgttgattaatggatatgaaaatacagctagattggaggaataaattttagtgttccatggtaatatatggtgaatctaattgacaacaattaattgtttatttttaaatacctagaagagaggattatgaatgttcccaacacaaaacagtgataaatgtttgaggtgatagatatgctaattatcctgatttgatcattacacattataatacatgaattgaaatatcacactgtacccgataaatatgtacaattatgcgctgattaaaaataataaaggcaaaaacattatttgctgcttatctgaaattcaaataaaaaataaatgctgacatgctttaaaaatggtttaaattttgcttttcatattgaagtctttaattcatctggaattcatttttgagtatgcagtgaggtagagatctcagcatagctctttacatcaatacaatcaatactcccaacaccactccttgttggtctcaccaccctctgcactaatttgttgagctgcttctgttttctacatacatgggtccctgctgggtctttctagttttttctgtaagtctaattttctatacctataacaatactgacactcttttaatgattgtagcttactttcttgtttcatgtttttatttttgttcaaccttcctagaggtttattgacttgatttaaaaaaaaccaaaacccagcttttgttattcttgaatattatagaagctatacaagtttccttactttctgtatcattaatttgtgtcctaatctttgttactttcttcccccctactttatttgattttactttattataatttattgatttggatatttgacatattaatatttaacttgtgattcttctttaatatatacacttaaaacgatacatttatttgtaattactgatttacctatacctcattagtttttgtatatgacgctataaaatgttttgtctgtaaatattttgtgattttctattataatttcttcaactcataaattatttatagtattgtcttaatatttccaaattgtagagttttttttgtttttgttttcattatggtcagaaaacattcttacattatcaattcttgggtaattatggccttctgggagacacattttgtgcttgaaaataatgcacattctcaaattgttgtaattagagttttccttatacattcacttgattgtgtttattgtatcaaatctcatatttccttttattctactctgaattatgagattttttgagatatatgttaatatctttcactatgattttggattttctagcttctttttacaacttgtttaatttttgctttgtacattttgggatttggaagttctatatctttctggtgattattttgtcattctttagtacatcatttattcccaataatagtgtttgtttaaaattgttcttttctgataatcacattgctaaaccacttttctcactaattataagcaaacacttgttctctggccaccatagacactaatgtaattactttgttatacataaaaaaaattttggaaagttgaactctgaaaggatctaaaagaataataggcatggagatatcatctgatcattaatatataaaaacctctgaaagtttattattatcaagttaggttaataaatcaaacacattgtcttacatagtagagaaatcagaaaaaaatctatattactaatatagacttggaactctttaaagaggtttccattttcaaaagaagacatatttttgcatgattctgaattgtaccctaaagattccctcattttctatctctgttgtctctacatttggaaatttacctatgtgcctttgggtatgactattaagatgtgtgctccatgagggcaaataacttttctgtgtttagtgtttaggttagttcactaggtcctcagtgtcaagagcagcctctggcacctagtagatgctcaaatacatctgttgaatgattgaataatgtataaatgctgttagatggcagctcatgagctgctttctaaaaaaaaaaaaaaacttgcagagaaagaaacttttctaaaaggctcacataatttagcaattgatatctccaattaacaaatcaagtttgtaaagcttggtaatataatttcttgtcaatttctcctttctttaagtgcccatttgagctgatagaacatacgccccagatcccccaaacaggccacgttactctttcctacctgcagaacataaatacagtgctggatggagacctccctggttattctgctaacctcagccacttctctaagctcaagtgttgcaattaattatacatttatttccagttactgaacattttatgttgttctatgtatgttgctgaattgtgagctgtgatacattctaatcttcctgaaatcaggtgtctgctcagacggcttcttaacggtgttctgggcaagcagtgcctaaactctcctgttaattgactgattagcttctgcttatattctagaattctcagtgtctgctgcattacatggctcaaaggcatctaaaaagatccttcttcctctttctgcttggtattaaactcaacactgtagggctcaaagcatctcgttaatgaatgtgataggagtaaaataaggggctgggtgacatgatcactactgttctttctgtctctaacatcccatgtttctgagggtccaagtagagtcggggcccaaaagaggaatttttaaatctcaccctttgaaagcctgaatgaaatgacatgctcattagccacacatcaaaggtgtcaattgactggctaactggtaccactcacgttgagcctgaggacagtgaatgacagatacagtcccatgtgtagcaacacaaactgaagagctctgatgtgaacgcatgggaatcagtcctagccatgaataacatcgagcagcacggtgctttacaggcagatctagcttcaacttaatgcagagtgaaggttgactttattctactcatgccttcgaagaatcacagagcctgcggtaataggcaccaattctgaattctggccctgtttatcacaccttataagccccagactagtcattgctttttctgcaaccgtgcatttgagagttgtgagaattgattgaatatgtaaaatcttagtacacagtgtgtgctcaaaaactgcatgcacttcccttactatgattccaaagactgcgtctcaaacaatagagggcatagctcaagtgcctagatgagcaagcccctctccaaggagtgctaatagaatgttcttccccaaactcacactttgataggaaactacattgttattttcccatttgtgagcctttgttctaatcattagagctgttacaaactcaacaggcttcccgagttcacaaagtatgtcaagttcatatgaaattagaaaatctttttttcttttttttcttttttttttttgagtctcgctctgttgctcaggctggatgcagtggtgtgatctcggctcactgcaacctctgccttctaggttcaaacgattctcatgcctcagccaacccagtagctgggattacaggcatgcgccaccacgcccggctaatttttgtatttttagtagagacagggtttcactatgttggccaggctggtcttgaactcctgacctcaagtgatccacccgccttggcctcccaaagtgctgggattacaggcgtgagccaccatgccctgccacaaaatctttttttctgtgaattaggattttgaaatttctaccagactcccctcacccccatcaaaatcctgagttcacctactgagttacacagaagcatacaatttacatttagtgaaagtaatattacctgtaattagcgaatcactttcatctattgtattttaataacttgctgcccatctttcttttcaatttgaacaataggagacgcgcctctcagttgtcggtgaattaatgacactgttaccaaaagggtaaatttagcaagagaactgtactcttaaataatgtgtctgaaaagcagcaatgagggagcttgtaaaacagttatagagattatttacaccagtcacattacagtttaaagcggcttcacgccgcgtgtgaaaagaaacaaatagctcaaagtgagtggctagaaaaggctaaaccctgtggtatccaaaccaaaaatccttaccttgttttcattgaaattagcaataactactccaacaaaaagggtcagtccaatcatgcaacccaggaatacaaaaacatgaatatagattccatggatctgcataaaggaaaatatggttattcatcaaaacaaatgaaagctgctcttgaagtgttcaaaggattcgatgtgctcgcttaccggccccacacgatgaataataacatctctcacttccacccagcctttcaaggagagaacttcaaacaacgccagcatagcgtttcccacattgtcgaaattaaagttccgaggattcgccctgcgattccaatacaggaatgttctgtgaaattccaataagcagcacccgaaggcaaatatctgtagccctttccagtcatgagtgtgggatatgtgtgtgtgtgtgtatatacacacacatatatacacacacacgtgtgcgtgcacacacacatacatatgtgtgtatatgtatacacacacatttttacgctatatggcattcgtttgctaaatcataacaatgcatcaatgtgttataattgattgtgttcattaggtaatgatggggtgatctcaatgtaaaacagctctagttctagcttgagaggttctgcaacatttctaccttgtcctgattaccctgaggactggacagatgattttatcgatttgcacaaagaagcattggattttggatgtggattttgaaatagttttgtaactgaaaatctttcgaaaggcataaattacaattgcctgtgttagtatagaaagtgtagagtagaatttagtcactttatttcactttgtgtcatcatggtgaacacagggctggaaagtagtgatgcatttagaggtcactgagacggcaagaggtgtttgcttgtagtatgtatttttccaaattactctcttccagttggattttttcttattaactctgagtcttctcagtggactcttagtctggtcccctttatgggtggtatgctttctacctccaccgctgattcctgattcctgaaactcattggcttattcattttctgttttcttatagatttggggggtacacgtgcaggcttgttacatgggtgtattgcataatgctggggtttgagcttctaatgaacccattactcagatagtgcacgcagaatccaacaggtaatttttccaacctatgacctccttccttcctcctcccatttgaagtccccgctgtccagagtttccaactttatgtcgaggtgtacccactgtttagctcccacttctgtgggggccagggatgtctcatttcttgttcttttaacatggttatacttttctcttcccaattataaaagtgatcctttttactagattgcatcttctttaattgttatggttcttagctaacatttttgttgttaatagaagaagctttcagtggcttttccccctctttccttcttattagaggctaattttaaataattaagattttgataaccaaacactggaaaatcatggactatatttcttgaatttaatgaagaactgagctccggaccactgactagagtaggccccttggagcctatttaaattatattttgatcattttttccccctgctagctcatttctcaaaatttaaccctcaggacaggcaacgctctagggaaaatctggttctgtacttttctaccatcttttatgttttttaaactatagagacaatcacaagatgtgccttcataagttttttgaatattaaatagatgaggatataagaagaaaacattaaactgaaactgatttgttcttaagggcttagggctgattagtggagacggtctttaatatagtgcaaaagccccactcagaaatgcatattttggaattctgctttatatttttttatgtatgaaagtacaaatatattcttttggatgcttccaacaatctttcctttgggatgtttccactaaatttcatatattttacagtagacagaagttataaggattctacagatgccacagtttgcttgaataaggattttttacaagcaagtgaaccggttctcagagccggtgttggacttccttacctgctcattttcttttgtagaagtgctttcttagctgaatttgcagccactgaaactactgttatgttctagatcttctagaagttagaatatgtgaaaaatattctaactaaaccaagtaaaacaaaatgtagcatcaaagacttcaatagttggaagaatttatcacattaaaaaaataagtctttttcagttttaatcatgtaaagtgttttcttatgctttcttcatgctagcaaagttgcaaagtttgaaactttacctgtaactacggagtccttcaataaatcccaaatgccatctattattgtcatttttacctgctacccttccttgaattgaaaaggttgtcattttttctggttaatttgtgaaatattgtaatcttgcctgtccaattcagaaaactaagacattagatctgaccacataattttgtcagttttttacctcccagaggaggtgctccaaggccccccaagatcaaggtagggagagctgctcttcccttggggaacatgggggcaccctgaagacgtgactgagcgtctgcccttggatgtggaaatgcagaaaaagactttgtccaaaaacggcatgctgtatcttacacaaccatctctcctaaaagaaatcagaaacgtcgtacttcctacagcaccccaacgctttttgccttgagctttgggcatagagttgccttaacttgtaataccaaacctatgcctagactttcctcctcacctgcctctgaccctgcccccttcacctggctagttcctattggttgtccttcaaaaggtaaccagtgtgtcttctcatctggtccttctctttggccctgcatagttggggttaggtgcttctcctgtgtgtccattgtacccttagcctttctgtaggaatcagaggcaggtatatgatgaagccaaagaaacctaaggggtaggacccctcttttgtacaggcccttctgagatgttggtaccccaaattgtttgggccttagaccctataaaacctgatcaccttcttcctagaacatatcacagtgtagcttaacattacatggagatgagtttcgggtgagccagaggtaagcttaggggcttctctgtgcagcattaaagcccttagcatattatataaaattatttgtaattttattttctgtttcccactagactttaagctcctaaggggtaggggccatcgcttattcagggccttaccacagtgacaagcatactagctggtgaagagcaagcactcaataaatacatttattataagcctgaatactttgttagtttttctcccatgcatgccattttcctatattccagacctcctcttaaaataaatcacactgtatttataatccatgatatgtttaatcctttttactgaggtgactcatcaagtctgagtgattcagaagaaagtacatttattaatctgaagagagaatattgaaactagactgtctcctgaattagtgcatatttatgtcctaattataattaccaaagcattcctctagtgtattcctagatatgttattttcttaatcataatttagccaatataaaattacaaaatttcagcttccaactcttgattagcttacttaagaaggaaagtgtaaaaagttatcatggttacagatgacatttattagatcgaaggtgtctatttcactacaatccaagtcacattatcctggagaaatggacaagagcacttgtgatgatgttcaaggaatgcctggctatttgcttatgcttctagaatggcattgcctttgaaacccctaataataccttccataaaatattgcatttaaattaactttgattttaaaaatcccatgtagctggttttatggactaggttgagtgctatagggcacaactggcaggtttacttttctccaaacactaccttcaagtgtgttccagctccctgtctgaattcttggggaggtcccagagctttttggttattttcagtaattcagttttacatccaactgatcctataactcatataacaatcccatccttagcagctcaaggaccccggtttgaggaaaggaagaaaagttggccactttcttcacttccactcatcctcttcaggccaccacgagattctcacatgactgaggtgggatgtcgttgaaaggaatggaggaatggagtttaagtcttgtgcatctgatacaattggattctggccataggtgttcaagagtttgaaccccctctccagcccaggagtgcctcattgcaccttttctcctgtaagtgtgcagtctttgggtgattctcaagtctggctcctggaaacacacctacggaccctttggaggggggtaccctttcccagcacaaagccctttgccgcaaggctcaagaggactcagatgatgtggccctaggcagtgactactgggctctccaggaacaccagataaccctgctctccagatggtgatgagcagcctggccacaagagtctctcttcttgccctgcccatctctgacgttaagtgatccccctggggtacctcacttggcagaggtgggaggcaccctctacctttctctatagtgaaggaaatgaaatgccccagtgttctctattcctgactacatttacttccatgatattatctttgaattaataaaaattaataaattataacataaataactttatgctataattaatttttatctcatggaagaaaatttttatgctcctttaatttttatttcaatggaaattggacggcttttctagtcagcagtggggccaggatattctcatgtctcacattcctctctctccaagctgaagccacataccccaaatgaatcctttttctcagttcttggatattttaaaaaataaaaacccaatatgcattctattggattacgtataaaagcgaatttcatatgagaaaaatgccaaagagaggtaacagtgagtgctagggtacagctgggtgaaatgctgttccttttaaagagttttgacatttagaaaagaacatcaattgtgacaaaagcagaggtgctgtgactcagttgttattcttacacattttctaaaagaaaacttaaaaaacagataataattttaaaggacaaatgaaggtgacagaacactcagttcaccaatgacacagactgagagattcactcatggtcattaataaaataagaaagaaggtactaggtatttctagctttgatctaagtgctttgaaaactcaatttaaagaaaaaggaatattaaagggaaagttagaagcaatcaactgtgtcactgattattcctctctagtgtttcaataatggaagtccttcagtgtaaatgggttttaaaatggaaatagctttatgatttagggttctattatgaggacatcagatcctcctttaaagatataaactcaggataagtttagttttaatttgacagaaaatcctgttaagcctaattttttaaggcatttgaatccagatacatatttctgaagtattagaaaaatactgagataatatttctctagtttcatgaagctatatagaactcattgcactacttgctctcttattttttaccttatttctatcttccaatataatctagcgcttcgccctgtatgacttaagatcattttaacatctctagcaaaactacttttagttacatgccatatgatacttatttaaagccttatactgacaaacacaccattcttcagaatatttttttatgatatacttaccaaacacggggcacccaaaatccaggttttttctctccaggcctcaattttaaatttaagttctttgacacactgacattaattctgaatatgccattgcaatcttcctaaagtagaaaaacaagaggagaggggaaacctggtcagaaaatgaactcagaaaagataaaggataggaaactctttcttctttcacggaatcccaaaagccctttatctaacaacagtgatgtggacagctacccagcaaatagtaacaaagactttggagacaggcagttaaaaatcgatgctgagaatattacttaaatgagcaaaggacctgagtagacacttctccaaggaagatatgcaaatggccaaaaagcacacgacaagatgctcagtatcatgtgccatctgccatccggaaaatgcaaatcaaaaccataatgatatatcacctcacacccactgagaaagccataaccaaaaagtcagataacaacaagcattggcgaggatgtggaggaatcgcaatcctcatactggaacccttacatactggtggggatgtagaatggtgcaaccactttggaaaacattctagcaggtcctcaaaccactaacacagagttaccatatgagccagcaactccactcctaggtatctacccaagagagatgaaaatatatgtccctatagaaacttgtataaaatgtttatataagcattattcacaatagccaaaaggtggaaacaatccagatgtccatttttgaacaaacagataaacaaaatgtggtccaaccatacaagtgaatattattcagccataggaagggatgaagtcctgatacgtgctacaacatggaggatccttgaaaatattatgctaattgagaaaaaagtcacaaaagaccatatgttatgattttattcatatagaagtccagaacagtgaactctatagagacaaaaagaatattagttgttgtttaggtcttgaggtggaggctaaagggatgggggtaatagttaagagacatagggtttcttttcaaggagatacaaatgttctaaaagtggctgtcgtgtatacaactctatgaatacgctaaaaaaccattgaattgaacacttgaagtgggtgtattgtgtggtatgtggattacatctcaataaagctgttaaaaaggttttaaaaattaaacatctataggaagtttttgactcatttcctattctccctttggttatttttgtttctttggctatgatggtcatattttgaacctaaatctcttttctgggttcaaggtgtagatggtaaaattcttgatcactgtttgaatatttcaacaaaaattccattttaatctgcttcacgtcctctttgaccctaagccatgtctcctcttggcctcctcctttctgtccctggaccagcatcccagcagaagcccagcatcaagcttagggttccctgggctttccctgtccttcttggcccaagtctccattcttactacgatgagtttagtaatgccaacgttacttctttctggattaccagcatgattctttaaaataagaatattttaatgcaaataacacatctttaatttataaagcctggacaaataaaaggaagaaaacttacccacaattgccacagacaaacacaatgaacgttttggagtatatccttccagtcttttttcctatatgtatctgagctcataaagtttatattcttccatcgcccacttttttcagctaaaactacattgcgattatctttccataaccatacctttttatgtagaacattatttggaaaggctgtgttgtagtgtattgtataaaggtcccttgacatatttggcctcactgccttttccaatttgtcttcctgaacccacctgagcccacctttgattgcatgaagcagtctggtatcttggtgaaaagccagggtgcctggacactagttccctgcttctccacttattaggtgggtgaccttggacaaattatttaatctttctacacctgttttcctcattaggaatggatatcctcattaggatatgggtaacaaaaacagcactaggaatggtgctttgtactttgtgggcactaggatgtgtctgattcctcttcttaccaaccttttgtggtttctcacttctcatcaacgaaattccaaaccccttagccaggcatttcaggcacttgaggatctctccctaacttacatttctggccttgttcttcagttttttcctacatgggcgggaatgaaattaacactcactgttgagatcaggttaggtacttcgcataaacaaggtaatctaatcttcataatatcattgtgtgagaagcattcaaggcagaaataggttccagaaggattaagtgaccagaccaggccatcacctctcctgaagtaggattccaatctcagaagctgtgatttcgaagcccatgctccttcctccttgttcggtccctgcctctacactgtgacccttctttgtatgctccgtgtccttcttcactgcttgctctccttggaaggtcctttcctgctcatctcaaatcccacctcctccctgaagccctcccagtacagtactcccagttggaagcacaatttcccatgctgacatcatagattacatgttatttctgcttctcataggcttttgaaaactgctgactttatattactgttgcttgaacatgaaacacgttctgattggacagaaaatgccacaaaacagaagcaaggacctcctaatgtttcccttccacatttcatttcacctatcacagtgccttggacacaactgacatttaatgactatttgtcaaaaggtatcctcagcgtttgtttacagggttttggtgacaaagtcctaggctccatatctatatctatattgatctcatgacatctgttgagttttaagacaacaaacaaaggagcagagggaggaagtgctcagcctcatacaagaaaacacatcttcccaactggaaactatgggcgcagcaactgaagcttcgttgtctttaacaggaactgtgtgtgatctaaatgttggtgtatctactttccccctttctttggatttatctcttcttttagtaagatgggctgaagttctccaacagaacttcagccgacgtcaccttcactcatggcgtttttggcctcggcctcggcctcttatgtttggatttgagaagacaaaaagactcaagccccgtctcaccgtgccaatttcttttcaatcgttctgcttggtgctggtgctctctatgatggctgagtctccttaggctttccatctgagcctcgcacagacctcactgctctaggaaacaggataaatgcatcatgaaatctgtgtctatgctcatctgctggctgctgtcaccatcaatcttcagctttggctgggtatgagtggataatgtaaaatcaccatgctcttaggccactgttaatatactgagtcatccaagattcctagcaggcttcatcctgaagtgttattatctttctggcctctgttcagtgtggatcaaaaatcactcttctttccacacacaagcttgtggatgaatgcgtcaggtctctgtcactttctttatcagctaatttgatacggcatgaccgtcaggccacattccttgttctgtcttctcaggtgtatcaaagctcttggaatgtctctcccagtctggcctttgtttcaaattctcattattaatataatttataatgtattttggctgaacaaagatgttacctgtattttgtcacaattagagaacaatttgtatcatttaaaatctatactagatagccatatttgctagaaataaataatgtagttcaggtctagtaggccttttgaagatatacatttaggaactgaggcatcattttattgggatcaaagagaaaatgcttttctagtttatacatcagcagtggttggtttactttatgaatttacttgtaacataagaatcctaagagaatgggacactttatgatattacaaaaattgtctaattattaaccaaactgtgtcccccttttatttttctggagcacacaactaaattccagccccccttgcagtatctctgctctttacagaggaatgtgggtggagcagattctcccacagcccactcagttggagatggctctccactgttatctccagctcattgaagaaggctctgaagacatggcaaagggtggcggcataggatagaaggcatgtgagtccctgagtggtcatttggaggagagctgtatatagtgtatatattgcaaatgtatatattgcaactgatccaagatgcaatatatacatttcattatgtgaagctaccgaaatattgggcttgttacagcagctagccttcccttataaccaatgactgaagaaagagaaagaaacgccgtagtgcaagtattcaagtttgggtctttgtggaggtccttgttggttgtcataaagagggagattctgggcagctagagctaatgtaaaggcactggctttctaatggggagaaagctgagagtggggaagcaataaaaagtggtgagaaccaaacgctgcttcttggacatttttgcatggggctgtttgctgatatgagtcttatgtgacaacaaaggaaggatcaagttagctaagacctcaagggaaagtatccaaagcttacagctgtaaacagctggaatcttgggtgaccacactcaagttgtcaacagtgggttgacactggaataggagggaagagtgacattctctgaggtgtgcttttcatcttattaacctttctagccagaagagacatatcacatgcttaagcaaaaaggggtttgtgggaagagaattcttagggttttatagggagttcttaaactaggcttgtcagccactggtaccacatgcttgccaagggagtgtaaacaccttattattattttgttttctttttagggacagggctctcgctctgttgcccaggttggagtacagtggtgagatcatagctcactgcaaccttgacctccagtttcaagtaatcttccctccttggcattccaaagtgctaggattgtaggcacatgccaccacacttggcccttaatttttatttcaaaagacagaaagatacatcttacccttctaataatgttgggatcattgcacttggccagttttccagcaaaaagctgaactccaaagcttgcaaaaacgagcattaatgtcagcaaaagaatggagacctgaaagaaattgatgaaatgttaaatctcttgttaaagactaaatattaggtttggtttaaacagtgacataaataggacttctaagataacattgtataaaaatcatgggtttttgatgatatattttaacttctccaccataggtcacacaattagccttactggaaggtcaaaaggagaaaattaacaagctttgaattttttaaatggaaacatgaatttcatgtaagaaaatggaataaggtatttttgatatggcttgaacttttctgactttaaaatcaacaccttgatcttttttatttaatggaacaaaggaaaaaaatgtttaagtaattatattttgtctattttttcccaaatggacatatatatatttatttttttttctttttttttttttttttgagatggagtgccactctgtcccccagggtggagtgcaatggtgcaatctcagctcactgcaacctccacctcctgggttcaagcaattctactgcctcagcctcccgagtagctgggactacaggcacacgccaccaagcccagctaatttttgtatttttagtagagacagggtttcatcatattggtcaggctggtcttgaactcctgacctcaggcaatccacccgcctgggcctctcaaagtgctgggattacaggcgtgagccactatgcctggcctggattcatatttttattagcagagcacaaatgagcgggacagtggcttagctgtcttgtaactgtgaaggtgtgcgttaggagaatgttctatgcatagaggagaggagagaattcagtcctgaagagcaaatctgttaattaactcatgctccctctgctggctgacttctttggtctcagcagagacgagtggcagagggcaaaatatggaacaagtgaactgcactggttgaataacctaaacatatacctaagtgtactaaaatcacactgaccaccattagggaaaggcacaaattctcctctaaaatttattattgatcaaaagattcatatacattagcagtcaggtgatattttcttttaattccagctgtgtgaagagtcactgttttatggctttgcataaagaaaacaagaatttttaaacccatcttaaaaaagaaattcagcaactgggaggctgaggtgggtggatctcctgaggtcaggagttcaagggcagcatgggtaacatggtgcagccccgtgtctactaaaatacaaaaaattaactgggagtggtggcacatgcgtgtagtctcagctacttgggaggctgaggcatgagaatctcttgaacccagtaggtggaagttgcagtgagctgagattgcgccattgcactccagcctgggcgacagagcaagattctgtctcaaaaaaaaagaaaaaaaaagtcagtaatgatatatatacctctagtaacatcacaatctatctttaaaatacatttgtgtcaactacaactacagctgttttctcatcacaggtaagtctctagaaagcaagatacaaaacaagcctatgtaaattaattcatgcttctcatgcacaagcagacctcatcaataataaaaaaaacttttgatcactgttttgtaaggcaaagatctttctgtaacagattgtgaacaatgagcctctttcttgttgttttatctctgaccttgttttcagaagaccctaaatcaatgtttgcccagctagaaagtacgttttgccccctcaatcatctttgtaatcactcattactgtaatgctgaagttaattgaagtgggttatacctatatgttgcatttttaaagttgttttatgttaacactcctgagatctaaagacaaattctgtgctatattatttcaggaacacacagaatgagattaggagcccaaaagcatgaattcctaatcccatttgtggagtacacagtgttgaatcttcttatccttcattttcagatgggaggaaactaaaacccagagtaggaattagagtcaagaggttagtaccgaaagagtcagcagataggaactctttcaaatctcagagtgcttctctttaggtgaattaaataaactcatacgccagaagtgcccatgagtaaagtgtttgaaggtgcattgtgttttgttagtgcctccattaccctctggcaataaccaaaactattgaattgacctcaataagcaagactcacttttccctcattagctgcattagaggtggactactgtgaactggaatcaaaggataattctcacataccaaaaaaatttccttgaagccgctgaaaagttctcgaacaactttcctcatctggggcaccagtttgaatatgcgcagaggtctcaggcaccgaaggaccattagaagctgagctcccgattcagcaggtacattttgaggcatccaacaaagaaatatcaagctcacctaaaggggaacaaatgatctctggaatttatacaattcatcccctactatttacattttctgacagccgactggccacaacttttcatttagcagagattccactcactggttgtacgtgccatctgttaactttaaacaacaaacctcatctagacttgctaggtacctcaaaggaaagtcatcatgtgtatgcaggaaagaaatgggggtgtccacaccgtgtgtgtgtgtgtgtgtacaccagtgcgttctgcctcttcttttaacttactactctggaggctccactgatgtcgatctggctggaattccttttatcaaggttactgctattttattaatgacctgcaacatgctacttgttaatgatcacaattctccttgttgtctctgcaaagacattgatttcatgcctccttggacatacaggaaaaataaaaaattctctgagcccatttctatggttttccagcgagttttactagacagttgaatgggcaactgctatagccaggtattttatgcaatggaatcaggagagagatacaatcacaatcactttagtttgctttcagcaataaggggctcataatcaataacatggtttatatgaggcaaactttttttttttagtatagaagccataaggtttgtgggatgcaaactagatttgccatgttagaccttattaatgtatgtctcattcatacataaaattgtgattagtgtatttgaacaatataactatccatagatatttatgatgctcttaatttagattttacatgcatggcccttatttgcatataatgaactactctagagtccatttaagaattcggttagggaatctaagcctctgtaactcatacctcttgcgcttataccaagaaatgcaggagattttacaaaaccattacatttttcatttaggcaataagcaaagacttacaagatatataaatatgtccattactccaccgaagtccctgatgacagcagttggagtgaaaaataagccatctgccataatcttcagattaagctcaatgctcatgaatatcacaaacacatactcagcaatctgaaacgggcaaaaggcagtttggttacaatgaacggaaaaacagcaggtcagtattttacctcctagttgtaagctgagattttgcagcggtaagcggtacctgcaaagtaggtgcatgcatgactcttcgaaacggggactcaaacatcatggaaatgcaagagcagatggttacgatgatcatgacccagtccaggtaagtgaccaatcccagcaaatcactgccaaagaccaaacaaaattgagaaacataaaggttccaggaaaggcttctaagagttagagatgatggcttctgtggctctatcaacatgactggtattttaaaaacatcattccccaatcatctatttcatagcactatatagcaagaaaataaaagagaattttaatcgttgtatgcagcataaaatagtacatgaaaactttaaatgtgcatggaaaatgaagttggtgatgcttactaaagttgatggtactttgtatttttcacagctcctgtgacagggtctgttttagatctgtaagagaacacatatataaaattctgcaacaaagcaagcatgttttaacttgctaaaaatcatatttgcaaacatctcatctacctaaaatctcttttacagcctctctacaatgtccattataaaatatgttaactgtaggtaactctggaggtcagagaacattgatgaaagaaaaaatccaaagaatttgcagttgatgcttatgaaaataaagttttatatttctcaaaatacttgattttagactttgtgactttgttcagaattttctgacatgggtagtacaaaattaagttttgactttcatttaaaaacactcatttgaaatctttgccttaatagttcaagaatgttagttattcaagattatttaattaaatactccataatttaaatagacttcttccccctgcatttaactgtgatgtggtagaatgatttatttagaatttcttggaagggagagtcgttgtttctactttcaggaagcctgtgagcactgtcaatgagattgcttacagtctttgtgtatgtgtccccaattacaacagagtcttcatcaattgtattcaacatcagctgccttgctgataaaagggaaattacatcacactaagtgaagtggagaattaaccatgagatgttaaggtacaggcagccaacaggataattcaagataaaaaaaacgtacttcaagaactgatcaaatcaatctccaaaatggcattttcttcctttactttgaaaactcatggaagattttaataattgtgactcagttgctttaaattgtgaaagtctttatagaacagcagaaagaacaatagtctggcaatcaagagagagccaggtagtagctgggtccctgagcaaagccctcaacttctgcacgcttaaatgtcctcctctgttgaaggagggggcacacaaatgacaccgagtggtccctgaggtctcttccatccctgaaatgttataatagtgtgtattagtttcctcgagctgctgtaacaaagtaccactggtgcttaagactggatggctcaagcaacataagtttattttctcatagttttggaggctggaaatccaagatcaagatgccagctgagttggttctttctgagggctgtgagggaaaaccctgttccagggctgtctccttgacttgtggagagccgtcttctccctacgtgtcttcgcaaggtcttctctctgtatatgtctgtgtccaaatgttctcttaaggaaaccaatcatattagattagggcccaccctaatgatctcattttaattaacctgtttaaaattcctatttccaaatacagtcacattctgaggttctgagggtttggactctaccgtatggattttgtggagggggaacaattcagtccataacagatagtgattatcatatgctactaattaataacaaagaaatcaatttacttaaacgatggcatcagggacactccaactacataatgggaacatggaaagttttctcatttcctccatgactcttaatgtcttcagaatatttacttaaaggtactgatagggtttggctctgcgtccctacccaaatctcatcttgaatggtagctcccataattcccacatgttgtaggagggacccagtcagagataattgaatcatgggggcggttcccccatactgttcttgtggtggtgaataagtctcatgagatctgatgattttatgaggggtttctgctttcacttccctctcttgtctgctgccatgtaagatgtgccttttgccttccaccatgattgaaaggcttccccagccacttggaactgtgaatccaataaatctctttttctttataaattacccagtctcaggtatgtctttatcagtggcatgaaaatggactcatacaggtatgcttgacaaaaatccatttcatccatttgttgcctgtcaaacttggcttaggtgtccacaactagtgtcttcaatgtccactctacttacggcttcttacacatttcttccatgttggtagggtagagacagtgaacagtgggtttccttcttataacagttggtaatgaaagcactaatcaactttacgttattctccaaaaaacaaattgaggtatttttaccacaaaggaactacaagcctcatggaagacatggacaatgaccttcctttcaccatgtcctttagtctccttttgtctcagtacttccaaaataaaatatggagttaataatgccgatataagtgtatcaggaaactgttaaaatgcacaaacgaaaatggctgttttgtgttttatcaatgcgagttttctataaatgttaactacttgcgacctttgttttccacctggtcgggtgttcagcaaagaggagcagcatgattaattagtccgcagtttattttgtgaccccattaggattacacgttccttcttcttcatatgacaacacccctgctgtttgcatggctcaggccaaacacctggctgaaatgaagtgtacttacgcgttgaagcgtgctcggaccaccacccggcaaaagtttctgaacctgtgttctcgcccgacaatgaacagtggcttatcgaagtatgggtggttctctctgagttcctcttcttgcactttccttgaaggagaaattcatgggagaatgaggctaagggaaattttgccattcccgaatgagagccatgggacactgcagcaacctgtaccttttcatctctgcttgctcctttttttcctgaatcatctttatttcactgtcttctctttgtgcatttctatatctcactgtattggaatgctagaaataaattaacagggggtgtgttaaaacaggagggttttgaatgcaaaatatattatcagttaaaaaacttaaaactaatatctccctcaatataaagtataaatattaattacatatatttactgttaaacatatatttatatatttatattaaatgtatattttacaatgtatatttatactaaatgtatatatttacaacaaatatgtatatttacactaaatgtatatatttacattaaatatgtatatttatactaagtatatatttacaataaatatatatctatatgaaatgtatatatttataattatgtatatttatactaaaggtatatatttacattaaatatgtaatttaaagtaaatgtatatacttacattaaatatataaatttacagtatataaaatatgtatacgattaaatgtacatatttaatggccacagtcttcatagcaagagtatttgttcctctaaaaagtaattcattcagcacatattgattgaaatcctattatgtgccaggcactattctagtgtgcaggatatggcaagtggaaacaaaacatccttattctcataggatgttctagtcagtgggagacagataaaaaataattcaaaataagtatgtaagaggatgcttagtgatccgattttttaaaaaatcacaatgggtgaaaggcatagagagacatagacaggctagaagattatgattttaaatgaacaggtcagggtagacctcaatatgaaggtgctatttgaggaaagactagaaggaggtgagggtgcaggctgtggtaggactacagaaatgtgttcttccagagctaggagcaggcctggcgtgtctacatgtggaatagccaggatgccagtgtgggtaaagctaagagaggtgagcaggccatgcaggcccttcacagccctttagatggaccccatggaaggtgcaaggccagagttccagtaactcagtagattttacagaaagcactccttagacttaattatctgtgtctgctatcattcagaataagtgaaaaagttaaaattctctaatttaaatctcccctttgtgggagaaaagacattataagaatttattggaaatgatcagaaccccatggcattttgctatggagaaggtgggagatggattttactatacttctacatgaaaaatagggtaggaagtctctgaagaagtaagctccggcactgagactattcaaatagggcctttgctgtctatgtttaaacacattattttcaaagacatgttctgatttgattcttaagtaggttgtacatttcggttgaaacatattgaaggcgctttgaatgagggttgcctctttgacttttcacctgaaaatgttctccgtgcaatatggctgactctgcagttctaagttgcgcaggccatatgttggatttgatggcaattctatgtcaacaatatggtagccaatcagatagagctatggatattaaaaatcatggtggtaaacagagctctgtgccaactagaaccatgtctatagggtattggtgatatcaggtgttctcattgccaacttctcgctcttgattttgcccggaacacttaataaaaaccatgtacttggactaaaacagcagtttctacagaatgaaagcagatgtagtaggcaagcactccaaaagctcaagaaataagagataagtggtgaaaaagagaaaaacgaaataaccccaaggctttgctaactttctcttgctagccctcctttctcaagtgccatccttggctctgaacattcaagattactttttaagccagttcatccagattcaacctaacgcctgtctttttaccagggcttcataattacggttatttaatatgcatttcccaaacctttcattgtaatctttgcatggtatagctgctgggccatataacgcttggcttctctgcatttttttcatgtctccttcatttcatttgggtctccgggataatgcagatgggtctacgataaccatcgtatctaaaattccctgcccccaaatccccacctttgatttatttacatgacttcattttactttacattataaagcaaatctgtcacagtaatgaagagatgatggaaaataaaaagaaatcactccagaaattccattatatttttatgaacttattatctgtctcctattctaaaatttaagctccaggagggcactgagtctatcttattaccccactgctcctcgttccttaaaacagaacccagcacagagcaaacacttgataactatttatagagccagtaaataaatccatgacttagagtctaaaagcaaaaagctttcctgggaaatactaggtagtccttgacaggaaaattcttctagaaataaaatttcacttcctaatatataaagccctgaaattatagacccttgatctagattctagaatattcgattctcagtgaatattcaaagtcaatgatgcaaatcaatcctatatacaatgcttaaaatgtctttaatttcaagtcaaatccaactgataatgacacttttgtgttactattttaactaagacatgtgctttgtgtgggatgactggagttttctgctgttaacagttacttctgatacttggctacataattcatatcctgagtttcctgattccctctggtatgaagtcttaaggagacatgggaatgcagcagaaagacactgggcattgtctaagcagtcatttaaatacattttcataatcacgtttctgaaatccaaagcattgcttaaaacttacatcttgagtcaaagtttcaagagattttcccctgctgatcctctggctgtttgatccatgtcttagtgacctaaaacaaccacaggcactggttaatacatctcaagatcaaactggcctttcaagcagtgaccatgataaaatcaaaataaaacactttttctgctacaacgccacaaatgcctatgatttcttttcatagcagaagcttatactctctccaaatgtctttgatcccatctaacaaaattcagaatttttccttctgatcttaaaggtgagaatttggccatctctaaggaaaaggattgtgaagtagagatttttttgaatctttggatctgattaggtgtttcattattgtaacaaacagcaaatagaacgcgattcctcagccatgcctgtctggcagccagggctgacagccgtgactgtgtacagcgaccatttcctgtaaaaccccccttttttagagtctctgaagccctgtcttcccaagtatttacctgcgctcttggcggatatgatgctgcacgctgaggattgacctctcctttgcgggctgcccctcaaatgatccgctcagcatgcgctgtcgggtgcaagctctaggaaaaaaaaaggagcccaagataaatgcatggtttgtacacttgagatgaataacacataagtgctcattacttttattattttaaaggcaacaccaatgaaaacacaaaatacagcaaataacgtataattataaaggaaaatgaactttacgctctgcgtcaagaacacttacaaagcagaagtatcacagctatgaagaagggctggaaaataaacagaaagctcccctcttgcccctcctccttctgcctcctccctcctttccaaaaataatggtagagcttctatcaggacaccataagcagaaggccagcctacccacagtgatatggtttggctttgtccccacccaaatctcatcttgaattcccatgtgtcgtgggagggacccggtgggaggtaattgaatcatgggggcaggtctttcttgtgcttttctcgtgattgtgaattagtctcataagatctgatggttttaaaaaggggagtttccctgtacaagctctcttctcttgtctgctgccatataagacgtgcctttcaccgtctgctatgattgtgaggcctctccagccacgtggaactgtaagttcactaaacctctttctttcgtaaattgcccagtctcaggtatgtctttactagcagcatgaaaacagattaatacacacaggcaatcatgatgtcggttttgaatttaaacaaggtttctaataaaccccctttgggaaggatttgtccactcaggctcctggaatgattaaatatatgttccaaggagattttgtagaactttaggaagataggaaaacataagcttacaagcaaaaatgagtcataaagagaagtaactaaagctggaattatgcacaacaatgtaaacatacttaacacgactgaactgtacacttagaaatggtttagatggtaaatgttatgtgttgtttttaaaaccacagttcaaaaaaaaaaaaaaagcacacagtttttggaattattacctacagaaacctcaatctgaagcttgcagcttactggtaaccagttaccacttgtttaaaccacgaagacttttaaaaacatgttctttttggacaataactggacttgtgttaatttctgatttgctaatgagtgaagacaattgggtggcctaacacctgtggtgtgaatgattttggtgagaaaaaaaaattattctccagaaaattttctccaactgggaatgacaggaattcccttgagatagttgataagtggcaagaaaataacacaagggattaaaagacctgtgtgccagaagttacactgttatgaagtagttgagtgatctttgggcctaacttcctcattggtaaaatgaagagaaagccttgctctgaaagatagctcacaggttgaaaatgcaatgattttatgatatgcaaatctaatgatactctatttgctcaacacctgaacacacaattctgccattttttacatattattttcacatttatgtttcttaaaatgcatttcttgaatggctttgaatatgattaccatctgtctgagaattaagatctttgagaaaaagatttgtatgtgcttagcgcacttaaaatagcagctcttatgatacatgtataatagaagcatttttaagtatttaaatataacacatatattacagaagaacttatataatacatcatataagaacttattatatagtaatacattatataagaacttactaaatatgtcatatttaagtccttaaaaatgtttttaatgtggatgaagataattatggtgaatatctatgaaaaatcatacaaattcactgaatgtaaatgtattcttggaaacaaaccctaaataatcactatttttcatttactaaacagcatgaagcaacttttctacagatatataaatatgtctaacgagaacattctgaaaaatcttattccattatacaaggagaccactggccacacacaggttcctggtgaatgagggaaggaccgcagatggaagttataaacctgaggttggacggtggatgcaggagcaaggcaatgggaaggaagttttatgaccctttggcctagagctcacctggacattgagacaggtatagaaagattcccatgataggacgtttctgcataatgaaacagccttgtacagcctaagccattgtcacatttgttggtcatgtaagaaattttgctattttggaaaataacagtgttggcagaaagctatgaacttcagttggacacaatcagacctgctaagaggttacatatactctaatccaatgtgcccaggttcatacaaaagcatggtaaaagtttgctttattattttttaaagggaatacaatgttactatagataagcatatacagtaaggcaaaccatgaaataaataccaaatagtgttttaacatgcacagtataatgacagactgatataaatgggctctgaaaagtaacatgaaatgagaaatgaatatttcacctatgtgaaagcacaaaaaaagacttgttttatactccatgttcctacagtatgttattaaccaagcttgtttaacgctcatggcattttgttatcattagttattccccttactaggctgtgagttgattagggaccactttatcactcagcctcccattcctaggaagttcagtttctggccctcatgctgcctgatgaacagaatgagtaagtgaaaaggtggggaggggtgagtagggagggtagcggcaggtgcgtggggactgtgtgaccccatccctaacttgctagcctctcatggttcaaagaagtgcaccctgcagtgcagctgctgatggaaagttctgcctttgtctggaagcctaatggagaagatgagttgagaaaacataagctttaaaagcacacacttctgacttcagcttttataagctgtgggaccttagacaggtgatgtgctttctctaagcctccatttcccatatgtaaaatgcagagaacaataatgcctttccttctgacttcacagggagctggaagaagtaaagatgattatgaatgtgacagtgctttggaaacatcaacgctttctttgaattttagttgctattatttcctgttgtatcttttcccgcgtcatggtggatgttataacactctacatagcatattcattctctctctctctctctctctctctctcgctgacttgctcttcccatcttgcttgcttgccctggtgaagcaagctgcatattgtgaggtgctctacggagagttccacttggggaggaatccagcaaaccggatggaactgaggccttcatatcacagctcacgaggaactgaatccactaacaaccatgcgattgagtggggctcttcccattcaagtccaaatgcatgcagcttggagagagacatgactaagggatgcccagattcctgactaaaactgtgagatgaaaaacgtgttgtttaaatcacttaagttttggagtaatttgtcctgcagcaatagatcacgaatgcggttattatcactgccttaaaaagactaagcctaacgagcagcatggcttgcacagccccgtttagtgtccctctaacctccctttctggtctcatctttaccaggaggaacctcgttctctccatgccattttctttgttcttttagttcgtcacatatgccatgctccaaagagctctaagagagtagggttttctttaaaattggtcatgattatttctcagctcttatccacagtaggtgctcaataaatatttgtggaatgaatgaaccttgaaattccgtgaagatcaaatattttcttttctgatcactccctgcttttgaagcatgaaaataatcacggacaaaacagcatgtgtttaaaatatacttttaaaggggcaagttaaataatcttaattttatctcaagttagaatatgatgccactcaagaataatgggctgcatacctacactagaagagacagtaatgaaaaaaaaaagacattgcttcttacgactaaaaacttcatacatctttctctatgttgtatgtgaaagctattagggaagcctgaaagccaagagggagcagagcaggctgtagcaggtgaacttagttcaatttctttaactggagatcagatctgttgctgggaacatagtctccatatacctcctcttacaggaatctaatacttgcaagccgaaatagtgagtaactacaaaatttgagacttccaatattttatataagaaatgagatgcatacatccttaaagttacgaagtaacagacctacccagaaggagaagaacttgaatattccattttgttatattttgccactttacatttttcattagtattgagatgccttttggtctcatgtaaggacaaaggaggtgcattttcagaaagaaaatgctcatttatttgcttcccagagtaaaggcaaggctaattttactggaagaatactgtgatcttcagggacagtctcacttttcttagaggaaagactgggtagtgtcaggtaccaaggtttttaacatcttccctagatcttttcacaatggcaagtactagaaggccagtttcttaggaactccatctagtggcttcatataaaaaactggcctgcctcctcagcttctgcaactgggaggcacaagacttcaagtgtctggtgaaaaataatgaagtcttttgtcttgtctgggtgaggaaattcttcattatgcaggcatatgtaatccctttattcctgttccctggaggagaattacagtgaggcattttccttttcccagttggggttaatgttatgccctctctacctttgaaagtaaaacaagatgaggacccctgaggatgattcaaatgtgggaatattcttcagcaaacacacattcccagttgcaaaaatattacccctggtttcttgccaagcctttgagaaaaaataatatgaaagattgatccttttttttccccctgcattgcctttgtgctgtggaatttcaattgctccttatatgacagccatatatatatatatatatataatcttttatggacgttggggaaagagaatcatgtcttgaaattgtctctatttttcttgacatttctccatctaaaatattttaaaattggcccaaagattatggttataagagagatctttggagctttattagcctttaaacaccactagttgtttatagacacagtagcagggggtccccggttcttttcttctttgtctccatgtcttctttcttaatgtcccagaacaagggtgtggaaaaagcctatacattctgtaatgaaagggagaggcctatgagtcttcaaattattttcactcattatagaaaagttagattacacaataccgtctggtattaaacgtaattaccatctaaaggaactgcagtataactttgcagagcattacatttgagggattttgctcaaatcttgaactccacaagtaattcatttaaaagtattatccaaggttggttaatgtaatgtaatcacattagcagacaacaggaaaatagtctttcagtggtaattatgtaaaactatgactgtataactaagagaatagataatgagtatttcctggaaatggctcttacctgactccactagagtgacaatgtgatcttcccaagtagagacaacagcggatgctaatgggtgagctcgtcggtaatggcctcttgctgagatgaggaaaaagctgcatttttatcctagtggataccccactcctttgtgagtcagccctatcctgagtaaatggatctggctctttcatagcaactgccagttagttcttcccaatcttgtgttattcataaaaatgttttcatagaaaggcatgtaaatacatgggcgaccagaacttcattgtaggcagaaaataaaataaaccttgaatgtctttatcttacgcacttatacccatactataaacaaaaaagaaaaattaactcatgagaaatccatgcctttcgtgcatctattaaatttcagcataaaaaatgtctgcaaccccgcatcattcactgggcttcaaatttagtaacccaactactgactccgaaacatgcaaattacaatgcaaaggctgaactttttactacaataaaagtgaaattttgtaaatgctgcaggaactgcattggccaattttcaacagatatgtattccatttttctttactactttactctccagtgacaaaataacaaaagaaagaccttgttaagatatctttccatctccatggttctatctttcccagaatgccatatagttagaatcatacagtatgtagacttttcagactgacttcttttactcagtaacaggcatttatgtttacaccatgtctttccatgatgatatctaatttcctttccatgctgaataattattccactgtctggatgtaccacagtttgcttatccattctcctactgaaggacatcttggttgcttccaagttttggcaattaggaataaagctgccatcaacatcaatgcatgtctatggagacacatatctatgtatttctatgtgcatttctatgtctgtggaaacagtaaaaagatcattggttgccagggtttgtggggagggaggaatgaataggtggagcacagaggatttttagagcactcaaattactctgtatgatgttataatgatagatacacatcatcacatatttgttcaaacccatagactatagtactctaggagtgaaccctagtgtcagctacagacttggcgtgatagtgatgtgtcagtgtaggttcatcaattgtaacaaatgtaccactctgatggggatgttgatagttggggagactgtgcctgtgtgggggcagaaggtacatgggaaatctctgtacctttgctccattttgccgcaaacctaaaactgctcaaaaaatagtctattaaaaaaaacttcccacatctgtttggtaaaactcaatagtagcccttctaatccataacactattataatcacttttgggcttaactaaaaacaatctataaatcatatgctatctcaataaaatataacatattttgattaccgcaaatcaggtactatctaaaaatgtgattagaatatattatttttgttttagttatattttgccacttttaaatctttactattttatgttttatgcaaaaacatatatctacacatcttgtctccttagtttatggttgtctgaatacagttaattttcatctatctacttagcttatttccaaatagtctttcaactaacttatcagagtttttaagtgtcaggaaaatcttaagaaaaagccaacaataaccaggcagacttcatagaattgcaaagataaatatttatgacattcattctcatactctattttcttaaaacttggggttattcataccaaatgctaagaaaaaaattgctgctatctcaggggttggcacaaaccctaggctgcaagggtctctgtcgtttctttctctcatctgtagggtcagtccagcaccttccctttccactgaggagctgagctcaaaggtccaggggacgctgtaaggtactcaggccctcccagcagtgtacagggtgtcttgctagttctgcccagaatgcggagctgcagagaaataatatgaccttatccaaagttgctgaatagctggctaacctatggaacaataattataaaaggagaactttccaaatgggaaaaagcaaatggtgtgaaatgcctggcatgtgagacactacagagatatttctcgaatgaatgcgtgaattcttaggggcactttctttcaggaaaaaaaatccagctaatgtcatttacataattgcagattaataaatacatagtgattatatatatatgtaagtagtatataagttgtatttatagtcattaaatgattcttttaaaatgataagagaaaaactatctctatgtattttattaaatccgtttaatttttttctgtagtaagtagcactaaactaaagactattccttaagacttaaacagttattaatataagtgcatggcaaagaaagttacgttataaaaccaaatgtcagaatgcaaacatcatacgagactgagcattcgaaaggttataaatatattgtcctcactaaggaggtactcatggcaaaccacacaaggatggaactttctaaactaatgtaaaatgtttaattgttttattttaacatttctctattcattcagccttgcaggaacgataatgcattttttgctcgatttcagggctttgaattagaggaaatctcaacaaaggtagtgatgcttttgaaagtacattgctatttgttttttatttcgcctgatgagagaaaaggtcactgccttttgaaaagaagctttatttagtggagctgaacgatacagtctaagtcagaacaacaataaatttaatagcaatcctggattttataattcaggtagtggaacatcctcttcggataactcttaaaaaacaacaactcagatgcctgtttgtgccaagtgaatcatctgcattttagcatgggccagtagcctcaagttctgtaaaaatggcccacttttttttttctcatcaaagagttctcaaatatatcaaaaaattcatttatatttctcaaaacatcaattaattttcaaaagtacaagaacatgaattaaagatgattatacatagaaatgggtgattctacctgtgagttacatacctcaggctctagggcccttcctctctgaaagacttcttcctctgtgggctggaatttcctgttcatagtaatgtatataacatactttctgctagaataatgtggatcctgtttcaaatggaagatggatatttggaaatgtgggtcccccctgagaactaagacccctggcagctctccagcttaatttccagggctgagagctgagcctctgcgtcaatatgacttgacttgtccaggaaggtaaagctgttaaacagtcagcaacttcaccgttgatttcaggcacttcccacaaattcatttatctgaactatagactgctgggccaacccctttctccagacagtaggtcactcaactggtcaagctagtcacctacaaatagttggtattcattaggattttttgtgaagactctacccaatggggatcaatgccaaacttaaaaaaaaaaaaaaaccactataaaagtcagttgtatttgtttgttaaaggtaatacatgtgtctggttaaaaatctgaaaggcacaaaagaaaaaataaatttcatgtgtgaagaggacaacataaggtcaccatttatttttcttctcttagatcacccaagtcaagaaggagaatgaaaatagaagggcaaactcgctgtaaagaatggattactcaaatgttgaaccaaagccgggggaaagaacatggaaagcagtggagaggcaccaggcaggtcgctttctctttctggtcctcaaccacagcactgccgtcttcagaacagtaactattacttgtccataccaggcatcttcaatactcctcaactcatatcaagaattctgcccagtctaaacagacctccatcctacaaacactgaaacccaaacccaaaaccttacatatatccacctctcacttatcccttctgagacattatgaaaacaaagtggcagtttcccttactggaataagtattaaattttgcttggtcaatagattattcagacaatctttttaaggtagataagaaaactgagggtcagattagtgaggtgttcaatgttacagagaagcagagcctgatcccagccaggggggatttaacaccaagtccagtatcctacattagatcttcaggggccctgaagatcgcctcctcctagctcccatggaatagacaagagagctgagaattgaaattaattgtctgtttacacagccaggcctccagaaaccttaagtcaaggggttgctttattttttcccaaatacttgttattttttggaaagttatctcaagacgctaatatttcataaaaacttcctattcttatatcactctggatttaaggtttttgtgatttatctctatctgcacacaaattaggacgaatgccaacctgtgatatttgccggaatgatccagctcaggtctctttttcaagcctccctatactgctgttacttacctccctggcgaggaacctcttggataagactaaagacaataattctatgaaattaaaaacacctagaaagttaagaggaatagaacactaaaacggcagtctcttccagatttcttttatttatatcaagatagacccatctattaaaagacagaatctgcatcctctttgtcttaaaagccctttcattttttaaaagccttctttcaaaatgcaaatggtcctgggagaccccactgctaagttatccaggaaccttggcagagtttaatcgacagcaaggttggagcctaggagagcggagtccctagaggcagtaaaaagacactgaaaaagtggtggagagctttttctccttcccaattttgtggaaggttattcgaatcaattgtcctgaggttactgcaaatgttttccttttttttttttttaaaaaaaattctttttctccctctttttttccttttagctgttattgttccttgaaaaacagtataaaacaatacaaacactcattgacatggacccaatctattcttgactttttaactgatggatcacattataatgcaggtatggtatcattgccattactattactacgattagtggtgaaaagataagtattcccaaaatatcagtttgattttttgcacttgcccttaattcatgcagaaactagcatagaagcaatgaagaaaccattcgcacagaagaaaaaacaaaatggctttctaagatcaaatttgtattttaaaaaattctaaggttttttattttttcaaattatggctttttatttcctgagtttcaaaaggtgatatagctcaggtagttttaaggtgctgcctctcattctgtagtatgctgggctgcagtaaaatattatttattggctgtgggtatcccctaaactacaccattgttaggcaagttagaggtgtctatattccctgatagtcttaaaaatattgctcatgtacattatataattgaaaaaacaaaaacacttctgtatatttaaaaatcagcaactatatccctcttgcaccacgttaaatagaagaatgtaatttctagcattattgtgtttgtgcttgaaaataattttaagaaaatattggagactcttcgccatccaatctattcaattttatgacattgggcacttattaaatcagttttcattgttgaaccaatcagctgaatctgtcagaaaaagtctggctttatttttcaattcaaataacatgtaaccacatgcccttgtgacaatcatgttatttctaaggcctaatctaaggtggatagctttgggaaggaagttatccataaaactgtcacctggataaataataaggcacggccccatgggaccctctttttggagaaatccaggtgggaacggtccttttgcttggcaacccagaggattttacatcccagattaatacacgccatagtttccggatgagtgagagtttcacctttcttttgtaaactgagagaggggtaaataaggacaggagggtgaaaaaggtaaagtgatagatcagttttaaggaagagttcctagggaagtgaggtctggaaatctcttccttgccagtatctgtttctgcatctgccttggaaagtctctgggaacccattcacacagagggcccattcacactgcaaggcagtggctctggacaggtgagtaaggtccctgtagttcctgacttggcaggcagatactcgatgcagactgagaattatgatgtccttgtaggtagtttctggcttgagggtgaatttctctttttagtgagtggatcagccttgctgtaggaccctaccatgaacctgtctgatgtaggtgcagctggaatcatgatcctgatgtaacatgtgtggttcaaggccagcctcactgcatgatctgatggtaataccaggatggagttaccagccagtcgggagtaagcctaagttggggcgcaggttgtctatttcaatgagaccttgtctgtttatctcatcacattttgtggtgataatatacaagccctagaaatgcttattttcatcctatgacagctactccaacacatacttaactctatgcatgaacgtcagccaatattgagagaaatactgtcttgatgagttaggaaattttttttgcacacaaattttaggtagtattataaagtaagaatagttttaaagatcatatatactaagctttattttctcacacagtcttccaagttatagtaatatgcattctggagagaatgcattaatgtctattcctagtaataaatctagtagaagggagctagaactccttatcactcaccgcaggtttgcagggggcttcctggcatgaatctgtccactcgccttgcgagcgatcctacctccagctcccaatcttgagttgtgtcatctacatatgtctatgtaatatatgtaccaataaatgatattctaaatgcctatgtgtttttatactcatcatgttactccataatataacatatagtcttataaaacactcaagtcggttgcttagttttcctccttgatacttcatttcagcgcatcttctagaaagtagcattaaaagcatatgttttcataggcattctaagattggtatactttttattatttccggatttttaataaatgtgctcttaatagtgtaatgaactataatgaaaaagtttacccttttaccatttatcctttagattgcaatttctcctttacatatcacaaaagatataaaactgttaaaaataacagtaagttattttcaccttttggtcaatgtttatacttatcatttatgtttaaatacttgaaagaaaggcctactgagctactaaaatttttttttagaaatgacatcaatatgtcttttacattgtttataagtacatagatactcaaagctactttctggcagaaagtatatgctgatgcccagaacattaattcatttttcaaaaagctatttttcgattaatataatcccacttgtgtttaaatatgtgtcaacattaattggtgttaccttaagattttagtgactgcggtctccttttccagaaggttccttgccctgatgctgaaaacagacttgcgaagctgaaaatgataagagtatgacttttagttttggaatgttaagaaataatatactgtcaaatcattcaatagatgacattgttaaaacatgaaacatgaatatgtttcgctaaagcatcatcgtacaattgacaattcttgtctatttttacttttatttgggcagcaccatgaacaaacttgtggggccccacgtcccagccacggatggtgcattggctgtgcctcactctgataatggccttcgtctgaataaaattttcagtttccaaagactttaacgttgaccctcatactggactccttatttgtctttgattagcgcaatgttctctaatccacattatgtctgctgcaggttcttggcctgtaacctaacactaatctgaacaatgagtttaggagttgttttgcttgcaggtgtggggaatgaatgaaatgggcattcaagatctcttcctagttggcgatgataaaattactccagagaagagaactaaggagaaaaccatcctggatgctgactgtaaattcaaagatatactccccaagctcagttctgtgtggcttgctagttgcagattttagattggtggaaggtgtacaaggagttaaagcaggcagaagaagggcaaagagaaaacaggcaaatgggccactatgttctcataataataaataaataactagattcacaataataaataactagaataaataataaataacaggaaagtgtaactccagtagtcagactgaagatagtaattgagacctgttcattttgatcaatagattagatttactgagcacttagcatgatattagtgaccataggagatttagggtaaatagaatttggagttcttggtttctagaagtgaatagcctagataggaagacaagggtaggacacatgagatcatcagtgacaagtacagtgcagtagatggcacagtgctagatgatacgtaaaggagaaaacacaagatcagaggggctggagctctctgcggtggaacagcaagtctggactagtcggcaaaggcttcaatgaaaaagtggaggttatactgggccttgaaggaaggctaagattcctagaggcaaaggcggtactgggtgaaggactgaagtggacatgtgtgcacagggcaagttaatttggtacaaactacctgtataagtgctgtgctagccagatcttgaaaccaggcaagaagccctacagggcatactgtgtgtcaaacaaagttgaggggggaaagaaaaccctcagaagacagaaaactctgtattcagtaaaaatagatcacctagttagtttcttttcaacaagggttaggtatgttgaggtacaaactcacagcaccccattctacaaacaaagctatgaacaaatgctataatgtcagtcagtgtgtccataaagccatagtggagaagaaccagagtaacaaacaggtctttttagtcacaaatgataacctagataacatcaaaactagcaatccacttttcatattttacagcagatatgtagtaaagatcagcatcactgaacatactggtgatttccccctcatgaggaaaggtggtttgttcatttttctgctcaaaaatgaaaaaccggaattggtttcattattcactagaactcttaggagaaaaattaatgtatggacaaggagacaagagtggataccaactatttggaacttccattttcttggtagcacatacatgctatttccaatgataaatcttgaaactttcctacttctcccctcctgaaagagttgacttttggcataattttttttttttttttaagatagtcttgctctgccatccaggctggagtgcagtggcgtaatctcagctcaccgcaacttccacctcctgggttcaagcgattctcctgcctcagccacccgagtagctgggactacaggtgcccgccaccatgcccgactgatttttgtatttttagtagagatggggtttcaccatattggccaggctggtcttgaactcctgaccttgtgatccacctgcctcagcctcccaaagtgctgagattacaggcatgagccaccacacccggccaaaagttgacttttgacatggatttaacctctcttgagttgacagctcagctcctaaggaaagctgcttggagccgcttttggagatggaagactcagctggtggccccatcatcgtggagcatctgctctttagacacctaagaacacacatagtcctgagacagacccaggcacagaggtcctgtgacagtgagttttaagagaggactccagattccacaactcttatttcatcttgaaaggacaatgacatgtgttagttgtctttccttcagtggaagatgagagtctgaatccaatcacttatctactgcccctgcaatttcacgttaggaaaaacttttgggataatatctggtacactattgcctaaatgatttctgccctgcacaagattgctaaaaggctactgaatggcctttgtcctgaatttgaactaagacaaaatacagtattaattcatacaggagagtacttgagaactgtttttataactaatgccagaggtagcaggagaatcaatattataatagaaaaacatcagatttagctttgggatgttcttttgttttgttttgttttttgagaaagagtctcactctgttgcccaggttggagggcagtggtgtgatcccggctcactgcaacctccgccccctgggttcaagcaatactcctgcctcagcctccctagtagctgggattacaggcatgcactaccacaccggctaatttttgtatttttagtagagacgaggtttcaccatgttggccaggctggcctcaaactcctgacctcaagtgatccaccgaccttggcctcccaaagtgctgggattacaggtgtgagcctccacacctggcctttgggatgttcttaaaagaaggaaaggactcacacacacatatatatgtcttctttcatctacttatacatatatatatgatattacatttgatgtcctagatatgtatttagatcgttatatactttcttttttctactaaataaagaaggcctatagtgattatctagttattcccttcttttttcttacttctatagtaaagctttgcgaattttttttggcaaagggcattcctagactgtgctaaacataaagagctcagagctacactgctctgcagtgccctcttctggctctagaagatactgacaatcacctgaaataattagcaaaacaaagaatacagagatccatttcatgatgagtaatttcagatctgaaattgtaaattacagctatgaaaggagccagtaattgctcattctggatgtaaacatatcagagatgtgggaataaaaaggaaggggatgaatgatggaattacaaggagtttactttgaaaaaagtcaaagattcgttgaagaagattttcttcggttttgtttggaaactgaaaacatccaactgcctcagataacaattctttgacagaattaataactcaaaacaagtaaattaaatttaaattatcaacaatatagagatattttaagtcttgaacttctaagttaaaacacgtttccagaattacatactttaacacataattcaaaagcttcaactcaattcccatagagttatttgtgattgaataatttggacctgaaagacattccaatgtatgaatcttgctgattttttggcgatgtcttctaattaatctacatgttacccttttttccccttaaaatagagaaacctgggccatttgacctatagtttttgagtctggatttttttttttctttttttgacagggtttcgttctgtcacccaggctggagtgcatgcagtggaattatcatgactcactgcagtcttgacctcctgggctgaatcgatcctcctgtctcagccttctgagtagctgggactacaggcgtgtgccatcacatatagctaagtaacatttttttttttttaagagatggggtttcttcatgttgcacaggctggtcttgaaatgcctgggctcaagtgatcctcctgccgtggcctcccaatatgctgggattgtaggagtaagccaccgcacccagccaagagagagtctggattttgctgaaagcacactcttggtacagttcaacacgttcttctgtcttctattttctgaaaatcggcagctggatccagaggtttcatcatacagactctggtttcatccctttggcaaggccataggtggtgtcagattcttccatcgaaaggaacagagtgtgtgtgtttctttttgtgatgttacgggtcttgatgttcatttcttagatcccttgacttcattccgtttgcaaaactgtcatttctttttcatttattagttgggatagttttataatgaggtgctttccctcctgtattatttggttacccagtagcaaaactggtatggaaaagccaagataaatgcttgattatcgacttttacttattaattttacatggttgattttctatcatcgctcaaggtaaccaattactatttaaaaaatgtcattatgaactcaagatttaaacttatttaatgtttaatggatttcagtccatgtcaattaccatttcttactgttagtcaaattatctctactgtgctcattgggagtttttcaagttggtcagtctgtaggttctttttatatgaccctcgtagtctttgacaaagcttccttgttcctagtatgacaagatgctccaaggtcagcttgtacacttcctattcaaaatcaaccattttcttcaagaagccctggtttacttattggaaaattggaaaaatggtgtttcaagaacatatctagagcccatagatgctcactgctatggagttggtcactgtttcaaatattttgcctgggtttattctgatgttttcaatttaaattcatgacccaggattttttttttttttttttagttatactttaagttctggggtacatgagcagaacgtgcaggtttgttacgtaggtatgcatgtcccacagtggttggctgcacccatcaacccgtcatctacattaggtatttctcctaatgctatccctccccttgccccccaccccgatagcacccagtgtgtgatgttcccctccctgtgcccatatgttctcattgttcaattcctacttatgactgagaacatgctgtgtttggttttctgttcctgtgttagtttgctgagaatgatggtttccagcttcatccgtgtccctgcaaaggacatgagctcattcttttatatggctgcatagtattccatggtgtatacgtgccacgttttctttaggatttttatttttacctaagcttttctatatgatatctatatctccttttttctccacaaagagcactcttgattatcaagagcaccagggatgccagaattagattgtctcaacagtgactcagttttatttcacatttcatagacaatagtctcagaatgaaaatacacaaccaagaaaactactgaatatcttaagggtttgcatatcttcttcccgttcacctcctcatttgtatatctgtactctatccatattagaacaaataattattacatatttcactcttcatgttgtccttatgtagttagttgttacatatgaatgtgaatttttatgccaaatggtttaagagtcccttttggagttcatttaggttatctgaggcatgttttttagtagattacaggttcattgaaacaagattacttgtatcttacattactcatattcttagatcttgaaagcagtttctctgaccttgaaagttgaaagtcagttttcaggatggaaaaaaatctggctcagatattctttgcctgggcatcctatatatgttactctattttcttctgacataaagcattgctgctgaaaaatctcatgataatctaacgttctttcctttataaatcacttgttcttatttgggctagataatatatttttaaaaaatttaaagacctgtcatttgtctggtgtatgtattgtttttaatcatttactccaatatttttaggtgtgtgctgtcaatatatagtttcatatctttttatgtttcagaaaagtttagtatacgttttattctcttgctgtggtttttcttccttagggacacctataatgcagatgtcggatttttgactttcttcaatttgtcatttttcttgcaaatcattttcatctctttcttcatttctctttgattttaaaaaatgccctcttctccattttctatttctcacttttgaatcatctgaggtctctttatgttccttctcgtttagttttcattgctttaatttataacttttctcagttctggcacctcatttctgagtttttctaacttttatttatgttgctatttcatccttatgtaatttttaatgtcttttaactaatttttcaatagtatgctacagtttgagctggttagagcacgtttttgtaggttgctttccttgtctacagtgagagacagtattctgctgtttttttcttataataacgtttgcagggaatttggctttgataattttccttactcatttttatacaaaattagttttcccaaacagtttagtatttctcttctaacttcagagtttcctcttctgttgttttaatatatcgatcaaatatggtagctttctttctggaatttccaagctctgtttcccaatcctcctccccccacaaattttgtctggatctgcttttatccttatcactcttgttcctggcctgttcaattttgattccactcctggactttttatttcagaatggagcaaagaagatgttctaccattccatgaacattggacgctctgtaactaagcttggtttcctcccacagacactaatatcatgcaaatcatgtggctgtttgtcaacacttgcttttatttagggtttgtggattaccgagttttatggtaaatattaactatggatttggggttttgatatcttggtattctttttgttttcatgtgggaattcaaggttaaaaaacaatgtcaatgcctctgtcatctttatagaagaaggctccttaattttttcttgttgaattttaaagtagatttatcaattttattactgcttccaaagaacaaaatttcaattatgttgatattatttatcacctctttccccccatttgattaataactgcttttctctttattatttctttctttctgctatcttagtgtttccttggttgataatttttctaaattcttgaaatgaatgcttggaggattaatttaagcctttatttctttactagatattcattcagggctaaattttttcctctaaaaatgccattagctacttcccacaagtttgatgcatcttttgttcattattttttaattgtagatattttcttattttcattggtgtttcttctgtgcttatttgaaaatagttttaaatttctgaatgtgtaggtttttttgtggttattttcttcttattaggtttctgattttgttacattttggtcaaataatatcttttctaggacactgatgtgtatatatttagaagtctgtggtaaatggttacatttaaaatcatacatgtgttcttgaattagaatgttattctctagtcattgaatgaagaattttatagatgcccattgcacatttaaaaatgtacattttataacttctacatctgtatttcttggctccttgatctgtgctgaggtgatatatacatattttaaacttaatcttcaaactaatcctcataggtaggtaaggtattattatctcttttttccagattaaagatctaaggctcataaaaattaagttgtctaagttcactcagataataaattgcaaaattattactagaactctggatcatgcagcttcagtgttcaaatcttttcactgcattatgtctatgtaaaatgtcactaggcttagtataaaaaagcattttctaaactatatcataacaaaatattatctgcttgacttgaaatattttgtttacacatattataaactcttgctattctcacatcctaatgcaaaatcgaaactaaccaactttttgtttgttctacatatgcataattgattttcagaataatgactctgaagcactgaaagagatcaatacatttcctaactcattaaagctagtatgatcatagtttttatattttacacttactgattccttaaaatctgggatccatcaaaactctcaatcaatcagaatattaatttgattaattcaatcacccagaagtaaccacagacctatcttgaatatagattcctttaggatgcggcaatgcttagacctaaagaaccatagcttgaccctagaaaccaccttcagaatgaagccatcaatatttatttgacaaagcacaccacaagtattataaatattcaatagcttttttgatttacaatgttaacaatacatttctgtttctaactgggaaaaagtttgagtggctccatttttcttttctcactttacaaatattaacaggttaataataaatgggaaagtggttataaaaacatatgaccataagacacaaaaccacggtccaatgaatatggcttgatgaatgtcatttctgctagaaagttgtagtgtaattattgtaacgagccactttattgaataagtctcccaaataaaatatagtaattgggaataagcaattacttaaaattgcatgggtcgaaggtggtatctcatttgactgtatttgaattttcatgcacccgtgaattcataattaatcccaaagtgcatacgacagatcatgtgtgtggcaagatgtttctataaaataaactttctctggaattgacattatgcttagaaaaaaaattttaaaaggtgattaatgtgagcatcagcaagattaaaatgttgattatggatgtatataaaggtgaataccattataatatcatgttatgaagctttgaacagtatcttaaaatgtgaattttgtgaagagaattttagatgatgggtcaagatttcttattgtaggccaggtgcggtggctcacgcctgtaatcccagcactttgggaggccgaggtgggtggatcacgaggtcaggagatcgagaccatcctggctaacatggtgaaaccccgtctctactaaaaaatagaaaaaataagccgggcatggtggcgggcgcctgtagtcccagctgctcgggaggctgaggcaggagaatggcgtgaacctgggaggcagagcttgcagtgagctgagatcgcgccactgcactccagcatgggccacagagcgagactctgtctcaaaaaaacaaacaaacaaaaaaaaagatttcctattgtaacttatttcaatatcatgtgttctgaaccctgtaaaaacactatgtgtaggagttaaaatattcatataaacatgcatgtgcacgtgtgtgcatgccatgcatacaccaaatcttcgctcttcctttggactcctaggcacccagcacaagttgatccctgccctgtgtgaaacatctttttatctttctgtaaattccaatagattgtaaactccttaggatatgtataatgtattctttgtttattacattttctttcattgtctagcactgtgcattgttggtgcttgaaatatatttgaaaattgaattaatttcataatattaaagtattactttttctatcttatatattttaatgtagttagtccttgaaaataagaaatatgaatgacgtaaaaattacaaagagggactgcttattttgaaatgaatcaactaacttgatatataggaacagcttgtaatattagaaactaaacaatttaaaacttaatggatctgatttttttttgcacgtgaatgttatgacaatgtttcggccactaacacagtagcctggggtcacttggtcaaatctccaacatcttacacatcaaataatgaaactgtgcaaaaatcgagggaaaagcaatatcttcgagtactgaaacaaatttagataggtttaatatacagtacttaatgataagaaactataaatgcccgggtgcggagactcacgcctgtagtcccagcactttgggaggccgaggcgggtggatcacgaggtcaggaaatcgagaccatcctggctaacacggtgaaaccctgtctctactaaaaatacaaaaaaattagccgggcgtggttgcgggcgcctgtagtcccagctactcaggaggctgaggcaggagaatggcgtgaacccgggaggcggagcttgcagtgagccgagatcgtgccgctgcaccccaggctgggtgacagagcgagactccgtctcaaacaaacaaacaaacaaaactataaatatacgctagatagattttaattacaaaagtaaaatacaaaatgactttatgattatatctaatataaacaggaaggcaaagattggaaatctgcagagacaaaagaaggtgagtgggcttgtgattctagagtaaatgtcagatgcttttaacctgtttgtgaatttagaaattccaaaatttttttttgttttgagacggagtctcgctgtatcgcccaagctggagtgcagtggcatgatcttggctcactgcaacctccgccccctgggctcaagcaattctcatgcctcagcctcccgagtagctgggactatagttgtgtgccaccatgctcagctacttttttttagtagagatggggtttcaccatgttgcccaggatggtctcgaactcctgagctcaggtgatccgccagccttggcctcccaaagtgctgggattatgggtgtagaaattcgaaatttaaggtctgtggcaacacaaggaagcaggacttggactcaacaccatcatcagcaacaaatacaacacactgagactagcatgacacttgatagaagagacaatttataagtaaaactgtagtcagaagaggaaaaagtttaaaaagaagagcaaaatgtaaatttccaagatagatttagcagcggccttaactccttgatacctcttttgtgcatgatacagaaaatgcgattaaaaatcttttaaattacctataaaaaattcttaatcctagactgatttacttttgactctcaatgcgcatttactaaggaatacaaacagctgatacatagttccaacctaaaaatggttacacaattaaatattctgcaaaaataatcattgagagggaattcctactctaatgttagttgaatatagaaagatgtgtttgtttactcagggcccagcaaactgtttgcatataatggtcctcaaaaatgattgttggatgaaagggtgagtgctcacacacacagatatttggttttagcttgagaatttactgcaaagaccagtaagaagaaaaaatggtttgattttatagtacgcatcgttttatttatttatttatttatttatatattatactttaggttctagggtgcatgtgcacaacgtgcaggtttgttacataggtatgcatgtgccatgtttgtgtgctgcacccattaactcatcatttacattaggtatatctcctaatactatccctcccccctccccctgccccatgacaggtcccagtgtgtgatgttccccttcctgtgtccaagtgttctcattgttcagttcccacctatgagtgagaacatgcagtatttggttttttgtccttgtgatagtttgctgagaatgatggtttccagcttcatccacgtccctacaaaggacatgaactcatccttttttatgactgcatagtattccatggtgtatatgtgccacattttcttaatccagtctatcattgatggacatttgggttggttccaggtctttgctattgtgaacagtgctgcaataaacatacatgtgcatgtgtctttatagcagcatgatttataatcctttgggcatgtacccagtaatgggatggctgggtcaaatgtatttctagttctagatccttgaggaatagcacgctgtcttccacaatggttgaactagtttacggtcccaccaacagtgtaaaagtgttcctatttctccacatcctctccagcacctgttgtttcctgactttttaatgatcgccattctaactggtgtgagatggtatctcattgtggctttgatttgcatttctctgatggccagtgatgatgaaatcttacgcatctttttatttctttccattattgtgactaaattgggaatccattatctactaaagcatttttaagctagagagaagtgtacagagttttcatatttgacatgaggaacaccaattcttccctttgagatacaacccatggttacatggtagcatcatgtcatctgtcactcttttcctggagatacatcttgaatggtactgcagagaagctaagccattatttaaaaaaaaaattctttcaaaagaccaaaagccctaaaaatgaaaacaggctgtgttcgttcgttcatttgttcattctctctctctctctctctcttttaaggtgaacaaacattcattcatcctggaaattatagatcaggctgagtaacttgctatgtgaggagttacaagaacaaattatcaagcactctataatcatatagaacattataaaatgctgtatggcaataaaaaaaacggaagagtaaatcttaccagaatgacctaatttacttcttcagattcgaagacaccgtgtagacaatagggatagcaactaaaatatcaacaaaaatcaaactctaaaaaaatcagacttaggtaccataaggaaattgatcagtaattaatatattgcactcaactagactgttacatctgaaggttaaatttatgtaaaagtcttttgtcctaactgatgaatagaaatctgtttgctgagtctgacttcatggtacagtttagtaacagtaacctttcttgtctggtttgagaggcacagaacatatgctagcccaggtgcaatgctaggtatttaacattattacattatttgattctcacaacaaaccttgaaaatgagaattatctccactttactgatgagggttggaacctgcaccacttaatcactcttctacccaatttctctcaaacatcgagcacctgatgctttgcatacctttgcatatatgtccccctctgcctggggtgctttcttcctttatcaatcaatcacacttcttctgtaaggggaacttagggggttctgtctcatggttccagtaatactttttactttcatgcatgtatgtgcatttcctcccattggactatgagcttctaaagggtacagttcgcatcttgctcactgttgaattcccacagcccagagaatagcagatgaataacgggtgctctataagtgcttgttgaatgactgaatgaatgttaatgagttataaaataaaatgggtaaacaaaacatagtcattccaatgatcattttcctctttactgtacataagttagctgttcattgtgaaggcttattaaagaactatcatatgcttcagcagaaaggaggctgacaagagggtgggcagatattgccctactgtcagagaaaatattcactgttcattattatgtgggctctgattctatgctgggaagtacaggggcacgaggtggaggtgctgggacagccctcatcctagcatggctccaggaggttcactcatgcttcccaggctattgcaggttctgacataagaaatggtgcatcagccaagacagcagcacagaaccatcctcaggccacagggcagtgagacgctgtagactcaaccacaggtgagaccttgaccttgactggatgtctcacttcggagaacagagcgggctgcttttattacagggttactggaaagtcaagttcagatctcactttattaatcaccactctgcttaaggaaactagagtttaatttcaataatatggaggaaaaatacaagtagaaattgttgcttgatttctttctgcttggaaactggaaaagcccctgtcaaaatccttgaatcaggaagaaaaggaacctctcacaattgctcacaggaacggtaggtagcaggataaagggatggggaaatgaccacttgggaaggtcgtttctatggagtctcaaacgacaggcaggaaaacactctttcctgtcttttccttttaggatctgggtcagccccaagattttaaagatttttgtttgctggttgttttctgggagaaggacaggtattttaaactgtataataaaggtgatccaccagggctatttttaaaaacatggtttctgcaaagtgaggttgccatgggaattactcatccctgttcaaagcttgggtaattactgggagaaaatcttgcctaatgtgcttttgtgttttctgcaatgcttcatcaaaccccagcccccttctggggttgctgtcagttgttgtttttttctccctgaacttgcagtcttcaggcacctggggcttcactattttccctggaaagagaaaggtgattccctctagcatagtgaagtcagaagtttctcctggtacaagataaccattaagagaacagttttattttattgttcctttgttcatgttatgagaatcaccgataaaccagcctctaatgtcctttttctttcataccagtcactgaggaaacacagcctcaatttgcacaatttgcagagggctgggtggtttttttttttcacgtagagtgaagaaccctgcctgtcactttactgtgactaggatttccaaaggcaattgggattttaatggaaatttctaagtgctcgctgaaaaatactttataaggggaactaatggtggtagggtctgtgacggggatttttgttctgtgtttatgcgctcttgtttttaagtggctttcgggtttcttaataaaaatgaaaaaggcttgccgtattcataatacaaatgccagaatgctgtctccgcaatttgtgcttccattaaatccttatcactgaaatcctttgaagagggattttctgctttagatttccctggcccaggggcactcaacaaggttgacaaatcctaaggtcttatgaggaacaccaagaactggtgggaactattgctgaaaatggtggatcctgaaaagaattaagtctacttttctgacaacctagatcgaatcaaagctttaagaaagcgtggatagtaacaggagcagttgtcttgccactcccataatagggtcctctgatgaagaaaaagtatgtttttgacattccactttccaagtgggagcaataagacatgttgtatgggataaaacgtgttattccaactgtacctggggagggttcgcttcgggcgggcgcacagaggggcgggccacattctctttagactcctcctcagcccggcacatgcctctcaagactctttttatctttgtcctcaccaaatcaaaatactgtgttcaggaaatgtgagaaacaatcacatttccttttagagagaaaataaactcatatttcaattttgtgtttccagtggggtagtgttaccagtgatttttaaaagcatgtcatggttttgtgactttggccataatggaaatcagctctctatcctcttcctggagataagtggtcacaaggacagcccagacttctggcttacaatctgctttggaaacaaaacaaaacaaaacaacctgctttctagtccacgcaaactgcaatttcagactgactggctgaagccaaggcactatcttcccacttgtttatccactgacatatgaccttctgcttccatgccccatgcacagtgttgagtggattataactgtgaagaagagaggtgataagtttaatttaaaaaaatcaaaaaagccaggcatggtggccatgcctatagtcccggctactcgggaggctgaggcaggaggatcacttgagctcaggagttcaaggctatagtgcactatggccgtgcctgtgaatagccactgcaccccagcctgggcaacacagcaagatctcatctctaaaaaaataaaaataaaagataaaagtaaagcctctaaggacagctaagggtaatatgcaagcctttaaggatagttaagggtcatatgtccatatcataatttttcacgagaaatttagaagcaaaggatgacctcagttgaaatctaattagtgtcctggaagaccaagcacagaacaaaaatagagagatggcaatcccaggggagagagaagcagatggaagagtaacaattgaacgcaaaataaatggaaatttccctgagcaaatatcttagttggcaagctgaaaagactctagttggagcagttctgatgaaaaaagacatataaggtatattctaagaaagcttctgaactccaaggatacacagaaaatcttacaagttttcctgaagaaacaagcaaaccaagtctaccaaccaaaaggctaattacttaaaaaaaaaatgacattggcatcagacttgtcatttacaatcttggattctgcaaagatagtagaatagcatctctagatggctgaaggaaaatcaacacatggaaatccttgaaaaagaagagacatcctgcaaagaaaatcatcatcattttcagcaagagcaacatgactgaactacagcagagaacctgggagctgggggagaggtaaacgggagtagtatcacattaggggaggggaggtgagaaagaggaggagaaaagggggaggtgaaaaaggaggaaaaaggggaggcaagaaagaggagaaaaaggggaggcgagataaagagaaaggtgagggaattccaaagggttcatccctgtgggaagggaaagaaagcggagagaaagaagatcctggaggatgaaacagttggcattttattgtcacatgatcatagagaaatatggatttcactataagcaaaagaaaaagggcagtaacaatgtaaaggaataaaaaacactctaggaatgccaaagtggaatacttgcaagtgaactagatgtttttgcaaactctactgtttaatctctttaatattaaaggacaattattaatctttcattttctaactgaactgacattgattatgtgaccaagctgatatatatagtttgatactatgcatacatatatacacacatatacatttatatgtctatgtgtgtatatataaatatgtttacttattatacctagataatacattctatgtctttttttttttttttttttttgagatggagtctcactctgttgcccaggctggagtacagtggcacaatctcagctcactgcaacctctgcctcctaggttcgagtgattctcctgcctcagcctcccgagtagctgggattacaggcatccaccaccacgcccagctgacttttgtatttttagtagagatggggttacaccatgttggccaagctggtctcgaacttctgacctcaagtgatccacccgcctcggcctcccaaagtgctgggattacaggggtgagccatggcacacagcccttatattattttttttaaaagtgaataaatgaaaaagtacatttctttaaaattattacctaaatttgctttatttatatgtggttccctactgatactttgctgtggaatctgaaaaaaattttcccttctacttttcaaatgataaagaaataggtaaactagaacatgaataagctcttgcacctaagttcctgccacatactaagcattgaataaatggcaattctttcgaccgattttagagaaacatgctctcgtatcctctctgatgtaataagtagacataagcagttgtacttgcaggagatggcaggtcattacacctggactgagccttggagatcccagccctttattccgcacctgagaaaatgcagatttgggaggctcttgatgtttacaaagtcgcatggctgccacgtggcgcagctcaaaagcttacacgggcaaatgcaaaatttcaatgcatagagtaaaaaatgttaggtttcatgatatcttttacaaatgaaatcattttattttcattattctcttgagaaattggattccaggaccctaaagaactctgcggttcttttctcaaacatagatgctttttagaagcctggttattcgaaacagcagatcttactttttggtcgatgtatttgttgtcctcaattgctgagcgtttggagtggtcgcaggaggaggaagaggtggtcgggaggcttctcaggaggcaacatgtgtcctgttgctggcggtcaataaactgcttcataaaactctccctttgcaaatgaagtatatgtgcatcaggcattattagtggaagggagcaagtgacagcattttgcaatgatgagtttgcttgagcaaagataaagcagtgataaaagatcatagaaaactagatcatgactaaaatatttcattagcaacagcttcctgaaactcagtgactcctgcttaaaaagcaatatccttgaaataactttcaagcaatattactcagtaaccgatggtagttttttgaatcttttttttttttgagacggagtttcactcttgttgcccaggctggagtgcaatggtgcaatctcagctcaccacaacctccgcctcccgagtttaagcaattctcctgcctcagcctccagagtagctgggattacaggcatgcgccaccacgcccagctaattttgtatttttactagagatgggatttctccatgttggtcaggctggtctcgaactcccgacctcaggtgatctgcccggttcggcctcccaaagtgctgggattacaggtgtgagccaccgcacccagcccagttttttgaatcttattgtggtaataaaacactttttttccccctctaagacttggaagaattagttgctctctctaaatgtccatttatcataagaatgactaagagagaattttacattttaagactcaaaagcaagtgcgttcatctgatcttcaaagcataacgaaaattcaagtaacgtctcttcaaattaccaaattcaattaattttgttttttaaaattagaaatgcaaatatatttctacccgaattttaaatattatggcaccatatatagtctcatacttttataaccccccacagaattatttttaaagctagtaacatattactgtaattctgtttgtaatttcttgagctataactagaagaatttccttttattattaaaaataggtgtttaaagcatcttttatgcatttgcttaactggagggcaaacgtggtagaaaatcaaatcagtatgagtggaaaaacgccacggttcttcttttaaaaagtggaaggcaaattatatatggtaacctgacatggtaggctccataaacactgtagtagtacacaaactgggccagctgtggtttccctgtttgcttgaaaataaaagggccacagaggcaattttagtctcatacggttggggtctgagattgatgtctacctgccatccctgcaacactgagcagcttctccagtttcctgggatgtcccattcccgaggagtcatcccagagagaagcgatgggaagcagccttcttgcttaggctactgcagttataaagtgactcttctgtgaatacattgcttaaaagagtcaaagttgtttatttatttatttattttaaatagaggtagaggtagtagaaagatgacaataaaatagaaagaaacccaacccacatatacttaaaagaagggttaaatcagatttaagatgatgaatcttttacaatatatgtgaaatatgcaattaaagaagtattttggtacctgattttaggaactgtaaaatctgaaggaagctttgagattttcaccatttgaggtctgtttggaaatttttcaaagattcgcaggcgtaaagggagcttttctttggtgtccgcatttgcttcactttgctttaactaaagaaaaattggaaagaagaaaaaaagggggaacctataatactattatatacgttacacaaaattagttttagaatggaagcaataagtaattacatgaaatgccagtagatggcagcaaaggcctaccaagtatacctctcttgcccgccataaattgctctatgagctaaaacttttgagttaacagaaaaaacaaaaacaaaacttaacaacaaaaaaactaaaccagaaaaaaattcaaggaaaactttatgtcattttattcccaaagacaagtctcttttcatctcagacatttttaatggtttactattacttgcatatttaaacaataaaatttgtttacacatgcctaacgctagaattaaaaatttttaaaaaccatgaaaaatttaaaaaaaattaactacagaatcatactaagtagtagcatttgtaaagagagacaatggcaggaaaattggttatgtcgcctagcagattaaaacagaaaagctcaaaacacaaataccacatttggtccatgcagcgagttttccatttggctgcaaacatgcttggacacgacgaacttaaatgccatatgatatctttgtgaggaatgacaatcaaatggatttatttaagagtgtatatttatatttctacaaattgagtttcagggaagctcaggtttaacatcataaactggaacaaggctgaactaagatactacaaaggtggactgtggcttccagaattcatgctatactttcctatgctctctttttctctcccagtgccgacgtctcttggagtccctctttacttctgtttacctctccccttctccaggaccttctgcagagtggaacacccttccccacgtctgccctgtcttctgtcccggcttcccaaactgcatcttttaacactgatgcctttcaaagagtacatgtaattcaggctgcctttttggagggatttggggggtgggtttcaaaaatcatccactcatttacctccttgttgggtatggttttactctataatttgttttaggaattatggaaagataagaattagaggccaagagagcttttaaaacaggaagagagatggcaatgcatccctcctatatgtggaaatacaaattggctaaggagaacaggagggcttctttttggggaaacattcccatttcaatatgatggatgactcaactatcctattggttgtgagctcatgatgagattatacatcctgatttctggttttcttattaggctgcagaaatcgctcttatgtttttgttttgtgtaacataaacatttaccttagccatttgtaagtctgatttgattttgtgggtagcctttggtttttctgtcttagatggtaatcttatttggagaaggagtcactgctgttcgttgccttcctcccttcctaactggagtgctcaacgcagtaatgtgtgcaaaatggcacgttctcaacagttccatggttatgatgatgacaatggtaaggaattagctcccaaagacacaaaacaaaaagtagtagcatctctgtgagaggtacacagttagaaaaatgattccacacacgagtaaagagatttaccaggaagagtcttgttttctaaaagttgatacaactagtagaaaaatacttgtcagtggtaaatagagcagaagtagaaaaagcagttaatctattagatcagatcagagtgtaaggcaggtatatcaggccaaaggtgataagacagagcagaaataaagtattgttaattcatgcatttgctgactcatttatttatacattgatactgtcacttataaatcaaatcttacaggtcaggttctgtgctaagctcaggggatataaaaagaaataagtcactgcactcgccctcacggagcccacagtataactgggtagatagttctataaagagacaatgataataaaatagaatggccactctggcagatataggaacagagtgctcggaaacacaaggtatagagcaaagagagaaataagaaaaaaaatgaaggcactacttctactccacgagacttcacgggcagcagaatagacacacgtggtcagaagagttgacttgggggctctagatgtatcaggactggtatgcatattttatgagaattcaatgtcttcaaacagacacaagggcaaatggtatattaattgggacatatcattgaaatgagaacacagagttctttcctaaaagcctctaggcctgcccactgcctgcatccccaccagtgcctccctggccaatgcaccactgggttcctgcatttcctgcagtgctttctccatctgcttcagctctttctaatctgctcttcattctgcggttattgccatttctcacgctctgtcttaaaacttttcaatggcattccactgcctttttcttcctctctctctcttttttttttttttttttgagatggagtcttgctctgtctcccaggctggagtgcagtggtgcgatcttggctcaccgcaacctctgccttctggttcaagcctcagtttcctgagtcgctggaattataagcatgcaccaccacacctggctacccactgcttttaacaaacaaacaaaaaaacttttgttttaacaaacaaaaacaaaaatataaacttttcttttttaaagatatgggatcttgcaatgttgcccaggctggcctcaaactcctgggctcaagggatcctcttgcctcagcctcctgagtagccgggactacaggtgcgagctgccatgcctggtcaaaatctcaatcttcaatctaggctcagaggcctttttttggcccctccctgcctgtccagcctcagctagctctatccccacaccgggttccagtcacatccttcagttgcttggaaacatctgcaccctctgcctcagaacctctgtgcctcccccacctctgccggccctctgctggccctctgctgggttcccctttcttcctctttttctcttgaactccatcaaattctacttgttttctagatttcagttccactagaaattcctcacagaagctttctctgacaaagttttcctcttacaagctcataacatggtaggatgaatcctataatattgctgtttgtgtggctcaaagcagttgaacatctgcaatttcttacgggtcaattgaatccacaatacattagtttcctaggactcctgtcacacattaccactagatcattagcttaacacaatagaaatttactctctcagcattctggaggctagaagtcaaaaaccaaggcgccagcagggccatgctctctctgaaggctccaggcgagagtccttccttgcctttctcttgtttctcatgattctcagccatgctcggagttccctggcttgtagctgtaacaccccatccctgcttctgtcaccacatggccttctgggcctgcgtgtttctgtgtctctgaatctgaatccccctctccttttccttatagatgccaaacactggaccatccagaacaattaacttaactggttacctctgcaaagacccaatttccaaagatggtctcattctgaggatccagctggacaaaaattttgggggaatgccttaaaccccctactcgtactgtcgtttgacactatattgtgtgaccccttgcacaacagttctcttttccctgagactgtaaacttggtgaggacaggaaccatgcagggctctgctcattattccacgggcagtggctggcatggcactggacacaaggtgagctgagcaaatattcagtgaaggaataatggtattgatcaggtggcggaactcaactctaagctaaactctccagcagacaactgggaaataaaagaaaagattttagatatatcctgaagggtagagagataagcataaaatatctattgattgattgaataaatttgttagtgtggagtatgcgtgtccttagattcacagaagagaataaaattagactcctgtgtcgtttaacctgaactgatgtctgtcgttgacaaactaatgaatgtttagacaaagtacagatataaaaattttgtaggctgggcgcagtggctcacgcctgtaatcccagtactttgggaggccgaggtgggcggatcacgaggtaaggagatcgagaccatcctggctaacacggtgaaaccccgtctctgctaaaaatacaaaaaattagctgggcgtggtggcaggcgcctgtagtcccagctactagggaggctgaggcaggagaatggcgtgaacccgggaggtggagcttacagtgagccaagattgtgccactgcactccagcctgggggacacagcgagactgtctcaaaaaaaaaaaaaaaaaattataaagggacatgttggagaaatggcaagttatattttatcgaatatccttgaatatattgtttaacatatgtaggataccaacagtcaccttgtttacacattttaaaaatgggtttcacccgcattctaattggtattagagatatttacactccccaaagcttgtacgctccttaggaacaagataccattttaaatttacttctatagtacattctagggagtagaaatagaactctttgtaaataaatgaattagaactcagcacaacttggtcattgcgctgtgaaactacaaagaacagacgggaagctctttttggagactcagaaggttcttcacgattgtgcaaacctggcatcattgccctacagttgtgcattaagggccagttaacacagagaaggatgagcggctgcttgaagggtgagtattttgaatctcatggctgaggcactgaatcaaacctcctaaaagcaaggacttgttcttctggacagcagttcccatgcactctttgctgttattaagagagaagcagcatcaactaaaaatgagcacaggtaaatccagcagccctgtggatcctctcctaggtgcgtgcctgcaagaactgcgtgcacacccacaaggcacaagccctcccttggccacagcagtgtcagttgttaaaagtcccaaaatgtgaactgtccaaatgcccactagcagttgagtgggaaaatacatttgggtttatttaaatatttgaatgagtgaactacatctcagtgtaagaaatgtggatttcacaacataacattgagtgaagggagccagacgcaacaacagagtacatactgttgtatgtactccattccacgtggaggaagttaaaccagcaggtggcactgacgtgtgctgccgggtgtctgcagagtggtcgtcctgggtgggggtggcggggagcgggagggagtatggaaaggagcttctaaggcacagtcaatatttcctgagcagggtgctgggtgtgttcagtttacaaaaatgtatactatacctctttctatatgtatattagagttcagttaaaagtttttcaaaagggaagatgatgcagttaagcaaaattattccattcttacttcggcactatcagccaccaaaactttgacgtctttcccaacccatgattttgaccaagctacagacacagaaaaaggaagaaagagtaagatgggagtagacagggtgtgtgttggtggtgggggatgaggtgaccatgatacacaaagtattacatgttattttgaagccactattaagtttctttaaaatgtaatgaaatggtattctaccttttatccaaattctttccccttttttgcatttaagcaaagattttgcaagattaaatttactttgatgcaaatgaatgaataatatatattataagaagtggttatgaatttttaagatcattatactataccaagaaaagaagatcttttaacataaagtaattataattgtaaatgtccatttaaaaagtgtttttaagatcatgattcttgaaggaaaagaacacagtgtagagaatcctaggattttatttctcatattgaaaaatctaatgtaaagaacagtacaaaggaagtttataatggcctcagctgagcatgaagtctggctgcaaccgagagatcaaatgatagctttgtcacacattcacatggtaaagaaaagcacatttgcaagaatgaaattagaatcaaagaaacaaacttcaaaccttgagctttaaaactagaagtcgtctaagctcagtgctattctacggctcagcatctgcctggctgagatatcattacacatcgggcggctgaaatcctctgctttccctgacttctcaagagacttcgggtgtaattgctctgcacgacacatactgtgttctgcctcatcgcttaaatcttccctatttcagcctgtgctttcttctgttaaaatattcaaacattattcagtttcagttcctttctgattgctgtgaggaataactgaattgaagaattacattaaataaaaatttttgtaattttttggtatgatttcccaaaagaaaacaatttaaaaaacattcagacttgggagattctcattttgaaatctagtccgtgttagtttgaaaactgtgcatagatttgtgagttgatgtaactgtagaatattttttggttgttcaatataggaaaaataaccacattatcttcaatcagaagaaaggagtccctcctctttgttatgtgaataaattaaggctgaagtctctttgcttctttacacagtggctttagctattttttctgtatctatatatatgacatagcaattcagaacatagagtcttgctaaggcgtaaactattatttttcaagggagtttctcttgctaatttgtatatgtgattttacaacccaaatcgcacagtcaaaacagatggggcatctggaataatgatcacacatgttggtttttaataatacctctgtgtaattataaaaccttaatatgcaaatacaaagaatatccctcactggcctgtgaaatccaatacagaatttcttcaggtgggtgggcactgtcttttctgctgtggacaaaaggcaaccaagtcaaattagtgcatagaagacagcgatactgtacagttttcaaacgtttcatcaaaaaacatgtttaagtcactaatttttccccgttttacaaaaatatttaatacacccagtatatccaaggtcaaagtggggttttcaattatttggacgcatcgactgaagccacagatagaaattggagggctcatttcttggttagcctatgggccataaaagctacatttttatgtgatagctgacatccaaaatgttcataacattagctgattaactgcatgtgctgtatcctggctggttactcattcgtccaagcagcatgtcccttaagtaagtatgaagagaagctctgttttcggaggggcggatgcactgggcaattaagtggctgttttgtgtttgttggtttgggagctcagcagagcacttataacagactgttgcattcctgccacttatgatatccctgaagtgtgcataaaatgtttactttcatgctgttatcacaacccttaagatcttacaagctttaaatgtccttcagaaggttactttgtgcaacaacatagataatatttgcagcaaggctaagctaaccaacaactctaatgaattagtaaaagaaaaaaaaaactattcaaatccagaatacctaattatgttgaatgagcacattttgctcatattattgtcctttaatatcccattaatgtaattaataatttcttagagacagtggtgatgaataaagattgattttgtaggtttattcttctaggtcccaaacatctctattttatattatatctgtcctttgttactccactgagacacagttgtttccatcagagaatttactgagtcatagaaatatgctcagtgtgataaaaaaaagtatatatcttttttgctccacttcagaggaaattatattagagtttcatgtcaactagatacttggttcttattgtgagatgattcttcgttaagtgctagggaaaaatgtcacaccaaagggaattcaggatacacacacacacacttacacacacacaaacacgcacatacactcccatgtaatttttctcttttttttaatttataaaacatcagagatagcataagtaaaaacagtaaaaaacaaagtaagaagacatggatttaaacttttgttcagttttataatctcttcacccctttggatttcagtgttctcaaataaaaaatgaggatctttagtctttcatataaatgccagacgtgtaagtgagatagcaatatgcctgtaatttgaattactcaagggaaatgtgctatacaaaccaaagctatcaccatgccacagtgactgcttgctctacaggaggaggacttcacccatatgaatggggtgacacatatgtgtgcttgagtcccttccctctggctaatctgagacaactcaacctctccctctttccccaatttcttctcgtttgctatgttgattggattgttttctcaagactcttggttgtaaaaatgaaaacgaaaataggcagttaaaccatttctcctgatcatgcctcctttgctatttaaggttgcttcttcaaagagatgcttacagcaccattatatcgcttcccacccctcttccagcctctcctgtctcaggtgtccccccctgcctcagtggggctgctcttggcaaagtcagcgtatttcccattttgctgaatccaatggtcaattggtcatccaaatttcatctcgttgagactcctgaaaccttcctaactggctttctgtcttagttttttccctttaaaccaatcttttagaacatctagaaaagaaatacctttatgtccctctggtccttaaagtaatgcaaagactatcaattatgtacagaagaaattctaatcttcttagcatggcataagcgggtcttccagtgctttgccctctatgctctaacctgtaggtctgtgcccccctcacacagggatgtcacatgaagatactgctccccatgcctgcaatacacttatttaactcttataaatccttccaaaaccatcttctccaggaatatttctcagaataacaactggtaggtgaagcagtaaacacgcgtgctggatatgatgctgaacactttatgctaatattatttaaccctaaaaattagctccctgatgtcggtaccataattagctccatattatgcaatgtcatcgatgaggaaacaggtccatggagcttcaattagctgcctgaagtcacatagctagaagtggcagaactggaatttgacaacaattttcctgattccagagcttgagcttctaaaactgttgtatactgccacaccaaaacaacactttcaagcaattggtacacttttacttgtgaatcttgtgcctgttattcctcttatatgggatattttctctcgttttcctaagaaaattttatgcatcatttttagacacatcttccaggacctgcctctaaaccaaattaggcacatcttcctctgtgcaccttgcatttagtcacatctccctctgttgcaccttgctcaggggtttgcactataactttctaattacgtgtgcttttcccctactagcatgatgcatttttaattaagggcacaactctctgtggccctgtggcctcaaattgtgcacacaatacaatgataatccaatggtgatgagatgagaacaagaaggcaacactaacggagtcccatcaacaggcagaagaggatcatttgtaatatttctcttcattctattattgttttcttagagcctttacaatatggaatcatctatattatccagcacaagcaagtctgccgatttcagatgagttatattactggcaaagatgaaagaggagtaatgacaagttacatcagattttctattagaaacaaaatcacaaaaagcatttggctcttgataaagtgtgtgttcccagctttttaagatcaaaaaagaataataaagtataaacttgatacaacgtattcatggcagaaagctacacagatgtacatatctttgaacaaggcaacacaggagctaatttctatgttgcattattacagcttaccatagaaaattctcatcctgtttacaaaaacactattttgaagtaatttaaaactcacatgagagttgcaaagatagtacagagagttcctgtataccttgacccagcatgttatataccatagaacatttatcaaaactacaaaattaaccttggtcaaatacttttaactaaagaagttattgggaattcccaggtttttgcacgaatgactttcgtctgatccaggagctcatcctggaaaccacattgcatttcattgtcacatctgaagtttctcttggctgtgacaattcctctaattcttcttgttgttaatgactttgatggtttcgaggagtatcagtcaggtaatttgcagagtgtcccccaattttgggttgtctgatcttttctcatgattagactgagcttatacatttttgggacaaataccatggagatgatacgcccttctcgtcatatcagtgtgtatatgacattgaggttaactgtccttacttgggtaaggtgatgtctgccaggtttctgcattataaagttacattcagtgtttctcttttcctactccattggcttgaagcaagtcactgactccaactgacacttagaagaattaaagctttatctcttaggaaggaggagtatcaaagaatttgtgggtggatgttaaagctgctacaataattaaaaaaagacttggagaggacactttgaggccatgcaaatgttttatttctccttaaagtttcacatactaattttggtattcatcagctcttgtctgtggcaattacaacaatagtttcctaatggcaattttctgtttacttcatttattattctattatttctatttctctacatttcttacttggaattattctgagagaatcagttgtccctcctcctttatttatttattcaatcatgtatctgtataaatatgtatttgtgactatttattgtattctttgggttataacccagtactttccttattcatttcattgctcaaagtcttcctgctttggccactgggggcactttcagtcggcttctctagtcttcagacatacttctatctattttgtttgtttgtttgtttgcttgtttgttttttcctttttagctcttctttattttctggcaccacaaaatgtcctatcctcatcttgtgttctctttaattcagctctaaagccagccatttcttcagagtgccgacttgttttattggagaatgttatttagggaccaaaatcccagcactaggtttctcattgtttctagtatatccttacttctaggctccctcagcagaaagagcggggaaatacatgtatgtatactaactcatgtacacacactctctcacatttacctagttttgtatatatttacctacgtatgtatcttacataaccctccaaccatatgtatgcaggtatatatatatatatgcatgtaactacctacctatcctctctcttaaaataagctgagttcttactgatactcctaatctagccccacaggttctcctgtggcatctcccctctgctcatttataacttctttctctgatggtatgaactctggctctcattttctatagaaaattcccttatttgttgcacttagtgtgcatgtaacgttgtatcagtaatggtatttactatcaaataaatatgacactttaaattagaggcatggaaaatacgtactttggaatgcagtcttaacattggggtcttggaccccagcagtgtcctattcccttaagtaatttcttttctggccacaatcatgcatttccaattatcatttttgtgtatgtctgtggtcaaatgaatagtttttaaatgtctcctatgttgataaaagggcttattagatacactatgaaaattcacattaatccacatattttattaaaaacaagtggaaatagggataacattaaagaaaataacatgtatatactgcactcatgtcccagtaacaatctaacaaaattagtatattgttaatacctgagtacaagttatcaaggcagatggttctatggttatgtaagacacatgcatagataggtaaatatatacaaaactagctaaatacatgtatgtgtgtacttgagttagtacacatacatgtatttccctgctcttcttgctgagagagcctagaaacactgatatactggaaacaatgagaaacctagtgctaggtttttggtccctaaataccattctccaataaaacaaatcagcactctttgaagaaatggctggctttagagctgaattacagaaaacacaagatgaggactggaaatttcacggtgacagaatgccaggaatgtctcacctctcactgtgcctggggatgccctacctctcactgagtaatgctccaagtggaatgtaagggaaggccaacagtgaaatcagtcatcctcaattataggaaagttggattataaatgaggataaaagactggttgttatccctagttaattccctaactttttggtcaactttggttattaaaaatttacttcagtgcagtctagtctcatatctgattcaaacctcccttcttcctcaccccattacatgacagtatgacatatggttttgagctagggaggggacatggtcttttttttttttttttcctgagatggagtcttgctctgttgcccagagctggagtgcaatggcgtgatctcagctcactacgacctctgcctcctgggttcaagcaattctcctgcctcagcttcctgagtagctgggattataggcaggcgccaccacacccagctaatttttgtatttttagtagagacagggtttcaccacgttggccaggctggtctcaaactcttgaccttgtgatccacccacctcagcctcccaaagtgctgagattacagggtgagcaaccaactgtcttttctttcattgctccacatcttcttcttttgggtgtagctcctccaaagttggggtcagagtggagagttaggagcagaaggtattatcttaggaaaccactgacctcccttctagtttggtttggatctacacccattcagcacttatgtcctttgttgatagggttaacatataatttgtgtgatttcttttttgtataaggagagttttactctggtcttccgcagccaaagacgtcctaagagaaagagaatcttgtcttccttaggtccttcctttaatcctctcctgaatgagcatgtcttggcttggcctctgcctgtgcagccctctgcctccccaaccttcctctaacatctgtcatgggcaccgctgagctcccctctgcactgtctgaggtggcagagaaggagaaaggggtggggttcccccagcccagcattaatcttagaaaatattcttcttgacagtcctttcttgacaagctactgctagctgtactctggctggcctctgactttcagaactgtctatgtcacgcaagggcaggttcactctacccccatctgcaccattcttcagaaggaagatgccagcttcctttcacaaccaactcagcttgctgtaatctagtggctgaactgagtagagctacgggtttccaagcttccagatagaagagccagtctctttctgtttgactggtactcctcactcctacaagtgattctctggaagtcctctcttgcgctttggcaaaggaggaataatctctctccgtaaacactgctactgatgattctaccacaactttcctcccacagcactctccttatttcatctgggggagtgtgagctgggaagataatcaggaataagaggaccaccagtcatctttggaaggtggaatctcaatttagaagatagagcacttagcactgagattttaggcacaaatccagagtaagatgaaatgatccagttaaaaatatgttgaaggcatatgagaatccaggtagtcatataattccctttcctaaactcccagagtgaaaaaataataggaaagtgggaaagtttgatggcatattaagtaaatggcaaggaatgaatatcatcactttcctgacttttattctttcatttgatccatgtacaaatacaaagcaatgctgtcaatgacagcatttattaatacaaccaagatttctgctaagagaaaattgtatgtattgacaaaatctgactattctcagaggagattacttatctagggccctgtgaccccagctctagtgccagagcttgcagcacaggtcaggtacatggtagacccagctcttcatcatggcttgcagtcgccccctccgggtggttactaacatgttgcctatgctggggattgcggtttgtgtaggtggccaggggtcggagcagaaattcgcagtaatgaacagagaacatattagaactacgtatattagaaaaccatgcagcatgaacaccccaaaatcagaagagacactggacataaacaacagatctgtcataatgaagtatacagctacaggtgtcccagtaatgacagctctcgactctttcccggatgagaattttagatctagaagagatcttgtcagggtctagtgcaggggcccagatttaaatgcctatgagaccagggagatgatataagtgccagcttggatgacataaaacaatcatataagacaatatataggagttaggactcgtgtcatcaaagaaaagagggcacaccggatctaaagatacccaagttagatttggtaaaactgaaagagagggaagacatttctccaaaatcacatctctttgttagtgagagagaaggttttttttgttttttgttattttttgttatttttattttattttattttgagacggagtctcattctgtcgcccaggctgaagtgcagcggtgcgatctcggctcactgcaacctctgcctcctgggttcaagcgattctactgcctcagcctcctgagtagctgggactacaggtacacaccaccatgcctgactaattttttgtatttttagtagagacagggtttcaccatgttagccaggatggtctcgatctcctgaccttgtgatctgcccgccttggcctcccaaaggagagagaagttttcattgtttcctcctgtggaccactcagtggaaggaaaatgtttgcaaggtcccttctaaatttccttccctcttccttctttttcgctttgtctgtgtctcttgccttttatctgcgcttatcataaagcagagaggtaaagtgagaacaggagccatatgaaggtgtaactgaccaagcgtggggaggaggggcaggctaggaaatgggaaccaatactccctcaggaccctacaatggcactcacatctgcttcctcctgaatgagtggttggggaggagctggattatctcagctcctcttttctgttacctttgcctagactgttaaattacagtggcatgcaatagataaacatattaaatctctctgtaatatgcaggtgagttctccaaatgtctgcctgttctgttttttgttttgttttgtttttgtttttttttatgaaggtgtttcttccttataaattgccttatggtacaaagtaactcatcacccttgtcaaagctggttgagccagaaaccgggccaaagacagggactttctataagactggccagcattgcgaggcaatcagagatgaaattcctgcctaaaaggaatcatattgattagctggatcgaccaaatctgttcttattgatcaagttttgaacctgagatacagaaaatgttgactatttgcaatggaactgaaagtgaaaatacacaaggaggaaaacagagacaggttgagttaccataaaggcaaacaccagcagttattaaatgttgctcttcctcaaggctccagcatattttttcttcccaccctatacaatctcatccagatttacaccttccagtattatgaaaacatggagaactttactaggactgaagctcaaaggaggcagtcatttttgtctgttctgttcattgacctacgccacatgtctagaacagcacctgaataaataattgagaattacattgaatgtccacatttatatctctaggcagccatccttctcccctgaactccagacctatacacaactattaggcatctctgttcagacatcttgaaagattcaccaactcaacatgcccaaggctgagttgatgaacgtttcccccaaatacggttgtatgctagtgtttcttaactcagttaatgacatttcattcatgcaactgtagaaacctgaaaccaggaatcatctttgagactctctcactcatgtctttaaatccaacctatcaccaagtccctcttgattttattttccaaacagctctctggttcaccactgcctcccatcttataagctttcagtggctcaggttaaaggtaaacattaaaggtaaatgttctggctggtatggtggctcatgcctgtaatcccagcactttgggaggccaaggcaggcggatcacctgaggtcaggagttcaagaccagcctggccaacatggtgaaaccccgtctcttctaaaaatataaaaattagccaggagtggtggcgcacgcctgtaatcccagctactcgggaggctgaggcaggagaatcgcttgaaccttggaggtagaggttgcagtgagccaagactgtaccactgcactccagcctgggtgacagagtgagactgtctcaaaacaaacaaacaaacaaaaaacaaatggtaaatgaccttaccgtgtttctcaaggcactgcatggttcatgccctgctgacttttccacacttactctataccactccaccctggtcttcctgcattctgggtgcacagaggctttcccttctccctggagttgtgctcccctcccctgacccaccacacctccgtgaagtccacaaggctcatcttgcaaaacttagctctcctgtaactttcttcatcctcacccctgaccaccatttgtgtcggggtcttctacgagtgtctctccttaaatgatgttattttctgaagaaagctcatctcaatctttacacagttaggaattattttaattacttgatttacatccaactcccctattagaccagaaggctccatgggagcaaagaacttacttattattgtacctggcctagcgttgtacacatggtagggactcaaatatttgaagaatggatgataaagcagattgtgaggatgcttccagaagaacggaaaagtacatgaattacttgaaaaaagatccaaacggactgtgtgaaagttgagttcaaaaggaatcagggcaatgactccagctccagcatgttcctatttaatgtgtaggtccacacagggtaaacctcactattctaactcctcacaacaaatcttaacacaactataagagtgcctttttgtaattcaacaactgccaggcaccgcataaaactgaaaactgtcatgcttttctcttagaaccattgcaatctagtttcccactgcctgtgacaggatctgaaagaaaaagtgctgcgaggttgctcttccttatcatccttgctgttttcaatggtacagtgcagtaagctcatgcttcttaacaattttgttctcttgattaaaggaaacaaaataaaatagcatccttacagttaagcagtgggtggtgttcagttggagttgaagtgtgagcttctctcctgtttgggcacatcttccctccaaatcccactatattttattttatttatttttttgagatggagtttcactcttgttgagatggagattcgcagacgcgatctcagctcactgcaacctctgcctcctgggttcaagtgattctcctgtctcagtctcccaagtagctaggactacaggcgcccgccactacgcctggctaattttttgtatttttagtagagatagggtttcaccatattggccaggctagtctcaaactcctgaccacaggtgatccacctgcctcggcttcccaaagtgctgggattacaggtgtgagtcaccatgcctggcctatatatatatatattttaattgaagggttaccttgcagagtgctgtggaaactagaatgaaaataattctgaattagcacaattaaagaatgatacaaccgacaacccaccattgtagactcgagtggacaatcttaggtgtgtagtttcatgtttgttccatggtaagagagatcatgctaacaaaacagtcccgagtacccatggatgaggcaaagaaaaggtctctaaaacaatgtccttctggtttgagttaatcacacatgacatgaaattttggaagggcttacagaaacctttcctctaagaaagtctcaagtctataaaattttactatgatggggtttgattcctataatcaaagaaaggcagaagaaaataactccaactgctgagaaagctgctccagggtggcgcaggctggcgtaggattccaagggtacgtccattgttccctgctgccccatgctctcagccaggctacttgccagctttagaagggatcgtttcttcttgagtccagagaacaaggctctggaggtgtgttagttgtctagggccgctgccacaaagttccaaaaaactgggtggctgaaaacagaaatgtattgtctcatatttctgggggctggaagtctgagatcaagatgtcagcaaggcaagctccttctggaggttctgaggggggtctactccatgggacttttccagctgcttgtgatgccagcaatcctgggtgttccttgtggaccacatcactctggtctgtggcttcatcatcacacagtgctctctctgtgtgtctgtgtctgtgtctcttctctttttatgaggacaacagtcatattgagtccaccctaatgacctcatcttaacctgattgcatctacaaagaccctatttccaatcaagttacattcacagggactgaggcgtagggcttccacgtacctatttgagggacagaattccactcatatcaggagaacatcaattctaacaggtacttctgttttgaactgactttttgaatctcccacctatacttatttgactgtaaaaatccagttggctgtttctatctttatctttcttggggggttggggggacagggtctttctctgttgcccaggctagaatgcagtggcacaatcacagctcactgcagccttgacctcccaggctcaagtgattctcctacctcagcctcacaagcagctgggaccacaggtatggaccaccacactgcgataatttttattttttgtagagatgagggtctcactatattgcccaggttggtctccaactactgggctcaagcgatcctcccaccttggcctcccatatttctactttttgaatgacttctagattcctaggctgttgtttttatgttgataattgatattcccaaattctgagcctctgttgtgacttcttggcttaaaccttgatctaaactgttctgtcttagccatttcatttcttcaaaccaattttattgctgtttatgtcttagtgtgacagagaatttattataaaaagtctaacatttattataaaagtaagaatttattataaaagtaagtagctatttcagaaatagcagatcaaatgctctataagctgatcttttgagatttacatcatggaaagttatgggcaataataaactgacctcaaaagagtcatctctgaccaaaagattgaaagaatggcttcaagtggagttaggtagcatcaacagatttgagtgaaatgcagagtttttcaactctcagccactaatgatttataggttcttcagggtacggtcctctcgctcctgggcagctgttccctggagcatcaggaatccttgatatctgatatttccagctgcttttgcttcctacctattgacttcagcgtgttgtacaaatatcattctctatgcataccacaatggcaaaaggttgggtagcactgtagcaaatggtgttaacatatctaacaaaattaagaatcagccagcaaccaggtggtctatctggaaacagagtatgaggcgtttgaggaaaaggttggtgatccaccttcacttccttacccgtcattgattccctatcctctgcaacccagctctgtatcatcgaaggccctgagcttgctcttattgccttcactaaccacctccttattgttaatatgatcagttttaaataaaagaaattaattgtggtaaaaaacatacaacataaattttgccatcttgatcatttttgtcgttgttgttgttatttgagacagggtctcactcttgcccaggccgaaatgtaatggcatgatcacagctcactgaagccttgatctcttgggctcaagcaatcctttcaccttggccacctacgtagctgtgactacaggcatgcgccaccatgtccggctaggctaattttttgtatttttagtagagacagggtgttgccacgttgcgcaggctgatctcaaattcctgggctcaaacaatgtgcttacctcggcctcctaaagttttgggattacaggcgtgagccaccacgcctagccccatcttaaccattttaagtgtacagttcagcagtgttaaacatactcacattgttgtacaacagatctccagaactttttcatctttcaaagtggaaactctgtacccattgaacaacaatgggtttactcccctccctagcccctggcaactctcattctgtcttctgtttctctgaatttgactactttagataaactcacataagagaaaccatacagaatttgtctttttgtgactggcttatttcacttagcatgatgtcctcaaggttcatccatgtgtagcatgtgtcagagttttattcatgtttaaggctgaatgatatttccttgcgtgtagataccacattttgtttatctattcatccactggtggacactagggttgcttccaccttctgttattgtgaaaaatactgcaatgaacatgagtgtgcaaatatgtctttgagattctattttcatttcttttggatatacatatccagaagtatattttatcatatgatcatgctacttttaattttttgaggaactgccatactgttttccgcagcagcagcaccattttacattctcatcaacaaagtacaaatgttgcaattttttcacattcttgccaaactgtttttttttttgatagtggccattctaataggtataaagtggtatctcattgtggtttctatttgcatttctctaatgattagtgatgttgaacatcttttcatctacttggccatttgtataccttttttagataaatgtcagcttaagtattttgcctatttttaaaacagattatttgtatttttcttgttgactataggagctctttcatattctcaatattaactcctcatcagacacacgatttgcaaatattttctacaatcccataggttggcttttcactctattgattgtttcctttgacgtgcaagtgtttttaagtttaatgcagtctcctatttttgcttttgctgtctgtgccatatccaataaatcattgacaattccaatgtcatgaagcttttgccttgttttcttctaggagctttatggttttaggtcttttgttaaggtccttaatccattttgagctaatttttatatatgatataaggtaagggccaaacttcattcttttgtgtgtggtatccaatttttcaacatcatttgttgaagagactgtcctttccccatagtgtggtcttgacaccactgttgaagatcatgtgactatatatgtgagggtttacttgtggcctctctattctgttccactggtctatatgtgtgcctttatgccagtatcacactgttttgattattttatctttgtaatatgttttgaaatcaggaagtatgacatcttcaagtttgttctttttcagaattgttttggctatttggtatcccttaagatttcgtatgaattttaagatttcttttctatatctgcaaaaagcgtcattggaattttacgaaagattgcattgaatctgtagattgctttggatggtatgaacattttaacaatattaagccttccagttcttcaacacagaatgtcttttcacttgcagatgttcctcaacttacaatagggtttataaattcattataagttgaaaatactgtaaaagtgcattttttaacttatgatattttcaagttactatgagtgtttctggatataattccatcataagttgaggagcatactgagcgtgtatctgttttgcaccatcataaaatcagaaaattgtaagttgccaggttaggtggttcacgcctgtaatcccagcactttgggaggctgaggcaggtgagtcacttgaggtcaggagttcgagaccagccctggccaacatggtgaaaccctgtctctactgaaaatacaaaaattagttggatttggtggtgcatgcctgtaatcccagctacttggtagactgaggcaggagaatcacttgaacctgggaggcagaggttgcagtgagccaaagatcatgctactgcactccagcctaaggaaaaggttgagactctgtcaaaaaaaaacaaaaacaaaaactgttaagtcgaatcatcgtaagtcagaattcatctttatttgtggcttaagttctttcctcagtattttatagttttcagggtatgtgtctttgcctccttggctaagtttattccaagtattttattctttttggtgctactgtaaatgggattgctttccatggtgactatttttttgacctctctgaagtctttgagatcgttgaacaaggatctctcttgaaactctttcaccttttgatcttggtgacaaacacattctaggctttcctcttacctcttgtgctgtgacttctcatacacattttggctcctcctcactggttcataccatttatttattaccccttagggaaccatccttcccttggtaagttcctgctctctaaaggcttaaattaccatctgcatgttgattttgctctttttcagtatctatttcagcctagatattccacctaagctttaaactttgtatctctccatagacattgtctcatagatatttcccaggcatctcagggaaaatatgaccaaacttcttcccccgaaaaaaaacccaaataaacaaaactctcatttcttctttctcttgtatttcttctgcatcagcgcacttaaagaaatctagaaatctgggtgacatccctgtgtcctggtttttctcacttcctacatccaatttgtcactaaatcctcttctctgtactccaccgctttcgatattctctcattcctatttcctttggttcaggctgccatcaccacttgcctcaagaacggattcttccatctccagtctgggtgccctccagtgcatttcacactgacaccaaaatgtaggtatgattatgacaccctgtggcatcaataccatcagaataatatcaaaatgcttagtgctgctcaagcatttcctgtgctggtatctccttatttttccagttaacaattttctctcttgctctacacattagccacagcaaactcttagtgtcgagaaagccactctgtttttttcccacctaaaaaagactctgcagttcccttggtcttcactaccctccttcatgccatcttcctccaaccctcttcacctggattagcactactcaacctccagatttcagtctgcacctgcttgtgagaaaacgtccctgatttcacagtctgctttagatgttttctgtgtgcttccgaaacattatccttataatcatcaccactgaacccaaactgcctgtttacttgtctttttctcccactggctcaggagttatttttgagggtagaaacagtgtcctgaccatcacatgtccctagccccaacacaatatctatagcatagtagatgagtgtccagaccccagtttcacagaatgagtagatttagtttctaggtcactaatatctcaactgtaaaagagataactcagttgatctcagcctatcttagcctatgccattatgtatttttaaaaatatttttatttatttttagattttactttaaatactgggatacatgtgcagaatgtgcaggtttgttacacaggcttacatgtgccatggtggtttgctgcatctatcaaaccatcatctatgtatttaaatcacacaacctttctcgcctccctctccatcctgattcctggctcactaagctatagtctgattataatttggcttcttctttgaatacccacagggagaaaatatgctgatctaaaaaatggataagcatctcatccaatccacacctagatatgcttttcattataaatgaaggagctggttctctgcaggcagcatggcctttttcagcaaggacattggtttagggtcagacagcctttgtggctctgacccaggcacatatgaattgtgtggacttgggtgagaaattcactcccctgaatgttagttgccacgtctttaatatttaggattaaatgtgataatttaatataaagtagcctacacaaggtagttctcaatagatagcatttgctcctgcagcagttatatcagtcttttaaaattacattagtttgagttcattcatgagagactgacaaaatgctgagaagattgaagattcaactaacatcaggagatgcaaccagtgctcagccgaatggcatcttccagcagtatccctgccaccttgctaccgccctcaatctggaatgaactcaatataggcgacaaaatggacatgcaaatgagagcttcaggtgtgttaggcaagattctccagagaaacaggaccaataaaatatacatcagtatttattttaaggtattggctcatgtaattatggaggctgatgataagtcccactatctgctctcttcaagctggagacctttggaagccagggcaacattttgaaggcctaagaaccaggattcctcagggcaggagaaggttgtttacatggtgcaggcaatgagacagacagcaaattcagctttcctccacctttttgttctatctgggacctcaaagctttggaagtggtttaacgacattggggaaggaggtctgctttactcaggctaccaattcaaatgcaaatctttccagaaccacccgacagatgcacccagaaacaatgttttaccagctatctgggcatcccttagcccagtcaagttgacacataaaatcaactatcatgcagcttaaggctaaagaaaaacattcacctagagctcatactttaacaaaagagaatataagatatttatggtttttgtttaaaaaagtcacagtcaataagaaaggaaagcttcttaatatataatatctatccaacactatgcagtggactctagcaaagaccaaacatcattaaattggaaccaggattcaagtgagactggatacagggctgggtaaacagttttcaatttcacagctctgaatttaatctaaacagactacctatacttcccttttcgatgattcctcccctcaggcttttctgtgggttttttcttccctcaaagcttaatgaattttataccacttaaaagaaaaccctttatatctgtctttcaccaaatttgcaaaaatcattaaagctgcaagaattctcttcatattcaaaccttgcaaaactctgtgtacattccccagtgtcattcctgcatcacttgagcttcacagtcatcaactcttccgttcagagaagttttaggtcaagggttttgttgtagcctctataccaactgatttatcaggaatctcctcagctcaccacaatctcatttttagccaatttttaaatgtcatgcagaaacaatgttttatatatatgtgtgtataaatactaaatataaaaaatataatttttatatactgttacatatattacacacattatgtataatttatgtcatgtattacatatatttataaatataatctttatatttaatatatacatatacgtatagatattacatatatgtaatacaaaattataatatatttttgtatttaatgtatgacatatacatatatgttacatatattacatatatgtaataatagatatacacacacacacatatatatttttttccgaggtctctgtattggcttttggggatgctgaaaagagaaatatggtttctacgtacttcaatatgggggtcatgtaaatgatggcagctatgaaaagattacgctgccctattgctattagcaatcagctgtgtcatatatataacacacagggaaggcaatagaggaatttcatatggttatatgattgaggtgagtttttggaacatgattgtgggaagtgacaaaggaaaagccatagaggtgaccatcacggcacacactggtgatgtcttggagaggcggtgatgggaataaacacaccagagcctctcaaaatttctgtgcaaaaagtccttttactttctcctctggattctaaaacccaaacttctttcctgccaaaatgcctcgattaagcaataagaaattcattgtagctttaaacaaatttgcttaaaggaaactatatatgaaaacacttcagaactatagtattaaggaaacagtgctgccacttagaattttcaggtttccagctaaaagtattaaacttgacattttatttagcaggtgcgggcttatattaagtgaatgcacaattctcttccagcttcctgaagtattaaaaatgacaccatagcttctcatgaggacgcctagagctcagcagtccttggctagaaaccacctctgatgcacacggaggttgcatagaaaaataatgggaaaagacatacagcgccatgcttctcttccaggagaacacgggcccaccgacaatccatcatgcagcccatgcctgccctcagggagcttctgaggggaacgccctggtgggctttgacttttggccactgacttgctcacattcctaactctggatttggccacattcctgcacctttatccctgagttatagtcatactctttatttcatatctggtgttttcctacttcacttcttccttcttttccattataatttcttcactagtaccttttcactttctaccaccatctcacacccttagcttaagggcggcctctcctctcccctgtatgagggctgcttcctcttcctctgttgagccctactgagtgttgcatgttaacacccccatttattgttattattatttgagacggagtctcgctctgtcacccaggctggagtacagtggcgccatcttggctcactgcaagctccgcctcccgggtttacgccattctcctgcctcagcctcccaagtagctgggactacaggtgcccgccaccacgcgcagctaatttttttgtttttcgtatttttagtagagacgggatttcaccgtgttagccaggatggtctcgatctcctgacctcgtgatccgcccacctcagcctccccaagtgctgggattacaggtgtgagccaccgcgcctggccaacacccccattttagagcgaacaggccctggtttttattactcttgaaaaaaatctatgaaccaacttttacatattaacacagttaaaaacatatcgataataaaagacattaaagtcactaaaatgctgctatgctgcaagcctgttatgtaggcgtctgaggaggatcatcactccaagaagatcattgcaaagtggcaccttgagtggcgtttgccatcgcgcagcaagactgtaactccagtggctctgattagatcctctgagttttgagaggaaacaaagaactaatgtgaatagttttaacgattgggttgctgcattcaccgctattctcagaaactgtccttcattctaacagttacttgaatatgaggatgcctttgttatctacaacatcattatttataaacaaataattcatagtcctatgagtgccctccccagtatgcatgactcatgtttggcctttatatagctttagtttgaatcaatacagtttagaggttaagagtgtgggctttcggtccaaattgcctaggttcaaattctagctccgacatttgttggctgtgtaaccttgagcaagttacttaacctctctatgtcttagtttcctcatctgtaagatggacataataataacacctgcattgaatgggtcgttttgaaaaataagtgaaaacataaaacacttgatactgagcaagaattcaaccaatgtcaccatagctatgagaatctacatacaagcagatgtggtaaaagaagcaaaaagtttgaacggagcaaagatggaatttggaatgcatagcgctttctgaaacttgaaacattaagaaaatcaaatactttttttgaacatttcctccactctactctctatctgggagtagtaaaaatagagtacataagtttaaatcttaaggactggatttgtacatggacaattgaaacaaatatttagggtaccaatttcattgttttttaaaagaatctgtaaaagacagtctaaagtttcaggtatccacatgaccacatgtgtatatgaaagtgaatgcatgagaatgtgtgtgtttttaaaaatatgcaaatgagccctaccttaaaggccaagatcactgaaaataagaaaaatcaggggcataaaaaatgacaccgttgttaaaaactactgaaaacaaaacataatcatacaaaaatgagagaaagttaaccaggaacactttaacttagtttaataatatttgctataatgaatttcaggttcaacgagtttcaagtatgaaattaatagaagaatttaatagatacatagtttcagtccaaccatgaataaagaatagtgtaaaaagtactaacaaaaatggaattgctgcgttatgattggagttttcaatgcccaaatacccagagtatatggtccaaattgtaggctagtgcaattggataaccagttctgatatacagaatttccagaaacacaaagcttcactaatatctagcaagtgattaaaagccattttataaataatgacatttacccaaagtgaagggccatatagtttattaaaactttatagcccaggaagaatgtcaatgccaattaaagtcctgactttttattgttgcttcttcactttgggtcagatatgaaatgcctattgtgaccactagatataaagatgacaaaaaatttaagtaggctatgcatatacgtgtatatataaataagttaaaatgttgaaaaaaatgaacactgcaaagtatccttaggtttgaattcacaatcctgaaaaaattgctacatacaagtttattttgttgctttccagcagaaaaattattttacaaatgagggctggaattatatggttatttaaaagcatatggaacctggcggtagcactagctaaaaaaaattggatattttaaattttatctatagaatacacattgtaacatactgtctcagaggatagtacatatctgtgcataataaccatggcatgaaggaaaagtgacagctcaataccagatttgtaaagcatggactaaagtggttctacagcagcagatttttattgatcatgtctaattatatggctggtcactttcaatcttgaattcacctattagatatttttttctgcaactagaagccacacaaagtattttcattgatggcataaaggaatgtcccaactctcatttgaagaatctatcactgctgccacagagtgaaaagacggggaagaaatcatctctagcagagccgggaagatgcccatttgcctgggtagctgtaggatggtaaagaactcaaaacctttcttggtatgctccaagtaggaatcttcataacaatttttttttgtttgtttgttctgtttttttttttccttgttgataccctctgttaaaagcataggctttaaaggtaagagtaataaaatgaaatgcctaacctgatcatgagatagattaaaaaaaattaaaaaatttaaataggttatactttttgctttgttaaaaatagagagctttgggaaattctgaatatggagggcctgcttataattccaaatggaaagtttcagagccatggttctgttaacattataacaggtgtggttctgtcaacattataacattctaacagttgggtagagtttggtagttaacatctcaactattctctcagttttggggagggtgatacaagaacgttccacccattgtcccactctcttgcgagctcttcttctcaaagggtctgtactctttgatagagccaaatattcaagccaaatatcctccatgcaacagaagctataggaatgattgacgatagctgtaatcctcctgccattaagaacacagcattcacctatttctagtttcattctctggggtataactttcaccatgatgacatcccgtctgttttcatacataactgggtccacatttgatcatttattctgtttcttatactcactatgggcacccagactaaattgtcctttagtgtctagagaccaggcaggttgattgtagtatttttatgatgatgataaagactattacatataattatgcaaaatctggccttgaggcatctcatttccaaacaaccttcatttaatggcagaaggagaacagtctccaaatccaattaactatactctgcccattttacttttattcaaaaataataaaactattcctaggatatttatagagtaatagaaagtttcccttgttaatattagataaaagttaaacttaacaccattttaccaccttcgatagccttattacattttatttttactttgaagctcaaatttttaatattgcctataagcaaatggtttgcccctggttttttgtcctttttaaaaaaaatcccccacacactacttacttgtttaagcttctttaggtcttcatcaagttctaagttgtccaaaataacagcaacaaacaaactcaggaggatctataaaatggtgaaataacaatgaaaaaacccacatgccataagtatcaaaatattatatgtataatatagctacctaaaatatattgagtatataattcattaaatgcaaaataaacatgcagtgatgaatcattgcataggcatttcaaggtatttatcacaaatacatgaaataaaatgcatacgttcattgaaataatatgttaacttgctttatgaaaccaacttacttaaaaaggaaattaagaaaaaggtttttttgaactcaacaatcccacttgtgtgataatattctaaaaaagtgatctgaactattgatgaaaagcttaatatacacaggtgcttattagagggttgtttgtaataaggaaatattagaaataacatccaactttgcatgaatagtcaatacagttatagagatttatgtgataagatacatgcagccattacaaattcccatgtggtagctactcttcaagatggcctccagcgttgttctagactcctggttcatgcctttgtgtagttcccttccacactgaatatgtctggcctgtgtcatcagcaggttgcagaaataattgtgtgtgacttatgaggctaggcaataaaatacactgtgtctttacccttggtctctcctagatcacctgctctgtggaagcaggtgctatgttgtgaggatgctcaagcagccctctggagaggtccatgtggtgaggaactgaggcctcctgccaacagccactggagtgacccatcttggaaagaggcactccagccctagtaaaacttcaaggtgactgcagctgtagacaacatctcaactgcaacctcatgacactttgaactagaaacactcagctaagcctgtctcagattcccaaccttgagaaactaattgagataataaacatctatttcctggtaggcttctaatgtgtgggtaatttattacacagcaacagatacctaatacactggtgaatttttatggtgttgaaaacacattataacagtaaatacgagtatatatatatatatatatatatggtagaagctcaactatgcatataacggagtaatagagaaaatgcttgaaggaggtactttagaaatattaatggtacttgcttttgtgtattggagtaatacaatttttcctcttttaaaaaatgttatgattttctcagtttttaaaaaatgtatgcttcttttagaacaggtaaataaaataaaacaaaatagcataatttttaaaaatattttacgctgtagtccctcttcaactttgaatttttttaagtcccatattcacttgatcatctttttcatttctaactcatatttttcttttcagttttcttcttaatgaattattcccatttgttaatattaggtggttaagcatgaaggtcagaaagttgagataattcagccagtgctagagaagttattatgcagaagttaatggctagctctttttcaattttaatgagtatatcaacatgattaaattatgatgggatatgcttggcttgggacaaatgccagcacccttcttttcaacagccatgccctttggagtcttaccataacttgaagaagatacagaatgatctagaccagagggtttttattaacatcaccatgactggtacaccactggtaactgggcatcaggcttattctgaaccagacatcattccaaactggacattttaaagtttgctccatgttcagcccatttcccaatacctcgacgacagaaagtaatatcagaggcagagtctaccttcccctgtcttgatttctcaccccgaattctgagatgttcacctgctggtttccttctgcaggaggggatatcttataccccttctctcacacctgggcactggagcaggcattgttctgtgtcctaatttaatcatgtttcctctctctctagtgaaagtacaaacatgaatctaaaaaaaggggggtcggaagggatcctgttcgcctcccttttcttagagcatttcctttataagacttggaattgtaaattctttccctttctgtttgagatgtatataaatacttttaagagccaaataagcttctcaccagttctacaacctaaaagaatgttttccttgagggctgtctccttgaagtaatgtaaacatcaaggaagacaagagcctccgtctccccttctccgtagagggtgggagtttagacatctggctccaagttgtaaacctacctacttgtcacggaaatatgagaagttttaattttcctttggataaaggcaatcagctcccacagatggccaccccacttaccaggtgaatttaggataaactatatttaacaagtggtgctgtcaagccttcttacttgaggactagttatttctatcttgagaacacgtatggaaagcggtgatataaaagagggaggtattttctgcctccgtgatctctttagcagattgccagtgatgtgcattgcagcctgcgttagagctttttcaataataaaactgggctctctctcctctacctttaaggagaggtttcgtgggttggcaggagattttattcttaattatatcccccaaactggacagagggcaggctacttaaggacagcaaggctatgttattctattaaatttgacaaacagttgactggactccatggatgtgtgaggcactgcctggtctgatacataaatacaatattgcactcactgcagtgatgtttatcactgaattaagcagacatagaagagagcactgtgcttggagtcagagagctcaggtagcaaacaggctgtgccagctatgagccacgtggcaactgccagcccacagtgagtttcggtgctctcgtttgtaaaatattacaaatgtaataatagctcaacaaattgcagcttttttttcatttaattctccccgagcaaccctgacatgtagtatagctatacaatgtctgaaaatatacagacataaaattagttatgcaaagctaaaataaatttcttggtttttctacaaatgaattgaatttggtgcacaatccctccatttctgttgggggctggaaacattatcttgctacatcagttccattcagtcctttcaagctcagttacatttgaataaatgctccttttctttttagggtagtttaaggtcaaggttacccactacaagctgggtaatatgtcctccatcccccatcaggggaactgatgaggctgtacagggggtttggggctttctttctgctgacttgaccaccatctcagctcccaaagctaagagctctgattcccagtgatgtcctccatatgcgcttcctagagtactgtaacaccgtgcacggagttggtagcttcaaacaacagacatttatttgatcacaattctggaggccagagtccaaaattgagttgtcggcaagaccacactctctccaaaggccacgggggagaatactcccttgtctcttccagctgctggtggcctcctctgtccctcggcttgtggctttgttaacaccagtcacttggcctttatctaacaccagtcacaaggctttctctctgtgtcttgtgctcttttgtgtcttacaaggacgcttgtcattggacttagggcccacccagataatccaggatgatctcatcacaagatccttaatttaattacatctgcaaagactctttttccaataaggtcgtgttcataggttctgtgggttaagccatggtcctatcttttgtaggggcccatttaatccactatactctccacctggtcttttttttttttttttttttgagacagggcctcacattgtcacccaggctggagtgcagtggtgtgatctcaactcatgcagcctccacctcatgggctcaagcgatcctcccacctcagcctcccaagtagctgggactacaggcacctaccaccatgcctggctacttttttttttttttttattttttgtagagacaaggttgaccaggctggtcttgaactcctgagctcatgagatccgtggatcttggcctcccaaagtgctaggattacaggtgtgagtcaccacgcctggcctccgcgtggcctttggcttgggctgttgttcccacaacacatgtattagctctcaactcagggaaactcagaaagggctgtcattccacttggaactaacggagacttgttcttgtgggatattccgggcctctccaccgagaactctcaggcagctgcccaactctgccctggctgcccctggcccatgtggggcccccagcaaggttctctccccatcaggttccaagaagaattagggtcaagtcttggatgtcaaaacacacctgtgtgggtaccaacactgccgatgctcccaagtgaggtgtgtgggcatctcccacggaaacacgctttgtctctctctctctctgcatctgtctctctcatgctccatcccagaaatcagtcttatttcttctcagaaagcagaaacgtgaaagaaaattggagagcggatgggaagggcggccacgcaagtgtgaagaaggaggaccagaaatgaagccccatcataaattcacacatttagttctgtaccattttgaagcatttagacttggagagcccatctgggcacatgggccaggggggcactttccgaacactacttatcgaagattgtgagacaatgacagagagccaaggatgctctcccaagccacgcagatgccaaggagaagactgattttggaaaagagctgtgaggaacgcattccaggtggtgtggtgagggcctggtgagtaagtctggccagagtctggcttccaggcagagggtttggaggctggagaggaaggcaggatggacaggcgtcttgagtgccacagaggtcacggataagagagggaggctggaataatcacaaagtgatgacatcagtttctttctgctaaatttttccttttaaaagttctggggctttttgtgtgtgtgtttttgtttttaatgcatgtaatgcagcaagtttaaactggctcagctgggcatggtgactcatgcgtgtaatcctagcagtttgggaagctgaggcaggattgcttgaccccaggaatttgagaccagcctgggcaaccctgtctctcaaaaaaaaaaaaaacaaaaattagtcaggcatggtggcgcatgcctgtggccccagctacttgggaggaggctgaggtgggaggatttcttgagcctgggaggtcgaggctgcagtgagctgtgaatgtgccactgcactctaggcctggatggcagagcaagtccctgtctccaaaaactaaaaacaaacaaaacaaaaaaataaactggctcactgaaatagtaactagacaaggttaagtgcagtttgacaaaatgttattagatatataatgttttctagccgggtgcagtggctcacgcctgtaatcccagcactttgggaggccaaggccggcagatcacgaggtcaggagatcgagaccatcctggctaacatggtgaaaccccgtttctactaaaagtacaaaaaaattagccgggcgtggtggcgggtgcctgtagtcccagttactccggaggctgaggcaggagaatggcgtgaacccgggaggcggagcttgcagtgagccgagatcgtgccactgcactccagcctgggcaacagagcgagactccatctcaaaaaaaaaaaaaaaaaaaaaaaagatatgtaatgttttcttacattggttaaacaagaaactggtatatactttttccttgggataaacagagaaaagccaccctcagagcaggacagagagagccacggcatgccagctgcactgactcctcaaggcagatgcatttgatatttgctgtggataggagaaggcaagactcctaaaggaagagctttggcttctctgggaaaacgctgcgtgacttcacaacaggaaggcccaaacttaaagaattagaacaaactcttggggaggcaacaaatttaaaaataatataataaagtttgaagtttgcttgaaagtagcataaacctaattttattcagcaaatatctttgtttaggcatcatttttcaattaatttgacagtggcatgacaaaagcacaaacttacaaaacagaaactggttcaagatgtatgtgtgtggtagggggcttgggtttccgctgaagccctatttgaatgtggactttcagattgatcctcatcaaactgtccctggcatgtagggcactgtgataaggtggcaactggcactccgggtgagagatgactgaagtctgacccaaggctttggctgtgtctttgcaatggaaacagaagattcaggaggtgcagggtgagtctgtagctgattgccaggaggtgagaatgactttgcggttcttttctcacagactctaataaggtgacaataagcactgcgataaagggtagaagtgaaggaagaatggcagcttggtgtccatcatatttaatttatgttatcaatgatacagtattttcctacaaacccagtgcaatgtggatttggactgaaagagcaggtcgacctgggtgtcagacacttgccaacacatggtatggaaagtcatgggagtgggtgacaagccctcattctgaaaggaagaaccatttttcagttctctgagtgttctcatttattctgtttttacagaaagctgaggtaatgctcattagtaatcagaacccattacagcgatgtctgcatattaccttcagctaatgtttacctacactaccacatgttgctgtgccaaaaggtttttctatagccactaaatgtgatttacaggttcatattaaaacggtattgatgtaataaaggaattttacagggacttgccacattaaatcacaggagtgtcatcatatgtataaaacacttttacctttgtgttttgactgttctaaattatgcaactaatttgctttgcattatttatttcttaatatttagatttatgtgatatttctattgagtgattgattgattgattgaggcagagtctctctctgtcccccaggctggagtgcagtggtgcgatctcagctcactgcaacctctacctcccgggttcaagtggttctcctgcttcagcctccgaagtagctgggattttaggtgcctgccaccacaccaggctaatttttgtgtgtttagtagacacagggttttaccatgttgatcaggctggtctggaattcccgacctcaggtgatccacccgcctcggcctcccaaagtgctgggattatagggggagccaccacgcctggcccgatatttcaatttatactgcagcaggatatactatgtccctatttttttttaatgatataatttcaggggaaaaaggctaatgacaccacctttcatctcctcttgaaccctgctaagtacatgtatgctttcaacacagtggtgtttagtttgtacaatgctgtaaaaaagaaagccaaatatctattttttcatgcatttactatttggcacttttaacaggtctatagcgtttgatcatattaatatgcaacacagcatttgtcctactgtgtaatatacagctgatgtatgtatccactttttaattttatgaccgatattgatacattatgaatcagtgatgtcaatgaaaaagtggagaataacaatgtatttcagatatctaattctttatttccctcagattataatgcccattgctaaggtatgtttagcattgacaatgcattcagtgtggaaaatgccacattatcaggcctgctgaagtctgggaagtctctctcagaatatttatgaatgatataataggattttgacctttcagcttagtggatttcaaaagcgtaattttccaggttcaaactggtacctggaccagggtctcacaggcgtttgatttctctaatattctttatgacgctcctctttctctaatacctcctcttcctttttctcctctgaaacagcccagattcacctcagttaatgctgtggtagttatttgctctgtttaagttttatacatgtgaccacagatatatttattttttttctatttaactacaataaatttcagtcaaattcaataaattactgaaatagttgcatttgcaagtataattatttcttccaattttgttgtgatgcagatcattttgtccaacataatgtagttctcattccctcggaataagacttttggattagcatgattcaaacagctgaaaagtatgatttatttttgcaagagggcagccttgtcattcacaatggattttctggttgaaaatttctctccctgcagcaacatatcctattttacattctctctgactctgcagatagccatgaccttaccctatatagctttcccttttcagttttctttctttttataaagtttaattttatgatttttttccttttatatagcttaaagatgtccctttagctgaaatttcacctttaatcttattttcttctttgctgtgaactttattaataatttcttatctttaaattattttgaaatatacactagaaacacagcaggaatcaatgtcccacactcttgtgtttttcttttcctgtttaccatttataatcaccctatcctaagctgtcttgccgcctgtggtatgaaacaatttcactttttatatgggtcaacaaaaagtcaaatgtaatcagcgcagtgtaaaatgggatacgttcaacacagatgcacttttaaatgaattctatacaatcaagttatttaatttacactttggaatgcccatttgtgtcagcaaaatatgactattctcagcaagctgccactaccgaggcaaaatcaagagattgctgtgttaatttcagcacttcaaaggtaacaaaaagactacccacaatgaacgcttaattacattttctttcttttcagtattcacatcacagggctttcctttgaaacagtaatagacagaaaaacattgcaggaaaaatggagtctttcaacttgttaggtcttccatagtccctatccccaaatcattggcaaagatggggaaaaagatgaatttaacaagcattcaataaactgcaatcagtcaggacagaaatacagaatacatacctggcggaagagagagatgtttgaaagggacaatacatggaggttatgaatatgcatttgctatatacttcagcttgattttcattgtgggctgaaaattggtgcccccaggggtgatgaaatagcctgctgttctttattccagaacaagctgcaaccacacattttatttttcgctgcttggcacatgcctgtccctgggaagactaaatcaggaactcatcaagttgtatggcaccactgttcggtgtgaacaaaagacacatcagagcttgtatgtttacacagactactttttttttcccttctcacccatttgggttaaaatgcgttgtagcattttgtaaaaggaaacatacaattaaacaaaaatgctcattttaaggtaagttcagctctgaagacaggcttatggaatattttaacttgtgaagtttagtttttaggggcatgcaatgtgtgtgtaacacagacctgtcaccctcacgcatgtgtttatatgttagcccacagactatctccagctgtttcactgccactacttttgatatttctcataaggcagattgggaacaactgggaagcagatgtttattgatcacatagcaagtagcaatgtacacatgcctctcttaccatttgcatctttaggccttggaaccactggttttatttgtttgttggttagcctgtctgtgttcgttattgctaatttccaattatttgtagcccctaagaggacatgaattaagctctttcccactttggccaggacgtaggttagtacctgcacgtggtagtagaggttcagtaaaactgtatcaaatcaaattgaactcacttcataaagcccattacagtaactgttagtctaagggtacaaaggaaaagagaaacaactgctgaccatgttttaagcaaaattttttgtgaactggggaagtgacttcagtattagactttttttgggtagtatagaagtgataatctttgttttaatttagttatatagtgtttccttttattaaattatatatcatttaaaaaataatttagaaatttaaaagtttgaacagtttaccttttttgtgttagacttcataatcagataaatcaaataaatattctaaaccttgcagtttctcatataaatctgagaaaaattgatttgagttttatttaaacagtatatttcatctagcttatgctatatctaactagtaagtagagatgagctaaagacttaaaggtgaaaagcaaaaattgtaaacaattagaagaagatataggagaatatttgtattacctcaggtgggaaagaattccttaagcatgaggtcaaaataaatacagaccatcagtgaaaaaccgatagttttgacctaatttgatcattccacaatgtatgcatgtatcaaaacatcacgttgtaccccataaatacagtaggccccccccttatccactgtctcactttctgtagtttcagttccctgtggtcagccacagcctgaaaatattaagacattttgaaaaggagagatggagacagagagagaatgcgtattcacataacttttattacagtatattgtcataactgttctattttgttattattgttgttgatttcttactatgcctcatttacaaattaaactttatcaaagttatgtatgtataataaaacacatagtatatatagggttctgtactatccatggtttcaggtatctactgggaatcttggaaagtttcccttggggacaaaggaggactactatatatacaattattatttgttaactaaaaatgaaataaaaatatatagaatgtcaaaagacatcacagacaaactggaagacaaaatactgcctaagagaggatattcgcaacacatgtaatagtcaagagattaatatccaacaaatatccaataaatgagttaagacaaatttgtttttaggaaaataggtaaagcaaacaattgagtcacaaaaaagatggtcaataaacatagtaagaggtgctcccttattaataattatggaaatgcaaaaatgcaagcccaattgataccagtgttcactcataagattgccaaaacctcacatgtcaaacaatgtgacgtctaagtgagagtgtaagaacacaggaattctcaactattgcacttgggagggtaaattagcacaatttatctatagagcaggagtccacagtgttttcttaaaggtccagacagtaaacattttagacgttgagggtcatgaggcaatactgaggatattctgtgggtacctgtataaccactaaattatagaaaccatttttagctcacaggttgtataatacaggtggtgggctggatttggtatctgggcttgcaggtccctagtatagagcaatttgggcagtacctaagatctaagcattctacttttggacatatatcctagagaaattcacataagtgggcacgatacataaatgtattgcagcattataaaagtacaactttggaaaacagcctaaatagccatcagaaagggaactgataaacaaatatggcatattcacagtccgcggagtaccatacggctctctataacaatgaccaaattagcttcatgtggagtaagataaaaagatctcagaaaaaaatagccagtgaaaaatttaactgcagaatatatgttgagtttgataccatttgttctaaaaattgctgccacaaataattgataaggagggaaacacatgaccatgtataacttggccccagcatggacttatagggagagaagtatgtattaccagaccactcccctagggatggccatcagttgactggagcagtgctttgcaaactaagaaaacttaatattaatcttcagaattttgggcataaaatgtatttagatggtaaccttaagtttaaaatactatatgtatacatatatatacacacacatatatatacatatatacacacacatatatatacatatatacacacatatatacatatatacacatatatacacacacacacgtgtgtgtgtgtgtctgtgtgtgtgtatatatatatatatttttttgagatggagtttcactgttgttgcccaggctggggtacaacagcatgatctcggctcactgcaacccccacctcccagattcaagtgattctcccctgcctcagtatcctgagtagctgggcttacaggtgctcaccaccatgcctggctaatattttgtatttttagtagagatagggtttcaccatgttggccaggctgatctttaactcctgacctcaggtgatccacctgcctcagcctcccaaagtgctgggattacaggcgtgagccaccgtgctggccataaatactatatttttaatggatgcatatatgtgtgggaaacctctgcatttcattgattttaagatgcacatttactttcaccttttaaaaactctgaagtagggatgccccttatcctctatgtgtatagtttaattgtttttctctttagtgttacacaaactgagtcttctactgaatgacagaatgttaaatttagtgaaatatgttctaaaaattggaaaatgaatttatattaaaattatcagagtcattgcctgggagaagaggtatagggaaggagagaaagaagaagaatggaaattaattcaggaaggggcataaatgataccctaataaatgatacttgcataaattaaaaatatctgaacataatataaatttaacatttattaatatatggctttaaatgcacaaaccgtcttatctacatttaaaggggctcagtgctggtgctctaaaacatcctcagaaatacagggttaactcgcagatacatgacaaccttggaaactgggtgtattgtgaattattatcctcactttccgatacaaacaacagagagatcagggaagttatgtgagtcttcagaaatcagatatcgagtgaccagcagagctagaacctgaatctggatttttgccttccaatttcatagtcttgtacgacaccacatttaccaaactgttctcgttaacatgtagacttctgaattctcaattgccttacagacttttaaaaagtgtgaataaaagaacaagttatttcaattttcagttttaacttataactgttgtttgaaaattgcaataaaaaagttagaacagatgttttgggtagatacttaaatcagtaagtggaaagagtagaattagagattggttttcatcttgtgctctgtggattcctaaagcctcaggtgaaccccaggagtccttggatgaactttaagtgatctataaccaatgccatattttagcccataaagaagatttagattgcccaagaaggctatataccagttttaatattttattttattatattagtgaccccagtagaattttcacttgaaaaaatattactttactaaataatgtaataggctagttttttcttccagctttcattttttgtgtccctgatttaagaatcaaacatatatctgagtgtgaaacattttcagtgaggaaagtaaaccattttgttgctttattaggaaaacgattaggttgattactataaaataattagattgatattccctgacatagatgatttcaatgaaatctatcctgcatttaacccacaatcaacagtctgagcaattccatagttttagagtaacttaaacacaagtagcttaataaacttagttgaacgcataaatgatgtgtaaatgaatggatgaatgaataaatggcacaggcttaaaggtcctggaagggaagatgcaaagaccccagggctaagtgttgtgcaaacaccagcacagccagattcagctttgcaagccaggcttccattcctattgcacaatgttcctatctttcgcgtaacttttaaaagtcaactccatgtataaaaaggccaaaactatgtctatgtagttctactgtttgagcccatgacttcacaccatgtaacaatgaattctcattaactttttggtggacatgtcttagttttgaaagcctctgtctgtctatagcaaacacaacttctaagttatatctagtttatcaaggacttatttcattcatagatatttagaattaaaactgaccttagagattatatgtaatttgtttgatgtgagtgattctttggcagaagtttgatttgacaaagacattttttcagacaactttaaacttcattatccagggaagcaataataattagctgcaagactaaggaccaaatctagatcagacagacctgggaacactctggtcatatttacattccatgtgacatcagataaattactaaactcttctgagtatcagttttatcatctgttaactgggaatactatctaatcgggtgttccaaagattagcaataatattgtaagatattttgtaactgtaagacatattgccaaaaacaatagtagcagttgtatttatttcttgtattcctgataaagggaaacatttgagtcctcaacttggaacttctaacgtgatgttagaacttaggtttgcttcttaaatatgaacaaatttattacatagagatgagcatttggtattacattccttagtaagtcacaggctgcatttcataacattttttctttgtttttaatggaagtatattgaagagaaaaatctgcttgtgtgacagaagtcggttcttactggactttggtattcagttttcttgtgcttttacaatacttgcagcaatgtgttttatttttttccatgtgtttttttccagtcgcacatagcacaaaaccactgtgctgatttctaattaactgactgcaccctgaggtctatagcttctgtcttcagtttaattacagctgtgaagaggatgcagtgaaactgaagacagtgtctctacatgagaaaaaaaataataatggagttccggtttgatcctgagatcatctaggtgtgaatgcttggggatacttaaattggtatgtaaatgtgagattttcattttgttctgtcttgttttccctcttacaaacactggtacctgatggagaaaatatctaacttaacaaatcaagcagttctttgatgtgtagaaacttagaatggaaggagggatctcatccaaccagattagtctgcattagtcctttggctcccattttgaaattgacaataggccaaatatctgttgatgttcatcccattataaattccaagatataattgaaaaaaaaatgctgaactcaccagagtggcaaaaagatgatagagaatgaaatagatggcaaccacgggtgcccacatatgtcccacagcatttagagtttggtccattacgtccacccatccttcctgggtgaggatctggaacatggacataaatgcctaagaggaaaagaacaaaggtattacacactagctttaggcttgcatacaacttcaaattagcatgtgatgtttgaagactttgatctcaatattattgatttttatctgatcagggcaagaacagtcttgattcaacacataggaaagatataagaataaagatcttaaaaatgtgatatttaactatttgatgtggaataagaaaataattaccctgaattaaaattagttttgttcgcagtaaatgctgttgagcaaattagaaacaaattcaagatctttggtttttgccgttaatttttttcctttcagcaagctatctaacattttcaacagattactttttctttgttcctgctgctaagagaaacttatttttatagtgaattacacttgtctaaggcatataaaggcatataattttatttttatggtacctttctatcatattattttagctatcatattaaaaacatgggactctttaaaaaagaaatatttctaagtgatattgccacactggacagcttgaagacaaacacatttttcatgatttaaaaaaagtttcaaggcacagggtcaagatcatggaagaagccaagaccaaaaaaacaaacaaacaaacaaaaaagaaataaaaaatagagcattccaacaaaggccagccaagctaaaaatctcacacactttctgccaatatctttggctagtttcattcttacatatttttctaattaaatatatgtgtatctgtgagtctccaactcatgtatcctatacacattagtagtcaataaatactttttaatgagactatgatgatatctggagcaagttgccccactggagtctagtgactctttaaaaacatctttatagacttcagtacgataaagacataaattgaattctcagatattgggattccaataaataaagtccaggataatgcaaggatggactgagaccaagacagaaacccagttacactgggggacctaaagatagacctaatctggtaaagatgatttcatctgattccttcttttttttttttttttgaagataaggaaaatgaggctcaaagatgttaagtgattatcccaaagtcacactattaatttctggcactaatagaagtagcacccaggcattaggactccaaagtaagtacttttccaaatattgcatcctgcattcagtgaagtctacccaggatctaccaggcctaattacatagtaatctaagtataattttcacacttgatcttagccaaaaggctgagaagcgacctaactgtaatttccttcagtaaggataacaaactttcttagaggtacactgttcaaggcccagaacacagtggacctatttgaaaaaggagcaattaattgttaaatgaaccacgaactagaagataagttcttccacttatcctttgtccatgtgcaaagtaattatttttaccttgagttgatttttctataatctcattaccttatgaagaagtgttttgttcatgaaaatatgaagcgtgttgttattgatacttgaccgcaccatcaccaagggcaatatactatttttcttgttatggtgcccaagagacagccactctctgcaaaaattattccttctaaaattgcttttgagaatttttcaacacatcacttatccttataagtatttcagaactcatcattgagggcaattatttttttcctgtattttttttctcttgaatatttattgtatccaaaggtgaggaacacgaattccaaagatgattcacataaaaatatcagattgctgtattttcttcaatgaaggtatcggtgtgaaaacatgtacatatcctggagattcaacagcaataggtgaagagtcaaaatgcctgccagtataaaagaaatttcactggacatggctttctttccccaaaagtagcaggacaactcatgattaagcccaacagatttattttggtatctggagactaaaaatgtaagtgcacctttcagctgtcttgggcatgaaccagctgatgttttctcatctgttgcattacatttgatcaacacagtagctgcttgggaacgtggagttatgggattgtaatctgttgttgtgagataagcgatgtgggcaagagcactggggttatcctcttttcatttcagagtctcgggagaaaaaaaaatcgaatttccacacagctcaaccacctgaaagctcatattgtgagatgcactaaattatatttgcgaacaaggctttctgtgacaatgggatctgtgtgtttatggctgctgaaatgaataaaccaatgaaaggtagtgccaacaaatacttctattagaggctgaaaattaacttgtgtcttgcttgaagggtgccttatcagttttgtggagatttttatccagaaatttaaattcaaatggtagtgtgcttgagatagtgactcaagtgcacttactgacttacattgtccgtagggcctgtgctctttatttattcaaacaaggattattagtggttactaaaggtttgatgcattggggattgagtggagtaagacatagtttcttcccttaagaattgtataattgagaggggaagaaaaagatgaacaggatcaattctcaaaaaggaagaatactggctgggcatgatggctcacgcctgtaatcccagcactttgggaggccaaggcgggcagatcacttgaggtcaggagttccagaccagcctggccaacatggtgaaaccccgtctctactaaaaatacaaaaattagccagttgtggtgatggtcacctgtaatcccagctactcgggaggctgaggaagaagaattgcttgaacctgggaggcggaggtttcagtgagctgagattgtgccactgcactccagcctggacaacagagcgagatcctgtctcaaaagaaaaaagaaaataaaaagaaagggaagaatagtaactttggtgtgtaagcaaaatatggttaaagtactgaggggcaacagagaagagccaatttagtcctcttgggtgaatcaagaacagttttgggaaaatgaagcaactgacctcagtaatgcacaggagtagagtttcagtggaaagaaggcagagaggaagttgtttctctgaactacctattcgcatgttattccatttttctgccctgttgaccattttattttctttattggtttccaccaactctttacaaataagaaaacccatcttttatctgccatgtatgttcagtgcattttcccctatacatttcttatatttttgcaaagatcagttttaaatttcagtgtggtctaatttgtcattccttttaagtgtttttattttgcttaaaaagacttctctcactgcatgattagacataaatttacccatggttttatgcagtagtttgacactttccttgctttattattttaaacatgttgaacctgaattggctgtttaaatcagtttaaatctgaaatttattttggtataagtaatgagacaggaattttttgttttcacttctgatggcgttatgcctatccctatttaggatttcttgatttatccactttagacatagacttctgctatgatatgtgaagatttcattcaggcacaacatcactccccacttcccttaaccactcccaaatttggatgtaaatctcgatttctttttccatcaaactagaaagacttgaccccttccagtgtgagatgaaggtattaccattgccacttgtcaggtcacctcttctctctgctttcattttccatctcgtgtcatgtatacatttatatcctcaagtttgacaatatttacattttgtttttctatcataattgggtcatccgtgcttctcagcaggttgataatcaatatgttgatagtcaatgtttcctatgaaaacattgctcactcttgggccaggtaatgttctaaaattatacttccccctccaagactctattagacagtaaatggtcaaggttaaatggaaccttccttactttccattaattgctcagaatctgggccaatttaactcacgttatttgagccatttttttttaatacaatctttggtttggttttgtttttgctgagattttctgactatttctcacatgtctcattgggaaaataaatatattctttctttcttctatctcaagtagcttccagattctcacacattacacttatcatttagaataaacccttcttactatcctgcagatgttctttctttaaaccatcaattgcccagaaaccatttgattcttactctcatagatattattcttggggtcctctcactacctgttttaatttgaactaatttctttctagactggttccacagttgccaaaatttccacttttaacattattatctagatctttcattctttctaatacaggggcagagaattattccagatatctcatcccactcattagcatcctttttcaatttatcaacgaggttttcttctctgtgttttactgtttcagtatgaggagaggggtacagggagagaagtattagctgaggctgtgtatgggcaattatgcttgaaatatcaggcttcagatatttcttcaattcaggtaggttcaggaaatctttattgcagccagaactaatcagtcctaagtgttcacttccccaaattcactggcctctctccagccatcattcccactccactgactccaggtgagggagaagtcaatgtcctcctgttggttttggttctctgtatgggcgaataggacaactcctggggctttcgacacccctctttatcctgagcttcctgtactcttgaagcttctgtttttgtctcttcatattttcattatgctacatttttgtagcagaatgggagatgattcattttcagaaggtatgacattttgccttcactctcaagcctcctcagctgaaaaaaataaaaatggtgagatctagtggattattttgcctctggaacaagtggcttctatacatgagtggttcttatcactttccagggctctgcatagccctttggccacagacttcacagattggggaatttgagtatacggtttcgttgtttttccaagtttatttcttcttaacttcttccagaagacagtcttaagggatgagcctagaatattcatgttctctctcattctcttctcctcctccgcgaccctttccttttcctcctccttcatctttctcttcttttctttcctcctagctgctattcggagaaaatggcatgaaattgtagctcttccttactgtagttatgctggtataattttctcaggtcattttattcatttccttaggttttattagcaggggagttgggtaattttgctattttacccctcaagtccaaacctatacatgtaagtatgagtaaacaactgtgtttacaagtgctattttgtttgctgctagtaacattatcacatattaaacatcactatacgggtcaatcactgttaatgctgcagatgcctccctgctgataactgcaccagggatgagcagtttacttgagaatggtccagtttgctatgaggtgatctggaacaagcaactctaccctgccagggaagaaataagtaaatcaaaagcatctctagtgaattttaatgggaaactatgaagaaaaatcagattgccaacagtaggctctggaagtgaacaaatgaatggagatcagccatgcagttgagtgggacaacaaaagggaaattacaaagtcaaagttgccagcacattgatgttcccaggaatcagtctctgcatgaacagaatttaagtggaaaagaaaacatattgaataaacagactgcaatgatttttacctaatggagaagaaagattttgaaaataatgagctgagttcagttgttgtttctaattagagtgtatcatcttccttggatatatgagaacagggtgagaaccagagagtagagggtgaaagcacaacaggaatgtatgaggaatcttatgcaaaaattaattcaagatggaataaagacttaaatgtcagacataaaaccatgaaaaccctagaagaaaacctaggcaataccattcaggacataggcatgggcaaagacttcatgtctaaaacaccaaaaggaatggcaacaaaacccaaaattgacaaatgggatctaattaaactaaagagcttctgcacagcaaaagaaactaccatcagagtgaacaggcaacttacagaatgggagaaaatttttgcaatctactcatctgacaaagggctaatatccagaatctacaatgaactcaaacaaattataagaagaaaacaaacaaccccatcaaaaagtgggcaaaggatttgaacagacacttttcaaaagaagacatttatgcagccaacagacacatgaaaaaatgctcatcatcactggccatcagagaaatgcaaatcaaaaccataatgagatactatctcacaccagttagaatggcgatcattaaaaagtcaggaaacaacaggtgctggagaggatgtggagaaatacgaacacttttacactgttggtgggactgcaaactagttcaaccattgtggaagtcagtgtggcaattcctcagggatctagaactagaattaccatttgacccagccatcccattactgggtatatactcacaggattataaatcattctgctataaagacacatgcatatgtatgtttattgtggcactattcacaatagcaaagacttggaaccaacccaaatgtccaacaatgatagactggattaagaaaatgtggcacatatacaccatagaatactatgcagccataaaattgatgagttcatgtcccttgtagggacatggatgaagctggaaactatcattctcagcaaactatcacaaggacaaaagtcaaacactgcactttctcactcataggtgggaactgaataatgagaacacatggacacaggaaggggaacatcacacactggggcctgttgtggggtggggggaggtgggaggtatagcattaggagatatagctaatgtaaatgacaagttaatgggtacagcacaccaacatggcatatatatacatatgtaacaaacctgcacattgtgcacatgtaccctaaaatttaaagtataataaaaaaaagagttggaaaaaataaataaataaatcatgctgctataaagacacatgcacacatatgtttactgtggcactattcacaatagcaaagacttggaaccaacccaaatgtccaacaattatagactggattaagaaaatgtggcacatatacacaatggaatactatgcagccataaaaaatgatgagttcatgtcctttgtagggacatggatgaagctggaaaccatcattctcagcaaactatcgcaaggacaaaaaaccaaacaccgcatgttctcactcataggtgggaattgaacaatgagaacacttggacacaggaaggggaacatcacacactggggcctgttgtggggtggggggaggggggagggatagcattaggagatatagctaatgtaaatgacgagttaatgggtgcagcacactaacatggcacatgtatacatatgtacaaacctgcacgttgtgcacatgtaccctagaacttagagtataaataaatatatatatatagaaatgtcacagggatgctccgggtgaaaacacagagaaaagcagtgaacaagcatctttcagtcaccaaaagagccagagcactgcactacagagccacaaaatccaatgccagccctttgcatgctcctttgctggtttctcttcaatttcctaatgtctaaatgttacagagctccagtacttgacctcagatcttttcttatatctcaatactcactacctgcttgatctcatccattgtaatgccttcacatcccttgtatgttctgatgacttccacagttatatttccagccccacctccagaatcaactccacatttttacttggacagatgttagataacaggaatctcaagtatttgatgtgtcatatgaaactcctcatgccccactttcaaacctgttctttctgcactccttcccagccaagaaaatggcaaatctattcttcaagttattcaggccaatgaccctgaagacatctttggttcatctcatttcctcacatcctacatccaatctttcaggaaatcctgctaaatccaaccttagtccttgcttccagttctgcatttgtccctgatcttccttgatattacttccaaaacagataacatttttcccctaaatgccctcacgctttggtgctgtattttccggttataagttgagattaagagcgtcggataaaaataagaccaccaaagagggaagaaagggggataagcaaaagtttccacagcttctcttttgttcctagcaccccttaaacatcaacataggtgggctaggccatgttgcctacactaggcttcccacagggccactgaggacccatgccatagggtcatggcagagccagatcatcaatagcagaagatccttttctctctcaagccccaagaacccatttctgaccctaaatatctctaatagacttccttagagttaggtgaaggcaaagcaagggtattttcctatgctgaaataaacaggctgaaagatcatgcaaaggagttttaagcccttaaaaaatatcatggatgacctttgaaatttgatgactcaatgcatattttggtattttagtatgtgtggatatcaatttaagttcaaacatagtcaaatattaagaaaaagtagaatggttaaacatcttgggttttggtcaaagtagagtaagtagaatatatagtaccatccctttgctatatcccaagcacatagatatgcttttgtgtgcatataaatgcttgaaagtgtatacaataaacctgtaactctaaggactagaatggaaaggactaaggaactatggaaggggtctatactattttttttgacttttaaaagaaataggtttttgagatacaatttgcataccataaagttcaccttttaaagtgtacgattaagtgggttttagtttattcacatggttgtgcagccattaccactatctaatttaagaacattctctttatccccaaaagaagctacatacttgttagctgtcattctccattcctccctccctcagcctttggaaatcaaagacatctactttctgtctctatggctttttgtactctggatattttctataaatggaatcacccaatatgtggccaggggtcatccatgttgtagtatgcatcggaacttcattcccttttgttgccaaataatattttattaatggatataccacattttacctatttatcagttgatatttgggttgtttccaccttttggctattatgaataatgctgttatgaacatttatatacaagtttttgtgtaaacatatgttttgataaattacttctgactttttttttactgtttgtactaaaatacgtgtaaaatgtacattttttcatttaaaaatatatacactaaaaatgttaaaatgtggtggggaatacaactcgtatcatccacatataactttgattttacaacataacttgtatcaactttttaaatctttaactggtttcaagaactctttctctacaaaaaaagttgctttcaaaataaaatctacttgatgatttatatagtagctcaacctttttattgagagagtccctgttatatcttactataagacagccctaaaatagaagacttgccttgatggtattcactgagtgcaaaagtgacttctcttctgtttttaattgccttaatgattcatttactcagtctccttgtttcgatttttcccaaacagcaataattagtagaatagttttatcttcagaaaaacccactgacctcataatccgttaatattttgttttataattcctttgcttttatttaaaacttaattcagctattcaaagctacagcaatatttaggataatattgatatacagtaaatgctggtcgtacctaatgttggggttacatttctaaaaagtatattggttggcaaagtcataactgacgggatgaagatcttgtggagaattaggggttaaggaaaaccaatgaagatgacatgaaatgtatttaaaatcctatggtaaataaaagctccagaagccacaacttactatggctaaactaaattgtacctaaatacacatagtgtggatttggaatttggagtataaatatagtactgttggttagagccattgaccatagctatttctttatttcagatccctccaattcaatcacactcttcccagttcttcaaattccatctctctgtctttttttgtgaaaccctcaggaaaaatatcgattcctaggtgaatctgatactccatggctgcccctagccatccagctgccctgtggagagagctatatcccagggaaatgggttccctcctcacacagcctccaaagggacttcgacactgccaacaaagctcctgctcccattagtacatgcctatcagccaggagcttttcaaagctgctccccctggtgtaacttcagccacctccatcactgctctcactctaaagagatcacctttctagaaggaatggctgagggactgcgtttaagatagagattgaatcgctgagtatgcagaccaggatgctctgtaagccagcagatcagtgaggtcaagaaccaagtactcagcctctgctttcacagcgtctgagtctaagtcaccgacttacttaacggctttgggaaaaacattcagccgtcctgagaccagcctttctcaaatatgcaatcccattgtcactcgaagattgttttgaaaatcaaaataacatatatgtgaatactttaaaaataataaagcattatataaagaatagttgaaataataattttgaaatctgccttaaaaatattgtcccaaggaaaagcaacttctatcacagtggttaaattccggaattcctatgttttcttttttttgagacagagtttcgctcttgtcgcccaggctggagtgcaatggcacgatcttggctcactgcaacctccaccttccaggttcaaacgattctcctgcctcagtctcctaagtagctgggattacaggtgcctaccaccacacctggctgacttttgtattttttagtagagacggggtttcaccatgttggccaggctggtcttgaactcctgacctcaggtgatccacccacctcagcttcccaaagtgctgggattacaggtgtgagccactgtgcccggcccagaattcctgtgtattctttatgacttaaaatgtttggtcatatatggtgtgattccatttttataaagttcaaaaattataaaggataaactattttttaaggaatttcttttagatacataattttgaaaatttgacagtgttttcaaagacattatttcctttcatctttgaagtacacgatacatatcttccagctataaaggtctactattctataatctattaactgttaatgacagtcaattggaaaattttgttttttttacaatatactttccagtctatttttccaagccagatcttacctataaaagttaaacaaagaagctacagtgacttcttactaatagatgctatgaattgccttttggtgctgtcaactcatcagggtcttctactgaatcaacagtaaaaattgcagttggcaaattgactgaaaataaggaggcaggtaaattaagtgctttgctctatgtcgtaagtcatcacatgactggatgttaaaacgcaatggaacactaactgaattttggtgtagggtcctagtctggggagtttaattatgagtgacttttaaatgataaagattttgtagctatttttatacatatctctctatgtatgaactcttttggaattagagatctgttgaagtcaattacctttatgttaatagaacttaggcgtttaaaatatcactgtatctgtaaaataattccttattccttgtgatttaggaggaaataaagttgaaactggtggtttcagttaattctgtgactgccttttatgttggcaagaaagaccaagtagttcttttttcaaaatgaacccacattatttattttgcttttacaattcccaaaatatgcttgttgccaagcataccacttaaatgaataaagagagaggagaaaaaaactgtttattgttcaaattttagatgactaaggaaaagtcttctgaatctagacttttgtaattggccttaaatgtcaaaatgagcttgaacataattagaagcaaagcagacatcagaacattatgcctattccagcagcaaattactttaagtggagtctacacttaaatataatttcaagagtaaaagaaaaaaaaagtaacagaagcacattggcaaaaaccagcgaatctttttgctagttatgaaaatatatgtaggtatgtccaattgtctctttccttggctatgcttgggttaacttttatgtattataccataaatgacagctggacaaggtcatgaatttgtactaggatttcattgcagctaagatgaaatgatatgagaacaggcactgaaccaggactagcatttgtatggtgctttgcaattcccacagtagttaattgtccattatttaatataatcttagcaatgaccctgtgaagtgattactgtagatataatggcccctactgcagatggagagctgaagtacatagggtttaaatcaagaactccagcttacaggtagcaaatggtgttgctcagtatccaggctgagatctcttgactttgattccttctgtgctcttgggtgttacaggtaaaagacatttaagatctaataattgctgatccctttccattattaaaattaataaaacaaagaacatacatgcatattctcagcaatatctaaaaattttaatcctcttttttccagcacacctatattgcactccatataatgcttggctgattaatgaaaaatagatatcctcagtattttttactctttgctaaaataagctctactgattaacatttttatgtatgaacacataacctttttatttttatgaaaatataaaattacaaaatatattttaataataaaaatatttcagtaatttgagacttaaagttcctgtattagaaatatttattttaaggaaaaatatcaagatcaactgaatgaacttatattttacccctgacaatctttcttgcagagcatggtatttttagttgaaaggtatacttcccaccgattatgttaaaataatgttgaactgcaaccgtctagctgacaacaaacagctgtgaaaatgagacctggagatttatgcaaataggggacttttgaattaatgctcttcatagaacagactgtcaagtttcttggagtacttatgacctatttcttaataagagattttgctaatgtcagccatattacatttttataagttaaatgcatttcattgtcaatcaaatatgtgctataaaattgtacatgaaattgatattttcatttcagtgcaatgataattactaatatatacaaaacagtgcttcgaaaaacacagatgtatgccccattgttaaatggaggattaattaaaaatatttccgtaactaaaacagcacagaatctacataggaaatttcactatgttctcgcaatactatgctcaaaaataatatttttatatttagctttaaatagaaagcagctttggtcagagaaatgcttatgttttgcatattaaaataaaccacacttcagacatggagtttgcctggctattgttcttctctttacaaatgtggaaatatgactactattttctctgctcatttcctcatgcccaatacttaatttttaaaagttttaaatctgagattttctaaaatctcacccaattcctgccttcctccctccctgtatctttctcttatcatgtgaaaaagtaacctgtgtaatcaactttgatttctcatttctcttcactaagctcacaaataaagagctttatcaaaaatgatgtggtcttttgcagatataaatttcaaagccacacttctaatagtgcttatttagtactttaataccttaaaaataaacttgatagctgtttatgaataaacacttaattgaaattattttactttaataaaatattttacaagtcaaaaacctaaattagttttattgtaaatataactagcatgtccgtgtgtgtgtgtattttctttcttttagaactttacctgttcatgtacttgccatttaaaaaatagtttttttctcactgatgtttaactataaagtaaggttttatatctatttgtttatcagtccacctgtttccatttttgaagattttcatagtaaaaaatctcaaaataccaaaatatatgaagcataaaataattcaaacaacaggttttttaaatatatatatatatatatacacatataacaaaaaatgtatatattttgttttgtaatttaaacattctatcagtttgtttctaggcatacaaatgtacttgaatcaaaattgaattcagctgcaaatatagtttggtaaaatttttaaaaatattttatcatcaccatttctctcactcatgacttacatcactaattagtctataaaaatatagttttgataattgcatgataaaccactatatttcaaaatttacttagtcattctactatggttggacagaaaaactgtttcaaaattttcaaaacagtaaataatgcaacaaaaaacattttttgaagatcaatctttgtatgcatctcaggttactttcttaggagagatttttataaatgcaattagaagatcaaaggataagatgctttttagtgtcattttatataataaaaaaccaattctcagaaaagttacacaaattttcactgccacatgcaatatatcacagtatctgtgcttccttgccagcagtgtgcattgttgataacaaaaaccaaatatagcaaataaatcttgtccatttgacattttcttactgaaatggtaagttaaggttgtatttcatattttgtttagaaaatatttttggtggttatttttgacttgtttaaaaattcaaattcattcttctttgtaattgattttattctgttaggcttaggtggcctttgactatccaagattaagattttattttctttttgttctctacatttttcattctttaaatatccttgctctaattcatcaagaaaatgttttgatacatagtattgagacatgaagctggctgggcttctgggttgagtggggacttggagaacttttctgtctagccaaaggattgtaaatgcaccaatcagcactctgtgtctagctaaagatttgtaaacacaccaatcagcactctgtaaaatggaccaatcagcgctctgtaaaatggaccaatcagcaggatgtgggtggggccagataagggaataaaagcagaccacccaagccagcagcagcaacctgcttgggtccccttccgtgctgtggaagctttgttcttttgctctttgcaatacatcttgctgctgctcactctttgggtccgcactgtctttatgagctgcaacactcaccgcaaaggtctgcggcttcactcctgaagccagcgagaccacgaacccaccggaaggaatgaacaactccagaggcgctgcctttatgagctgtaacactcaccacgaaggtctgcagcgtcactcctgaagccagcaagacaacgaacccaccaggagggacaaacaactcccaacaggaggaacgaacaactccagatgcgccacctttatgaactgtaacactcaccacgaaggtctgcagcttcactcctgaagccagcaagaccacgaacccaccaggagggacaaagaactcccgacgggaggaacaaacaactccagatgtgccacctttatgaactgtaacactcatcacagaggtctgcagcttcactcctgaggccagcgagaccaggaacccaccagaaggcagaaactccggacacgtccaaatatcagaaggaacaaactctagacacaccatctttaagaactgtaacactcaccgcaagggtctgcggcttcattcttgaagtcagcaagaccaagaacccaacaattccggacacagtatgagagggctttagtattcccaacttaacttgtttaatatgtcttttaatcattcattgtgacactttgttacatgttgtttgagtgaatatatggtgatatggtttgcatgtgtgtcctttccaaatcccatgttgaaatgtgatccccagtgttggaggtggggcctgctgggaggtgtttaggtcacggggcagctgtctcacaaatggcttggtgctgtctatgataacgagtgagctctcgctctaagctctaaattcacaggagatctggttgtttgaaagagttggcgcctcctctctcttttgtttctgttctcgccatgtgaaaccgcttgctcccctttcaccttctgccatgactggaagcttgctgaggcctcacaaggagcagacgctggtgctacacttcctgtacagcctgcagaatggtgagccaattaaacctctttgctttagaaattgctcagtctcaggtatttctttatagcaatgcgtgtttgcccattcatctgtctgcgaaccctaagtcatacacttctagttattgtagccttatatgttttcttgttggttctcatcaatttctggtgctgttcctcactgcttcttttttataacgtccataattttccttaatgaagtcgttttgagaattatattagatatatgtggatatctatgtgtgtgtgcacctctctctctctgtgtatacccatccatctctccatttttcttcaaggctcttgtaaactctcacacataaaaagcaatcacatatagtaaccattaagattaataacatccagaaaaatgtctttctggacttgatcaggaataattatgcttctctaggaactagttggtacctcataatcactgtagaacttgtataaacatgtttgtctatcaaagtgtatatttgctagaaaaattagtcacgcttggtccgggattctgggaaacatgagtgtcctcatgatgagccttttaggttttggagtgccattttttgtttccatcttaatttgttttatttttaattactttaaattttgattaaatttatttgacctggatataattattgccggacacattatattctgttagaacaaggccaaatataataaacatttctttttatttattgttgaattggcagcaactataagatgaagataataatctttgtctagtgagtaatacaggaaagttctccctcgctcttcaagagagtgttgcctttcctttcatttgctgtacctttgcataatcccactggctttacttcattttactcaacttgaaatgacttggtttatcccaagagacagcaaatgtgacatttgtctagaatgttaacagaattcactttttggtggttcatattaatatgcattctttattgccaactttgcagagttctcacaggaatttagcaagtacatttctgttggattgaggcaggatttttatcttttgcctgttgcctttttctccggaattctgaaaactaaaataacaacacaaagaagcaacagcaaaagccacagcagcaatactgcagacctccatctaaactagctactaaggttctttctgcatctggtcccacctgctctgcttttccttttgtattgcacaatttaagattataggatgcagcccattagcttccatttgcttagagggggtccctctctccttccccacccccatctgcatgcacatgtgctcagccagatgcatgctcacacacgtacacacattatgctttatcccatcatgcttcctggaaattaagatttcaacattgattcctagaaaaaatgttagagacagtcctctgcagaagtaggcattttagtcttctggcacactaagactctgggtgttacatccaagaagggtatacccaagagaaagaatgaatatacatatcattgggtgaatggtctctgtttagttccgtatatgtaatagttaatgataagctatttccgcgtctggaaataacttgtcggtttgtcttatttttctgtaatatgatttttttttaccttttgcatttgtctggaaagtcgcaaaagactgattaaaaataatctcctaaactggaattggggactatttttaaagttttaaactttctatacaacacagaaaactgagtgcccaccattccattaattctccagtcatttacccttggatgctgggctacctcagtgctgctaggaattcagcatgccatgctaagacatgggctttccatgcatttaagaaggacaactgctactacttgttaagtgcctgtttacatggcaggcgcagtgctaactactttgcacctgttacttcctttaatcttcctaccaatcctctaagttatgtattattatcctgttttattgataggaaattgtgggtagccatgagagactgacaatagagtctcactacagactgtattttttgtaggcaagactacataaatcatgtgcctgttttgttgttcaaaattccaccgacattctttatgcagtagagctaaaaggcatacagacacaaatgtatgaactgtcctctttttgtaggcaagaatccacaaaatatttaataacacggtcatgttttcatcactgaaaacatacttgaggaagctcattataatggaatgagacaatacttttcattaatgactttcatttatttttaaaatttgaacaatggaacagtctgattattaaaataatattaatgtaagatggcaattaaatagttgggaaattgcaaataagatgattggtgaaaaactaccaaaataagatgagctgcaaaaataggttctccctgaaagagtactcttctagggttaggggtaggaaacaggatgctttattcaaggaaagtcataattctgatcattgcagttcagtggaccaatgatattaatatacaacagcaggaaaagatggccaattttatgtgattcatcctctaaaaggaagtacacaggatattattttatcatttcatcattatgccacagatgagtcaccacaaaaataaattccaacaggagcaaggaaaaaaaaaccctaatgttatagtagaaaggaaataatgaaaattaattttacagttttttttggggggggagacaatgacaataaactatatatatatatatatatctcatggtatcactttaaaataagccaaattgttagtttctattgcagagtcatgctcaaccatggataacaatctggcctaaagcttcagatgagactcaattttatgaaactgtgaaagatttgacacagtaacagcctcacagaaaaaaatataaaatatctccaaagatgcctgaaatttatcaactgatcataaattcttgtctttcatcaataaaaatgaattttgttcaatgaaaatacctcctcatagaaataacatttcttccagtgtaactttcctcaaaatagctcttctgctattctccaagaaaaaaaaaattaaaaaaaataaagtaaaaatcttcaaaagctcccttgtgtcacagttccaaccactgaagaccctccatgtctggtttcccattgctactgccatcctttggtcatatgtccctccatgcctgtgattctccatgtctctaatttactcatttggtttttcttatatggaatgccttcatctaatgccatgacccaaatctctacctgttgaaattatattcacccctaaagacaaatctttataaagctctgcacacctccttctctggaagcaatatttttctctcattaaatgagctgatatttggaagtgctaggcacacagtaaattcccagaattttaaaatactctcccaaatgtctttgctattactttagaactgagtacatctattgtagcatatgtcacctttggcttacttgagatctttcttatgtgttctactatgggatgagttgtttcagtccttccttgggttcttgacaatgctatagttaaagagggcagtgagtacatttgttcatgtcggtatgcttcctagctgtgttgcataaagaatgttgatagaattatgaatgaaaaaccaagaacatgatttatttatcttcatcataaatgggtatatcagatattttgtgaaagatgattttcagtggtgtggcagactgagggagggtaaagctgaggctatgacattcaaagaggacacaatatcctcaatgcaaacaaaggcaaaagactgtgaggctgcggacagtaaaggcaaacactgggatggcctgccctagatcatgctcattttaaaaagtctatccatctgaagtcttatccatctgataggaaggatcaataccatgaaaatggccatactgcccaaggtaatttatagattcaatgccatcgccatcaagctaccaatgactttcttcacagaattggaaaaaactactttaaagttcatatggaaccaaaaaagagcccgcattgccaagacaatcctaagccaaaagaacaaagctggaggcatcacgctacctgacttcaaactatactataaggctacagtaaccaaaacagcatggtactggtaccaaaacagagatatagaccaatggaatagaacagagccctcagaaataataccacacatctacaaccatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaaaacttaaatgttagacctaaaaccataaaaaccctagaagaaaatctaggcaataccattcaggatataggcatgggcaaggacttcatgagtaaaacacccaacgcaatggcaacaggagccaaaatagacaaatgggatctaattaagctaaagagcctctgcacagcaaaagaaactaccatcagagtgaacaggcaacctacagaatgagagaaaatttttacaatctacccatctgacaaagggctaatatccagaatctacaaagaacttaaatttacaagaaaaaatcaaacaactccttcaaaaagtgggcgaaggatatgaacagacacttctcaaaagaagacatttatgcagccaaaagacacatgaaaaaatgctcatcatcactggccatcagagaaatgcaaatcaaaaccacaatgagatgccatctcacaccagttagaatggcgatcattaaaaagtcaggaaacaacaggtgctggaggcatatagagaaataggaacacttttacactgttggtgggactgtaaactagttcaatcattgtggaagacagtgtggcgattcctcaaggatctagaactagaaataccatttgacccagccctcccattactgggtatatacccaaaggattataaatcatgctgctataaagacacatgcacacgtatgtttattgtggcactattcacaatagcaaagacttggaaccaacccaagtgtccaacaatgatagactggattaagaaaatgtggcacatgtatacaccatggaatactatgcagccataaaaatggatgagttcatgtcctttgtagggacatggatgaaggtggaaaccatcattctgagcaaactatcgcaaggacagaaaaccaaacactgcatgttctcactgataggtgggaattgaacaatgagaacatttggacacagggtggggaatatcacactccagggcctgtcatggggtggggggaggtgggagggatagcattaggagatatacctaatgtaaatgatgagttaatgggtgcagcacaccaacatggcacatgtatacatatgtaacaaacctgcacgttatgcacatgtaccctagaacttaaagtataatttttaaaaaagtctatccatctgagagtccatggagtactgtttcttcttctcaaaaatttattagtgaacctcagtttctcatcctgtatggaaaaaaatgattcaaaaaccccaggaaattctggataaaatgcaaaaagcatccttttaaaggtgaatagtccaagaaaataattaaaaactccagggaccaaaagctaagaagtagcttgaatcaagaaaagtcagtttctctagagaatttccgatctctgctagactttggtttttaatgttgtgtcagagataaggtacaaagtcatgaacctttgaaaggaggagactgctgagatacttgagcaaagctatatagttattggttttaaacctcagagaggaggttgatccagatccagtaaaaaaaattcaatggcaaaaggggatgacaagggagcctgtgcctcttgacttgggcactcacatatggaaccacgttatgacacagctggcatatgatgcagaactagggggcatgaatagattggtcaataaatggtactgtggcaattgtttatccaaatggaaataaaattgttccctctctcacagcagccacaaaaatcaattcaggctaaatgaagagctaagtgtttcaagcaaaataaagcctgaccagaccaagtgttcctgagtggtaaagtagagaatactctcatatactgctgatagcttaggataaattggtaaaactactttggaatgaaagtttatcaataccaatgagaaatgaggatatgtttattctaagacccagcaactctattcccagatacataccctaaaaagaattatttcacatgtgcacaaatcaatgtacaaaaatgttcagagcagtactgtttggatttacaatatttagaaacatccaacacctggatgcattacttttctattgatgtgtaacaaattaccacaaacgaagcagcttaacactcatttgttacttcacagtttttgaaggtcagaatgtgggcatggtgtaatataactgtgctctcagctcagagtctcaaaaggtggaaatcaagatgctggctgggctttggtctcatctggagcttgcggtcttcttctaacttcatttgggttattatcagagggttgttccttagggttgcaggactgagagtcctgctttcttgatggctgttgcccagggtcttggccacacagcacttcacaacatggaggcttactttttttttcctatttattaatttatttattaatttattatactttaagttctagggtacatgtgcacaacgtgcaggtttgttacatatgtatacatgtgccacgttggtgtgctgcacccgttaactcatcatttacattaggtatatctcctaatgcaagccaacagaagaccctttcttgctttaaatctaagaaaaggccagtacctctgattaggacaggcccacacatgacaatctctatttatgactgactcaacattaaatgcttagcaacctattcacaggaatgacagcccatcatattcacaaatcctaccagtatcgaagggtaggggatgatgcagggtatggacactcgtgcggagatatcatgggggacagcttagaatctgcctactgcacaggaaaatgaaaaaataaattgtgttctgtctgtataaagaatgtattatatatgcaatataatatgtagttgctttttatacagtaatgacaataaataaaatacagctccatgtactcatttaggtaactctcataaacataatattgagcaataaaagcaattagcaggagaaatagtacagaatgagaccatataaggcaagtttaaattacacaaaagatatatgattttcagttgatgtccatatatgcattaaaagtataaagaaatttattaacaaaacacacatcaaaatcagaaaagtgattctccatgggagagtgagaggacagagatcaggaagaggcacccagggacttcaggtctattgcaatttagtgtttgttaagtatggccacagaggagtatgttttattattattcatatctttttgcacatcaaatatttcatgataaaattaaaaatacatgaaagacagaacaaaaattaaagatttcagcaatattaattgaactaatagttttaaatattaaaataaaccttgaatctattaaaaatgtcacacactctcactacatctgacaaataatttaaaaaattaaggagcaaattgtttcttcaaattttttggtaattcctttaatacaactaactgcacgactagtcattttggtggcaagaggaaaggaaagttaatttttaattatgtgttttatagcatttgttgcttctatcgtgcaataactgttttggacatattttataagtgaaaactcaatagagcaagtaattaacatttagagaatgaaaattaagaaaacctatatcaaataaatcatactaaaatttaagtactttgtgttatagaggataatatattacttagaaataaaaactatccccatttatacaaccgctaaacatatgaggtctgtttattattttagtgggaaatcagaaggaataaaggtacagagctggttaaagatggacagtgaatgtttactgcatttatttcagtaatttagaggcagttgctttctataataaatggaggaaaaactgagtaaaatcttactgaagctgcttatgagcttttgttaggcaattatggaaaaacatgcaatttgtttttgttacagaaagactgtggttgttcttgcttatggcaatctgtcttaggacctgtacaggctgttccagaatgaatagttcatctaaattgtactcatacaatatattcatcccaacaaaacaggaactgttgcatattgccttacatcaggatttcatcttgttatttctatttagcagtgtagctgtttggtccaaactagaacagaaagttattggcttgagatgacaaagttgttttattaaattctatcaatatagcattctttgtttttccatcgagtagaattcgagcatcccttctccatctcttgggcttatatactgatagagtcctagctgtcttcctttctgactctacttactgatgcttacagatcccactgcacagtgttaagtgctcttggaggtgtaaggaatgcacatgctctcaacctcaaggtacctgtagactagcaaaggcagtaagacccatgtgtaatgtcaatggtatgtgatagaaactgaccagtaccataaaaacagggagagcaggaatccataactgatctactctgtgtccagccctatgctagctactttgcaggtacctacctatttgggcatcttgggaaggatctggggtccagatgtttctggtgaaaggaattaaacaccagctttctttctaccacgtctatttacaaaccttgtttgcatggggaatataggagcagctttggagacagagctgagagaaatcttgtccaggttttgggtctgacccaagtagttgtcttcacaacatctactccttcccatgtgattaaccaaagccagtaattttaattctaggaatgaccctgttactcaatcctgccaatgagagatgacagcaagtttgctggaaggaaagggatgatagaaaaggtttcctggtcctaaggaggaggcctgggaacagaggacccacatattcctctagatgtcatcaggaagcctggaaatgtcacatccattttgctaacataggaagacaacccatggagaaggtcactgtatgagtttgctagggctgtggtaaaaaagctccacaaacctggtggcttaaaacaacagaaatgtattgtctcacaggtatggaggccagaagtctaaaattaaggtgttagcagggctgtgctctgacagctctagggaaaaaaatcttcccttgtatcttacggcttctggtgtttgccagcattctttgacattccttggcttgtagatgccattccagtcccatggccatatccccgtgtcatacagtttagatctgtgtccccacccaaatctcatgttcaattgtaatccccaatattggaggtggggcctgatgggagtgattagattataggggtggtttctcaggaatggttgagcaccatcttctcagtgctgttctcatgacactgagtgagtcatcatgaaatcaggttgcttaaaagtgtgtagcacctcctctctctttcttttcctcctgctccagccatataagacttgcctgcttcccctttgccttctgctgtgattgtaagtttcttgtggtttccccaggagccaagcagatgctgccatgcttcctatacaacctgcagaaccgggagcaattaaacctctcttctttgtaattacccagtctcagatatttctttatagcaatgtgagagcaggctaatatactgtgggtctatatcatcttcctcttatgcatatttgtgtctgttctttcccttttcataaaagcatcaggcatactggattagggtccaccctgattacttcattttaacttgattacctgtatttcaaataaagttatattttgaggttctgggagttgggatatcaacatacatttttgggggaacactgacaattcaaacaacaattaagagaatttcagtgaaagatccagtcctgacttcctgaaagctacctgatctcttgaattttatggaataaatttccttattcttaaagtcaactggaatcaagttttctgttacttgcagccaaagtgtttgcaacggaattatgcagacgcttctgattggatagggtaaggggaatgatggagggtaatgaggatcctggaggaatgaacaatactgggaaaaggaatccggcatgctgagcctcacccagtatgtaaggatgacagatgtttgtgttggttcagcattgttgctcattctccattcaaacacctcttcacaagctgtcacttggaacatcctttcacctgtctcatgtgtgggatcttcttagacaaatgctgtttctgctgtggcacagagactatcaggtgctggtttgggatcctgacatgatcattcctaacactcacaggctgtgccccaaaatgttaatacctctatacctttcttgatttcctgaagtcctctgggaagtttgtgatgaactattccagaggcctttccttccaggtacagattgacaaaatatttatattcttggcactcaataagtatttcctaactgaacactttctagtgtgtttgcttggctagaagtgacctaatggataatagttggtaggagcagtagacaacttcaaatccagctgtccagctgtgtaactttgtgtgggttatgcaagctctccaagcttcaaagtcttactatgtgtaagtagggctcttagttatcatgcctgtttgatagacatcattaccattttaaaaatgaatgaagctcagacaaattaagtgtcacctaagactacacacctggtaaatagtgctgaagcagattcagggtgagtgccctccccaagcctcccatgtgcttccacactttattttcccacaccattctgcagccctataaacattgctgggaggcagcctccaagacggcctggacccaagtcaagataacatagacaattgctgatttttaaagtctgtatttcactttgcgatacatcatgtgatttttcttgcagaaaatttgttctggtcatgtcctgtgccttggctaatactgtaattaaccaacctaccttaagcactcaaccactggataatgtctagagaagggagggaaaagaaacccagggatgtgcgtctgacgacaaatctagccttgagtaaaatatgtttttaatcatctctcctgaatgattttctatctggcaagtaagaccaattggtgatgctttatttgattagggatgataatgaccccttttgtaattgtaatattttttaacatttccttgtaaaattttattactcttcatggatttcacctttagtaacatttatgtgaaaggaaaaatatactccttctagtcacttcacacgttcaggctgtcaccattgtcagctgctgaataactgattagggggcctgggagaggccgagctgctttcattatgatggtcaaaataatcaggcaaaatggtgcaattgagtaattggagatctgaaaatgtaatactacttgattactattatagctggaaaatagagcaagtatagaggggctaagtcaggaatggatctaaaaagcagccttgccatttatacagataatattatcaatttcaaatatattacataggctgtaatctagtcttttaagaaatactttctaagcccagttgtgtcatctttgtatattatttaatacacaaaatgcagaagaaaaaaaaacacatttcggcttacatcttggttgtgaagaataaaaatgtaaagaatgatttgcccagtatcacatagctaaaaagcaatggggcattgatgcacaatcggacttgtagggacagaagtacagactcttaaatgcattttttaaaaatagaggcccacagtccttattcacaactccaaaatttaaaaatttctgaaaatacttgaaggtccttttgaattttttttttttcttatagtacatttagtagcaaaatctactgcaacctctgactccctggttcaaatgattctcctgcctcagcctcctgagtagctgggattacaggcacacgccaccacacccagctaatttttgtgtttttagtagagacagggttccaccatgttggccaggatggtctccatctcctgacctcatgatccgcccacctcagcctctcaaagtgctgggattacaggcatgagccctgcacctggccaaagacaccttttttactatccctctacatccctcctctcaaaacctttatgctttcacttggaccaaccctgacacaggctactcccaacaactcatctggactgtcctcccctgggggtttagagacagccatcactatttcagtcacttcaattagacctctcccaactacctctacaacccaggattttgctgcaatatgtggacagtttactcctttgcagcccctttcttgaccattgtattcaacacaccaccaagattttaaatgttttggctgaatgtgggtacctggtgtccaaaaggaaggcccaattaacctcaccgaaagtttcatacctaggactgatcataactccaaatacccgagaaatgctgttggcatgaaagcaaggtgttcaacaaatcccatttcctaaaacgaaaagggacttactttccttccttggattagtgggatatttccgattatgggtagcaaattttgccattattgctaaacccctttatgaacacacaaaaggaaatcttgaccaaccactcactcccaccccagacctttatcatgctttttctcatctaaaacgtgccttattgcaggcccatgctttagacattccaaacctcctaagaccttttcatctatatttacacagttctcataatcaggcccttggactattagcccaacttatgggagactccttctcaacagtggcatatttttcaaaacaactagaccccatttataaaatctggtcccttttcttaaaaattttggccacagcctctctaattatctctgagacacaaaaactcatgttctacaaaccccttcaggtattttcttctcacagtctacaagatatggtcagccataggcgctcacccccatctcatcctctcatatgcaagccttacatttaaccctccttcaacccgctatctctcttcatagatgctccccacctaatcccgcctctcttttaccctcaataccgattttagatcctgaccaatactcatgctctgatctaattgaaagttctcctaccatgtttcaccatcttacttccactcacataaagggagccccagactggtttatagatggcagtgcatcaaaaaaccctcctctccaagcaggatatgccatcattgagggatagcgttatgatacccactctctcccatctagaagagtgatagaggctgcccccttgcctttgggcacatccgcccaacaagcagaattagttgccctaataagagcactaaccctaccaaaaaacacacaagttaataatacaccaattctaaatatgcttataacatcatccattccaatgcctaaatttggagggagcggggctatctcacagttataggaacccctatcattaatggaaagctcattcatcctctattaaaggcacttctacttccagaaaaggttgcagttattcatggcaaagaacatcagacaaaagccacatttctttagggaaccatgaggctgactactgggcaaaacatgtctcaaccaatcacccaattccccaatacttatttcccttcatacaacatatccccttcttttatccagaacaccaaacacaacaactaatcatggcaggggcacaattcaaaccccccaaactgattcatacaaaacaaattagtcctacctgaccctgaaaaaaacaactcttttacgggacattcacaacctcttccatgctagccattcacctctacaacacttcttaaattcccataaacacataaccccagatataaaggaacagttaaaagccatttcccatcaatgctctatttgccagaaagcttcaccccattccaacactagacactcttctttcccaatccatcaagccaggggacaccttccaggacaggattggcaaattgattttacccatatacccccagtaaaaagggtttgatttcttttagttctggttgatacctttttggaatggcttgaggcttttcccacaaccaacaaacgagcctctaatgtcacctccaaattaataacagaaatcatccccaggtttggggtgcctctttcttttcaatctgataatggccctgaattcatttctcagattactcaaacactttcacaagccctacaaattacctggaagctacacatcccctatcgacctcaatcttcagaaaaggttgaaaaaatgaatggcattctaaaaaacaccctcaccaggtactcactccagacacataaagactcggttacacttttgcctttagcccttctaaaaattcaggtgctctcacataaacctttaatgctcagcccctttgaactcacatatgggagaccacttgccccttttggtccacctcagggtcaagccccacctctgccaacccctctcatttcccctcttgtacataccatctgccatttcatttgggaatatgctgacaaacacctgccacaacttgtcaccaactcctctaatcccttcctacagccaggagactgggttctgataaaagatcccagtcctagccccaattccctccttacacctaaatggaaaggaccttaccagatcatccttactacacccatggcagcaaaactccagggactccccaactggtttcattatacctctctcaagaaaacagacttcccttcaccacatacacaaacaaccaaatctaaaaccccttcagccttctcttgtgtctccacaggacctacttcccttcgcctcacctaaatcctggaggaaaaggaagagaaatccacataagctgcttatgtctctttctctcccaaactttcactgcttcctaaccaaccttgctacagaccttcagtggtacccttacaaagctcccattatacatgctaatcagtttctgactgttctatggtacctatggcttcaaggaactttccaggactttactactacccaaataacttttttctctttttgattgtttctttcaatataaattccctaatcatatcaacctcaccaataaaaccactcctcactgctctcaaactagaatgctctataaaccttacacaatccctcttgctgcaaagctaactcttcctttgctccagagtgctggatatgcttatcgctgtcttcctcagcttacacagcccttcctacaccccttcatgacctttgaacaggaaatataaccctaacttataaactcccaaaaggagcttccttttttgagagagccgacaccctgttcagagattatttcacttccagggccaatcgggccaacaaaatatttcaaacctattacaactctctacaatgccttaagcaccaagaccctcccattgaagggcccataactacacacaccccccttttacaacaagcctcactttgcttttcagcctcggagggaaatttccctgtagggtccttaacatctaaccaatgcaatcacactatcattgttaaacacccctctgaccatcaaagtagccacgttgactaccaagtatcacctgaaacaaatggagcatttctgcaaccagctagtttacagcctctccgtcaaccaatgcctcctgcctaacttgcgctgcccctggtgcccaactttttccatggctcaatatcaatggtgcaacatccgattgcattaaatgtgtaaaaaataactcttcctatatctctactatagtgggtgtctccctggcctcctccttgtccacctggagtaaaaaaccgcaggaaagaaaaaacaccccatctttaatttgcttatcttctttccctatctccgcctgcattatgacaaaggcttgttctttttatgcggtaccaacacatatctttttctccccaccaactagaccagaacctgtaccctagtttatctttctccctccgttggactagttcctcctaatcaatcttcacctgttccattcatccagtatgttagaaaaaggaggagcatccaagtcattcctttaatggctgccttatgtataacctccgggcttggattgggagcaggcagactggccaactccttaacatactttaaagttctttcaacagaactacaggatttattaaaagatatagcccaaagccttataagagtcgaagaccaattagactccttgcctggagcagtcctccaaaatagactgggattagatcttacaatggctgaaaaagggggtctctgcctctcactgagtgaggaatgttgcttctatctcaaccaatcaggcctagtaagagatgctgctgaaaaacttgaagaaagggctaaaacgtgaaaggaataccaaaacaaccaaatacattcttggtttagaaacaaaatcctaacatggaccatcccattcttgggccctctcctaataatatgcctaggactaatgtgcttacctggcttaattcacctttttcaaagattttttaactgacaggatcatggacatctcacaattacctaaaaacatctacagatggcattactcccacaatcaacccaagaccaaagaaccctctgaccctccactcagcaggaagtagccagaaagaatataccacccctcttcctttctataactgtagggactggattgacagagcaggagatcgtcgtcttggagaaacaccaccattttaagttccctttgattaaaaaaacacccaaatcaagcacccaaacatcagcctaatgcctaatgtcagcatcaccagaaacattccaaccctaagataaaccccctctgaccagaaacacgccaaccctgagacagcctcccctccaaccagacatcccaatcccaaccccacaataaactttccctcacatagaaacattccgaacctgcgataagctccccacttcctacacccttaaatacccttagtctgtaagagagaatgctcctgagcaaaattggccagaagcccctctaaagtttattctccaaaataaatctgtcttttactgttgagctgctttttgtgtttcttacctctttaactcttacaataaccatccccatgttcccatggaaaagatggccagctgatctttttatttacccagtgaaggggcagacccagagaaggtgggcctaatgatgtggctatcattttggcttgcctccctccagcctccgttccaggagtcctgctcctggccaaaatcctatgtgtgatctgatggcaaggccttgcctgggagacctcccggggaccactgccatccccaccctagacatggtgcatgaccagggcactgccatttctggagggacttgcaatttatgactcagctctgccctgccaggccagctgggatcatggccatagctgcagtcccagaccaggtgcctctgtgcagaggcctcctgatcagggcccagatgaggcactttcctccatgctggctccgttcctttcttctcctatcccttccttccttatgcttcccctccctaggtgcaggaatggctggaaccttttgttcaggactgcttagcaaggaaaagagccctccctcccccatgcctgctgatccacctgacccttaaccaacacctccggacgctggagagctggagagcggtgcctacctttgcctcctgcctgtactgttgcagtgagggaacaaagtcttgattgtaactttcagcttggcttgctgtcctgaggatcacctcgacacctgtcagctcaacacctgtctaaggccaatctttgtcctcttgctgtggatactgccttctcccacctctgcaggaacctttgccatcatcctccttatctcacccatctgcaacctcactagctacttgccctctctcatcagcacttaaacatcgtatgtaagtgcacctgaaagcaataactcaagcataccccgagaatgacccttcttgccagacacacctgaatgtgtgttctgagctagggaatctaggagtggccaacccagagattgactccttgttgatgaggaacatctgagtccccatctcctcccgtggaacactggctatacacagggaattgaggccccaagtctggggtgaattaagatttccatgtggaggttgctgggggagtgtgctaagtaaaaatgctatgtaaattgcatgcattttgcaagcaggtcttgttctcctgaccagccagccagcattggactccctcccctgtatgtaagccctcaatgaaaccccatgtctcatctgctggctctgggtctcttcttcagcctcttgaacctggtgccttccctactagagttgataggagtttggcatgacagatacgatcacactttcaaccgacttcagagttccttggccttttgtcctcctcttaccattgatggttcttgctaagttctggaagaaggatttgctcacctcagacatttagtacatgctgttcctgtgatgggaatccgttcccttgcacttcctttggctacatccagccattggagtcacctgttcccataagcctttctggacttttccatgcctgggaatcggccttgcctctgtgtccccagagcacctggtgtctgccttcatcaaggcctgtggtgccctgtgcttacctactggttcctcccctcaactgagaatttcttgaggacttatgtccccatgattacctaaatgaccagatgctttaaaggcactcgacaaatccttggcggcacatgaatgaagaatctgcattataaaaggatgaattccaacactggtagctaaaataataaatttagcataggatttttaaaaaaatccctaaaataaagctaagctatccattagaagtacagacccttttgctgtcaaagcttaacttttaaaaatatatgttgtttttaccccaatattattcttcccatatgatatggtttggctgtgtccccacccaaatgtcatcttgaattgtagctcccataattcccatgtgttgtggaagggaccaggtgtgagataattgaatcatgggggcggtttcccccctgctgctcttgtggtagtgaataagtctcacgagatctgatggttttataagaggtttccccctttagcttggctctcattctctcttgcctgccaccatgtaagatgtgcctttcaccttccaccatgactgtgaggcctctccagccacgtggaactgtgagtccattaaacctctttttctttataaattacccagtttcatcgagtatgtctttatcatcagtgtaagaatggactaatacaccatataataggccttactatttcaacttagggtaaaaatatatacattatttgtctggtcattgtatttttttatgtttctaagtccacatagagttaaatttcaaggtccttctggttaagagctgtacctcttacatgacttttgtttatggatccattgatttctaacttcctttttagcttaagtgaattctactgagaaagctgagagacatttaaaatctgaagagcctatgaattttattttattgaaaatcaaaagcttccttctagattctgactaacataacaatatataaattataaaacattaaaaatatgttaactctcttgaacacaaaaatgcaagctttattttaaaattctgctgtattttaatttataggtgctaagaaccctagcattcaggtttcagcatctaactctattagattatttccagaattttagaattgatatataatctgacaatgctgaaaatggtctcaaacacctgcaccctgcagaagagacaattttaaatattaaaatctaattatcccaagttatcaaaaataggataatacttctgaatgactaaagtgaaattactttgatgttaatcattattactaaaataagaacaatgaatttaacttactgcatttttaaaactcttaccctcggaaacgtagtaaatctgtccagttcttcgacaaagcagaacatctgcaaactaattgctgacataacaatcaagaggctggcagtaaatacaaccaaactcccaagcttttttccaggaccaaatatcttgtacacaaagtcttctaatgcaggtgaaatcttaatcagccgaactactcggagaacctatcaagggagagagaaacatttatttacacatatgatcatttatttacactgaatcttaaatatattcatactaaaatattattttatagtgctttatgaaaatcatacctctctatttgaatatctagtgactaaaattaacaatagaataaccattggtctagctcaataaatcccaaatgaatggatgaactaagtgttttaacatattatatgattatacaaaatgatattcactagtacgtattgttgaaataaaattaatatttttctaacgttcaaatatgcaaggaaacctttaattcaatacaggttgaacattcctaatttaaaacataaaatgctcaaaaatttaaagtttttgagtgctgatatgaggccataagtgaaaaattctacacctgacacctttgctttatgatggttcaatgtatacacactttgtttcatgcataaaaaaactattaagaatattgcatacaactaccttcagggaatgtatttgaggtgtttataaaacataaacaatttttgtgtttagacttgggtcccattcccaggatatctcattatgcacatacatacaaatattccaaaatctgacaaacatcgaaagccaaaacacttctgttcccaagcatttgggatacagatactcaacctgtattagttatattcactgtctcataaaatattttcctaggtattattagaaaatcacaaggaaatggaaagagaagcaaacttttgccaagaatctttacttcttattgagattatcagcccagtatccattttctctttcctcctttaaaaaacagaactttccgaattctaacctagcaagtggttgcctggggctatagcctacacattccagtctcccttgcagctagctgtctccagtggactgggttcagacctacggaatgtgagaggaaatgatttgtacaagttttggtgcattaagttaaactttctctgaatcctttttaaaatacctttctcttgcctggaaatggaaacaaatagtgtagcccctttggaccagaaatagaaggcttgcatagaatacgacaggtcctgtccaacccgacaggctgggtgaccatggggggcacagccacctgctttccctgcatacttaccaactgctgcagagaaataaacttctgtcttatgtaagttttgtatttttggatctttgttatatgtactcaactattctctctctatatatacacgcatgtatatgtgtgtgtgtatatatttacatatattttagtcatgcatcgcataacttttgagtcaagtatgggccacgtataggatggtggtcctataagacttaccttttctatatttagctatgtttagatatacaaatacttacctttgtgtgacaattgcctacagtattcaatgtagtcatacactgtacaggtttgtagcctaggagcaataggccataccatatagcctaggtatatagtgggctatacatctaggtttgtgtaagtaaactctatgatcacacgacaacaaaattgcctaacaatgcatttctcaaaatgtatctctgctgttaaatgatgcatgactgtgtatacacacacacacacacatctaaatatatacagatatatttagatgttttgcatactcacatttgcaaaaaaaaataagtaattaattgacaaatttattcactcatttgtttaacaaacctttattgattactatgtgccaaactttgtgttggacaaataggattcaatggctactattacaaagcgagtataacacaaagacacagcttttaaggacatatttatatgattagtatgtataaattagtacataattaaaagctgaagtatatagtgtgaaaaatacaacttttcattaagtctaagatgtcaccaattttgtatgtagctctaagaaataaaaaaatgctgccaattaaagtataacacaccactgattataacagctcccaaattcagagatattaacataggaaaattgcattcttggcataaatgaaatatagtttatacaatgatcatccaagattttttgatgtcaataagagattgagttgtctgttaaagatgaatagtgtatttagaacacagtaagaaacagaaaattcatttttaaaaattagattttaatttttacatgtctaaaataacatttgtttctttttggctttccagtgcctctggcttcttcaactctgcctggttttcctttagcaaatcattcctaccccagccttagtacaaaggtgcaagaaggactccccacccgtcatgatccagatctggccagagtattcacagtcatctgagtcatcctcagggcttttgctggatgcctttaataagaaatgttctatttcttttttttttttttttaatccccaacgggtactgctgtaagagtcacacaaactcttacagagctcctgggagccatctttgccttcacatagagaaaaccagcttaagaatgacaccgacacaccaacagaagaaaggtaggtgaagacatacactgagcccctgacaccatatcggcctctgaattttgccatacctgaaaccacgtttactgcatttactttgatttaacaggaagtatcagtggtcagtcttattcctattgtctgcagaatgcaaatgatatggtttacagcatgtaagtaaaccaattgaaaaaaaatgactaaagcatgtttccttcatgctaatttgcaatttttaaacatatgtaagaaattatgttgttcaaattaagcatcataccacatggtgcagctaccaatttttcctgctgtaattcttttcttttctttttttttttttgtgacggagtctcactctgtcgcccaggctggagtgtagtggagcgatctcggctcactgcaagctccacctcccgggttcacaccattctcctgcctcagcctcccgagtagctgggactacaggcgcccaccaccacacccagctaatttttttgtaattttagtagagacggggtttcaccatgttagccaggatggtctcgatctcctgacctcgtgatccgcctgcctcggcctcccaaagtgctgggattacaggtgtgagccactgcacccggccatcctgctgtaattcttaacatacattcccaaatcaggacatattactctcagataatctttacaaagaacaagcaaacagctttatcataagaactattaaagtattaacattcgtattaatttccagaataataatctggaaagatttcacatttttatcagatttgtctattttcggacataaataattcagtacctaactgtaaacagcttgaaaaaaatggaactatttaataccacttccacattggtgatttgatcagcattttcaaagggttaaacctgcattcctagaaaggaaaaatccctgtcagtgagtctaattgtgccttttcatttattcagggatcagcaggtttttcactctatctaccctataaagatttttgattttgtgttcctacagatacaacatgaagtaaaccatactctcaaagataagcacttcagaacattttgtctctgaaacacattttcctggtcacatttctgagtccttctcttaaaggtcactctgttgatttgtagtgagatgctgtagaaattgcatagttaagaatatgaactctgaaattcatgttcttgggaagaatttttttttttttttttgtgagacggagtctccctctgtggcccaggctggagagcagtggcgcaatctcagctcactgcaagctccacctcccgggttcacaccattctcctgcctcagcctcccaagtagctgggactacaggcgcccaccaccacgcctggctaattttttgtatttttagtagagacggggtttcaccatgttagccgggatagtcttgatctcctgacctcgtgatccacccgcctcggcctcccaaagtgctgggattacaggtgtgagccactgcgcccagccgggaagaagatttagctccatcatctgctaggtatgcggtcttgggcaagtcaacagatttcttgagacctcaatttacacatacagtccttatcttagggcttgttatgagaaacaaatgagacaatgcactcagcaagatgcccgacccacaggaaattcacaagacgcaccagtcaatatcatcaggatgataccgatatgtaagaaccacagcgttttgcaagacctgatgatttcccacaggccatgctgccctgcattggttgcagcccagccacgctggcctttgtgctattccttgaacacatcaatcatgcacccacctcaggacatgctcagtgtgattctctccacctggaatgcttcccctcagacctccttacagtttgctccttcacttcattcagtctctgctcaaacctcacctcttcagagagggcttctatgaacaactaatctaaaatagcccctactacacaatctctatgctttttaccctgcacacttcttccttaagacatttccagtacttgtacttcacattcctttgtgtacttctttgtgaactgtttgcctttagaatttcagcttcataaaatgggaatcctctctgctttgtccactgctccatcttcagtatctggaacagtggctgacacatagtagaagctcagaaatatcacttgaataaatacatgaataacttcagtagttagtctaacagataactaatattttaaaggaagccactttgcactaaacattacttcatttaaatgtgagaaatatgaaattgtctaaggaaagacttgttgccaacacagtaaagaaaggttgattgaaatgagaagtgtgaggaccaatagggaagaccaatgtaggcctttatacaaagagccgctctgtctggtacagtggattctccacatgcaaatttgcaaaaacccttgtgacacctaagtttctcaagagatttactttctagccacaaattaactgagatcatttttattcattattaatacattagaaaaagagaagcatggccatgtatagagagatacaaatgaaaatcacctaatcattaacataaattaaacagaaccaattacagaataatccaaaatcaaagacaaaactgaaattgcaaacttcactgtgatttgactatctatctactatctatctatctactatctatctatctatcatctacctatctatctatctatcatctgtctatctataaaatggttacagccttgcaggctaatattagatattttgtaaaaaaacagactagtaggaaaatcagacatgatgacaagagtaggaaactagagatgattaataatttgtaataaattggtttctttctagtcatttttttccattttataggtattttacatatgtatataataaatatatacatacatatatgtagttatgtatataatataatttatgctgtttatcgtttaaataaaacagtcatatttctaagttataaaaaactcatcacaattataattttatggttaaattcgcgttatgacttattaagctattcctcaaatgtttgtcatttaaacagttttcttttttctctcattaattctataataaatattttgcacacaaatgttattttctaactttttactgaaaaatggcatgtcagagactatagcaattttaaggccctgaatatattttatactgtacctttgctgaaataggcaacaccaattttcttaatttggctactttaatagctttgtaaaaaaggtatgctgttgttttgatataaaggatattctctataattatgtgcaatgatgccctaaggtaggtactcaatggccatgataactttgtgaatctagagagcagtgcacaagagcttataatcacaggaatgtttggaaagcacattttgtatcaagagttttaaacatgtatatctcttgccccagccatgtcacttatgatagctaagcttcaggatataactcaacaaatgaggagagatttacatccacggatgctgagggaagtgagcgcttgaactatgaaaaccctctgtggtttcaatatgcttagctgtgattacaagggctcagctttttgcctgggtttgtagggggttttgctttttactttttgtgaattatatttgcatgtcctttcccccaggtactaaaagtgtctagttacctgtgatctggcagttaaagtgaatattgttctgaaaataatattttggtattactaataaataaaatcaataaagttgcaatgcatgttctttttcctaaggggttagagtcctgtttctcaaaattacttctttaaaattctactgtcattttatttcccaaatatttaacaatatctatttagaaaacaatcaatgcacattctagtgtttccatgataaattatataaatgcgaaggacatgaacagacacttctcaaaagaagacatttatgcagccaaaaaacacatggaaaaatgctcaccatcactggccatcagagaaacgcaaatgaaaaccacaatgagataccatctcacaccagttagaatggcaatcattaaaaagtcaggaaacaacaggtgctggagaggatgtggagaaataggaacacttttacactgttggtgggactgtaaactagttcaactcttgtggaagtcagtgtggcgattcctcagggatctagaactagaaataccatttgacccagccatcccattactgggtatatacccaaaggactataaatcatgctgctataaagacacatgcacacgtatgtttattgcggcactcttcacaataggaaagacttggaaccaacccaaatgtccaacaatgatagactggattaagaaaatgtggcgcatatacaccatggaatactatgcagccataaaaaatgatgagttcatgtcctttgtaggggacgtggatgaaattggaaatcatcattctcagtaaactatcgcaagaacaaaaaaccaaacaccgcatattctcactcataggtgggaattgaacaatgagaacacatggacacaggaaggggaacatcacactctggggcctgttgtggggtggggggagggggcagggatagctttaggagatatacctaatgctagatgacgagttagtgggtgcagcacaccagcatggcacatgtatacatatgtaactaacctgcacattgtgcacatgtaccctaaaacttaaagtataataataataaaataaaataaaataaaaaataaaataatataaaataaaataaaataaaataaaaaataaatgaccaagtttgaatcaggaaaatgactacatttgaggtgtttttgactagaataccatgtagacatattttatcattttgactaagtatttaccaggacagtgagcgtgttgctatattcaataataacaaagaatgtaactaataattactgtttattgcataattagaaagcaatgtgatccaatatatcacatttaaaaaaagatatccaattattacaagttaaataagaattataagtgccatcatgaagtaacaggcatttataaataatactgtatgagtaattacaatctgtaaaggtaagttttataaacctttaatattttcattataaaccgttgttgagcaaacacttagccttatcgacaaggaagagaaacacttgggattaaattaatgtttcctagtctttaaagtttgtgccaacatcttatgtagtttaaaatttgatacgcatgtatggatatatgttatccatatataaaaatatgtgtatctatatactgctaatttaggaaaagtaagtaaaacatctacattgtttctgtgaattttcaggagttttaaaaagcgattgttacaatttgtgaatgcacttttctaatttgtaagatgtcattgtgcctttctcaagttcatatttaccataatagttattatatataaatattatatataattctatgtggttgttaaaataatgtgacaggtatttactctggaaataaataaatttctaaagacaaataggcattatttttattacctgaaagtacgtgaattgtgaatgataaagatctgggtatacatgaagagtagttccaattacgagtagtagttcgaatttgtggagagatgagctaatatatccagtaaatcccaaacaccatatcttcagaagtgcttccaaatcaaaaagtactgtaaaagccacctagagaaacaaagaaacattgaaattgaaattcagaactataatttattctaaattatttcacatatttgtcagtgtatgaatttttgccactatcatatacactaaggtgccccataaggtcaagaatgacattttactttaagaatgcatttgaaacataccaactagaacacagtagaccaaagcaatcttaaacaattataaaaacatgttatgattttgaatgtttgtgagtggcattatttctttattatctatatttgatattattttaaaaccattattatttaaagactttctatgtacacaaaaggctgaatttttttgtatgttgtattttttaagataaaatttatttaatgtacatggcatattataaaataacaacttacatattattaacctaattaaactaaaatttaaaagttaaaatatcatttattcctttatgctttaggccacatggcaaaagagaaattgagatttcataccaagcaattgatctatgtgtgcttatgcaaataaatcaatatgttactttaatattaataaaattaatgatcaatattagtatattaacacatttatttgatcttttaatctctcacatgcattctatgaatttactattccaaataacaatattataaaacacacacataaagacagcatgttatttcctttacatgtcctatgaacaagaattttcattttgtaaaggagattgcagctggaattaaaatttgcaatagaagattaacttctaattaaagactatgagggtgactactgggattagtcataatatgtccctctgagaagacactacatgatttattgaagataggaatatagcagaccttgcttctcttcttctagactaatgtggagtatcagaagggattttcttccactcatatatggaacatgtggggaaaatgcagttttaataatagtgttttaagaaatgaaacattaaaggcactgcagatagttaatttagatgtgaagaggaaattagcatcacttctcaaatctaccatttctgcagattctagttgctttttaattttaattgccatttccctccttaaaaaacataacaaggtaatatattttaaatttgaaatgatcttaagtccacaaaacacgtggatgaactcctttgcccacgtttctcaggtatttcatgttaatgtcatgtatattctttccttgatcatctgcttcttcatccacacatatgcaatcacagaaacaggcttgcaattacatgtttttacatgagatgtaaaaacaattgttacaatttatgaaagcactatttctaattttaaagatgtcattgtcctctgtcaagttcatactttctatacacttattatgtataaatattacatacagttctatgaagttgttaaaaataatgtgacaggtatttactctggaaagaaaaaaaattctaaagacaaataggcattcttggtattacctaaagttacgtgaactgtgaatgataaagatttgggtatgcaggaatattatatatcactctgcaacttgttttctgagtcactaacaatcgtggatatccctccagattaagggatataggtcctatgttttatttatcagctgcataatttcccatagtgttcaatgtttatgtaactcaacattttctctactaattcattgatgggtggtatttgcaggaatcatcaggaaggtggttaagcacattgctacttcaataaaaaggctgcactaagcatcctccctcaataccagtatttattgaggctttcatatctataaatagatttccaaagttggtattgctggggcaaagacagattagtgtgttttaaatttagaaaatattaaagtgattactttcaaaatattataagaaatcatttgcccttcagcaatacaggaaagttatcttgtctcaaatccatgccagtatcagtgtaatcaaacttattgttgctcatctgtttatatgtttattaatcactttaatttctttttaaagtaattaaatgttactgtccgtaaccttgacactattatatggtgttatgttgtgttccttatgcgttttgggagttgttggtattgaggacaataatctttgctatatatactgcaaacattttttccctagccaacagtctggtttctaactttgatattgttagtgctacaaacataaaatttacatgttcacatatgtctacaactttatgatttttttctttaccttttacatataaaatagaactttaagaagattaatactagtcttcatatccaggaatgcactcttttcctatttatttgaactggattttacgttctttaataagttttttccatataaatatcctaaatatcctatctttctttctctctctctctctctatctatctatgtattttttcttttttactatttctacccagttagttccagtgggaagaaaagctattgatttctctatattgaccttctgtacccactttactagattcttctattaattctaatatttttcataaagtctcacgatttttatagaaatgtgcacaatttcataaggaaataaaataagattatttcatttttaagatttattttggagttaatcatatgaatgcattagttataaaggtacagttatataatggttgctaaatacaaaatggtaataataggaatccataacttgctccttgttttcaatgaaagtttcttcagcgttcatatatagtggttgaaatgagtcttggtgattaatttttatcatgtttaaagactttccttttcttcctattctccttcaaaggatttaacctttaattcactgaggcaatgaaatataacacaaaagctcctgatgttaaccatttatttatttttggaaaaaaactctagatgataatgctaacatgttggattttattgggtaatatattttatttataattttcacagttactgttttatgtgaaattggcctatagttttacttgtatatcattatcaggttttggctaagattatgctagctttatcattcattctgtacagtttttatcttttgtatgaaaatttctgaaataaaataagaattagcacacctttaaaagtagacagaaagcaccaggaaacccacatgggcacaggccttttggtgatggtggagcaaagctgtccagtgctgttcagatcaggtttcttatctcatccatcaatttggcagtttgtattttgccaggaaatcattgattgtctctagattttcaagacctgcatttagggtacatatttttccagaaagaattggttcttccagggaacctgggtcatcttagaaatttgggtcccccttaaatcaacttttggctgctgtttctcagattctggacgtaatgggattttgagctccaaccccacgagtgggcaggctgtcttacacaattcagtacagataacatgataacctttttttttctttttctgagacagagtcttactctgtcacccagtctggagtgcagtggcatgatcagtcttagctcactgggacctctgcctcccaggttcaagtgattctcctgcctcagcctcccgagtagctggaattacaggcacatgccaccatgcctggctaatttttgtatgtttagtagagatggggtttcaccatgttggccaggttggtctcgaactcctgacctcaagtgatccacccacctcggcctcccaaagtgctgggattacaggcgtgagccaccatgcccggccagagataacatttttgatctgccaggggtcaaggtccagaatgatgatcccatcctttccctctgagggatgggatttttccttcctgatgttatgtggggcctctcttctgcctcttcactttgcacaggcctctagtcacttccatcctggacacactcctgaaaactgcaagttctggtcacaaggatttgcaaatgtcctcagggcagccactgccttggggcccacctggtattctggactcacgtcacatttaatttttggcctcaagaattttccttaattttttgcacactctgctgaacatttaaaacgtcttaatattttaagtgtttggtagaaatgatttttagttaccttgcagggccactttgtatgtgcttcctataagcagtgtacaatttttattttgtgtttaaacatactcagattttctagggtttttgataagaaaattcaacctgctcaaacaaaatgtgccaaagttatacttggtcttacgcttcctgtgtattttatgtcattgctgtttcatttttaaccttatcttgtctttttttaacttggtcaactatttgctaatttctttccctattcattaatttggacgctcgacttggtttttctaatctcctggcttaattctcaatggttagacatcaaaccaatgcttttttcttattgcttcacaactaaattgctggctcactcatccctccaccccacacatctgcaaacttcatagtacacttctaccatcccactctcctttgatatcacaccctttcctaagtcctggttttgctgaaatcatttacaaatttattactagtttctttaatgttatcatttctcttttttcaaagatccctatttgacatatttattattatctattgagatccaatgcccatcaattctctcttcttttgtctagtcattgagattgcaatttacttatcttgtgattagcacactttaaagtagttttctcaaataaatacaaagggttttatgctctcttagtccttttgtatataaaatgcatttttaacactgacagatgaacatgttgtctgtgttcagattctgtagttgcagttctattctctcagtagtctatgtatattgattcattaccttccactttccagtattgtagatgagtcatccattgcacaatacatttattttactttttcaggtttaggttcagcctgtttaggggctgaacaaggttacttctttatgcttgcaacctaggaaggtcaccaggacatgagtaagcatctattttcatttaatctcactaaaatttagtgagctctttcagtttgcagatttatgtttttttttttttttcatttatgtaagctttcttccgttgtttatgacaacttttcttctatctgttcgctttttccttcagggactcctattattcatagctgtgtggataggctattttactttgcccttattattatatctctaccactttttgagttattttttcctgcttcatctcccatattaaaaactagctctcaaggactatgcccttttttaactcattttttggacatttttagttgaagttacagaaattgtattttgtgccctgcttactttttcttgagacaacaacaacaacaacaacaacggattctctcgcccatcaattctacttgcttgggaaatctctagactagacatttgtcttgattctctgagtttcatcctcagtttctgagtctccctttgtgtgtgagttaacttttctttccttcaccatggatacatgtttttgatgtaattgtcgtttgtcttttatgctatcttaagcagtggcaaatgaggggtagtagagggcaccatagtttacggaggcgaaagacctgaaaagccatagctcctttgctgaacatctgaagaaggctttttggtgacaggatttcccagaaatgagtggagtcatttattgacccccttctccacctggagtaattcagtctctagtgagcttcccttcctggcccactgagacccacaggactctgtggactgctcctggaccacaagcagcatacaggcaggtccagctcctctgcgggaaatgaaaggctctctgccctgagcagtggcctcaggggaccagaggactcagactttgctgcaagtcctgcgacaggtacttcctctctagcacaggcttcttagttctggccttgcaatgatatggggaagacttgaacctgttttctctcctatggatactagggaatctcaggagaaactgaaattgatgtgtcatgaaggtcccatccacatgcctgacctggttgctgtattagcagaggaagcagtaataggcattcattacatcatctctcccttcacctgtattttcagactgagattttcattccaaaaaaaaagagtggtgatccattttaaagtgtttttttaaaagaaaactactaatgaatgcctgaaagatattccaatagattgtctaattatgtatacatacaattaatcaccttactaactgcatatattatcaaaaggacagatggaatgaactgtttaaatgagcataatttatagtaaaatatgcagctggatctgtttgcattacaattttctctgtgggaaaatgatattcttttgaaagacactaaaaggcactaaaagatttagcaaattgttatgtgattatatttaaatatctatagtctcactgattttcccctagaattcctgattccagattctcttggaatcaaatggcttgctttgaacataatttgttaacttttacaagccaacactctagctctctgaaatattcatgccaaagtgataacattttatggaaaatcaatgcacataaaaatatgcctaacttaacttgaaggtatgggttatcctgccatagagaagaactgtgtcaggatttaaagaaggtgattaggaaaatcaaattagtttaaatgatcactaagtatttcagtgtaggttatggggtttggtacaggacttaaattcagaggactataatagttcagaagaaccaaaatagaagcagtggaggcaagctctagtaaccacttctcaatgtgcagctccagattattgcagtgaactcaaccttgatggtagctggacagggtggaatttgccaggggcatgctgggagccatctaaaagggagaaggcaactggggtctctgcagaacctagttgcctggagggctcccaccaaagtcacctgtgcaggtgtccaatctcaaggctttctgcaaatcccaggcattcagcaggcagcctgtggaaaagtggaacggtggcttccatttgtcactcttagcctggcagccctccactgctttggccctcctcagtctgcagcccctgcaccaagaagggctcattgggacccttcttctgtttcatattctgcagtgcattccacctttgtgagtacctacaagttaaaacttaactttttaagagttaagacaaaatttgtaagagtataataaacttttctttttttttgcattactttaagaaaacttagaaacaatgcatagaaaagaagagaaatatttatttcttcttacaaataccccaaagcagtgtttcccaatctttttttaaatcacctcttctaagaagtcttttagagattttgttcttaatcaccacctcatggagttttgatacctctaccatattatatatctttttacatactctactttggttatttggtctacaaggcaatctgcattataaaagagagaattttctaccccccaactaagaacatattttcacccctttggaggtgattttactccctgttgagaatgcatgctcaaccgatatacctggtttgatgtcgccataatgaggcaggagaatagggtctggaggcagggaacctaagtccatttcacactgacttcttagaactaaattgaaagaaaaaccctaactttccatgcctgagtagcaaaaggaccaggggctactccctttgcaaacccccaccttttctgtgcggcagatggataattgaaagtacctctgatcggttgcttttcccaaccagacacttgcctaggaatgtaacttcgtaacttcacctcagcctctgattgcgggcaaccacttcatttacatggggtgaacaccaagtaggtggccaatgggaaacctctagggggtatttggacctgagaagattctgtatctggggcccttgagctgctgcttgggctcactcccacactgtgaagtgtactttcactttcaataaatctctgctttccttgcttctttctttccttgctttgctgtgcgttttgtccagttctttattcaaaacgtcaagaacctggacaacttgcagtcgagaccctctaccagtaacaacagcagagtttaactaatctcgtaaacacaggcctatgagataaaatggtagagatggacattgcccatgagtggaaagatatttgaaatgtgttatctaatatttgtgttgcagtctctgttttctaatttcaaagaatcatgatggatatcatgagaaaaaaatgcatatttatcacaaaggaagattacaggacaaagctcacaagaaaatcagttcaggcaatcccattctcttacatgaaattcagattcaataacaacaaaaagtgattactgattacctgtatcagtctggagctgtctgtaaatcacctactcttagcttatagtgtatatcagtatgttataaagagcaaattttgagatggatggttgagaagtccagattgtcattattgtattatatttttacctaacaagataatgtccagatcttttagaaacacacacaaaaagtaattgtcagaagaaacctatttacttgaagtttcccagaaaatgaaattaaactcaacaataatgtcaaagactgctgctatggcaagattgattattttcttcatttggccaatttttatgattaatgaactcaaacgtgggtgtcagattttgttggggccaaaataaatgactcttcattttaacaaatatcataaaaccaaatgtcttcagaggaatgcagaaatcacttttctagaaaagaggactccctgcaagacggcaaaatgagttcatgatttatgaaaccccttctgtttcaaacatactgtgatcaaaggaaaaaacaggaaaccaaagaggcaggaaggaattctaaacgaggttaacctctttgttgaccagaaatgcaacagaaacatatgctaggtcaagaatcaggcaatgttggactcaattgcttcctatagggtgaggagactaaggcaccttagataaggtaaagatgagaaccttcatagtgaaaagacagggactagaatgggtttctctgctaaggaaaggacagagaccaactacccaaggctaagaccttataggcagctgcaggcctccagaggcaggaggagaaattatcagcttatctgaaaaatcagaacaagatattttatggaatatagactagtgacaagaactgtgatatcacccatatcaaggggctagcattctccaaatgacacttaaaaacctggctctggatggtagggtccagggtcaaggttaaggcaactgcaatatccctaagaaagtagaagtgatcatagagggagggagagagaaataagaaaatctcccaagccaaatgaggcagcatgcaaagattttaaataaatctaatgagaaagaaaacaaaattctaaaattcaaactatgaatttactctcagtaaaattaattttgtcaaacttttttttcaccatcatttagttgttttcattattttatttttttaaattaaattcaattaaatttaaagttccaggatatatgtgcaggatatgcaggtttgttacataagtaaatgtgtgccatggcggtttgctgcacctataaacccatgacctaggtattaagccccacatgcattagctatttatcctgatgctacccctccccccacctcctgataggccccagtgtgtgttgttgttctccctgtgtccatgttcagctattcagtgttctcattatccagctcccacttataagtgagaacatgcagtgttcggttttctgttcctgtgttagtttgctgaggatgatggcttcccgatctatccatgtccctgcaaaggatgtgatctcgttcctttttatcgctgcctagtattccatagtgtatacgtaccacattttctttatccagtctatccctgatggacatttgggttgattccatgtctttgctattgtgaacagtgctgcgatgaacatatgcatgcatgtatctttataatagaatgatttatattccacccagagaaccccagtaagaattttcaaagaagtttaagatgaccaaagagataaatgaaaaagagaaaataataaaggtgagaggagaaatttaaaaaacaaagaaataaagggacttaatagttcaaaatattgggaacgaaccaataatttcaggtacattagaaactgttagtgtcaaccaaactaaaagctggttctttgaatgaaaaataaagaattttactggcttttgcctcaagttcctgggaagtagcctctacatccttggaatttgccaattgataggtatctttgttatttatggtgaccctggtagtttatggcaatgagatcattcatgagcactggccatgtcagaaactccaaccttgtgtgcatggccagtgattccagcgatcatgcctacctaaggaaatcccaatcagaagcctcagcacaaagctcaggtgagcttccctggttctcagcgctctgaatattgtttcacatccatgtgctgagagggtgatatgtcctcactccatgaaaagaggaaacagcaagtttcacatgtaggactctccagacctttctctctgcatctcttcttttggctggctctgatttgcaacctttttgctttaataaaaatgtaatcagaagtatagcactttcctgatttctgtgagtcattctagcaaattatcaaacttgagaaggctagtggaaacccccgagtttttagcctgttgatatgtcatatgatatgtcatatgtcatatcaaccatattagccatatgatatgtcatatgtcagggaggccctggaaccccctgagcttacagttagtatctcgagtaagggtaatcttgtagaggactgtgcctctgtgctgtgaagtttggtctaaaatccaggtagttagcatcagaagtcatttacttctataaaaaagaaagttataaataaacaatattggcagcaaaaaggattatacattcagtttcaatagagattataaaaatcctgagagaaaactgtggaaatgtgagacattagttaaaattaatgactctataaatagcaagcaataaaccatgaaactgacaaaccataataatcaaaccataaaataagtcattaatcaagatctctcttctccctttctccaccagggatcccactgcaaacaatagccctagatggtgttccagagggactttattcattctttcacagaagagaaaaagagaaaaatatgtctattccatttgtgaaaggaagtgtaacttccctaacaaaatcagactagcaatgtaaaagaaaataaaatcacagaactactatccttatgattgaaaattcctaatataatgtcagcttattggatttgtttattaaaagtaatgctataaaatcaagtgtttcaggaatctaaaatagtttcagtatcaaaatatctattattctaatatactgcactaagaaattaaaaaggaaagtctgtgtagtcagctcagtataggtagaagaagattgaatactcaactcataatgagaaatgctcttggcaacctagaaatagaagtgagctttattaacatgatgaaaggcatctataaaaacctacaaatgacattaatgatgaaatcataagcattcgtatcaaaatatagaaaaacacccagcatgtccactatcactgcctctattcaacattttattagagacccacacccggataataaaagaagaaaaaaatcagagatatgataattagacgtggaaagacaaaaccttaatttcagaagatacaattatctacatagaaattccaatcaagtctatggatgatcacaaacaaccaattgtagtaaagttgctggctatgaattaggtcaatataaaaaattaatattattcctacatcaataaaaatgtaattgaaattatttcattcacaaaagaaactgtaggatatgtaggcatgaatgtaacaaaaaatgtggaagacctttggagaaaattataaagcattgttggaaaacactaaggaaggttagaataactgaatagagatgttcttaacatcaattaaaatctcattactaaaatgaattaaattttcataatgtagagcaagaatagcaagaccaagaacagataaaacaaatctgaagaagaatatcaacatcagtagcttgccctaatagatctcaaggtttattataaaggatagcacttatgacaacatgttatcaactaaagctttgatgtatagacacagactgaggtgtccagaaacacaattgtgcacatgtgtaaacctgatatatgacagaaattgcactacaggagtgaggaaagaatgaattttcaatgaatcttcgaaggacaattgtttatatatggggaaaaaatcaagtccttatctcattccaaatgtattggagtctaaaattgaaaaagcacaacttgaaaactctagcctttactataagagaatgtctttaatgactctggtatagataagacacaaaaagcactgaatcaaaaattaaagatgactatatcttacagtgttaaaattaataacttctattgaagaaaagacagcaaataaaagttaaaagacaagctgaaggctgggagatgtctgcactgcatactactagataactgaaaaatcaattagggtacagattaaacaggcaaaattatagaagaggaaattcagggctgacagaatacgaaaaaaaggtcaaatctctatggtaaccaagaaaatgtatattaagactataatgattatatgagattgtaagaaacttaaaaatcctgaacaaaaaaaagtagtatgaagtagagctgctcatatatcctggtaggaatgtaaattgacacaagcactttgaagttcaatttaacaatatttagcaaagttgaaagtgagcatatctgacaaattcacaattttaagtctaggtatatatttagaaagagctctcccaaatgtggcacagaaattctaatgacaatgtttactgaagtattgttttcaacagcaaaaagttggaagcaattgaaatacccattgcccttacatgcagaacaaataaattcatgcttcaatcgacatgaatcaatttcccaaatataatgaggattgaaaaagtggcaccttaatacttcatactattataaagcatgcattgatatgatgaatatagttctctgtggattagggagaaggaggagatcaagaagtggtacacagggatcttctactctactaatgatgttttatttctgattgaaaaacctgacccaaacatgaaaaactattaattttttaaaaatctgggtgacggacacacaaatattggttataatattttctctatgtgttgaatttatgaaatactttctaattaagaaggaaataaaagaaagtcacagattttcaaaggatagaaatttcaaaaagaaggaaaaataaccatagaaaaagaatcctgcaaaataatcatattaatacacaaaggctaatggttgcttctgacatcataggtatctgacataaataagtctaatcctgcccaaatcttatttgtgtaaaattaatttagtctcagcacgttttgcttcatcaataatctgttttagaaacaacattctctcaagctgtaacttctctcagcgaactagcaccttggcagtttatgactcattccctccgacaagacaacttaatacatatttagtctaccacaatagagaatgatttttagatctattggaaacacggatttaataactaaaactgctcatatggatatgatgtgttgagacaaacactgacttggaaattgttcttaatttcttcttgtagagtcactaaaatttctttgataaatcatgttattgccacaaattttaggtatacacctcactcaagattacaccagataatctcacagaactatagcttctaagagtagaaagaggtccttagagtcacacatcgatggccatatcttatttactttatttacctctgattccccatcaccaagcacaactgccatgtaagaaaggatactaggcccttcttcctctctgttctctgactttataattgaaatgagatgaaaaattttatatccatgtgaaatctttgcagagaaactctgaatgtatttaaaataaatatttcctgtgggggactaagagggcttaagtaatagatgatactttcttttctgaggaatctagatcctcttaatagcagagctttttgttttgctgaacaaaaagcaagtgaagatgcaagtctgggggtggagtggaattgctgtgcatgagtagcaggggaagagcctgcctggctgatgacaagttggggagatatgggagtaggctgggtaggagggatagacagagttgagggtaagaggagttctagttaatttactgtggggtatgtagcacagagtcctaggacttctttctcccctctggcttcattggaaaacatgactgtcctcattaatacttaacaccaggaggtggaagaggattgagctccccattcagataggtctagaggaaatcagagaacatagctggggataatgctagggggtgacacagagctaactttgggcctctctgtaggtccgttgccttccttgttgtatctctcccatctgtttgtgagtttctcaaaagaagaattgagataaaagaagataaagcttttaatctcctgtgctgtgctgataaattttgttaaatgtacagtctaatggatacaaatacattcatataataataagaaaaatattgcttatattttatttcttaagaaaataatatatattttaaaatgtaatcatgttcattataacatatgatttaatgtgcaataataatatattctcttagatcacaatgaaaagttaaaattcttacagaggaaaataaactttacctttttctgtttatgcataggctacaaaagaggtaaactgtttcctgtttcttaactaattctaaatgtaggttaattaatccaaagtaacaaaacaagtccccagcttcacaacagaagctaagtatcttaatttattcttaaagggtgatttttagactgtgagttggctcttaatgggtaaagtgctttattttagattttctaaataatttattctggaatatgtgggaacttaaaaaataacttctttaaaagctcatgacctgttgtgatccatttttaaaataaacttttcaaaatattacataatgctattgccttacatactgcatcattatagtctataaacttgaattgctgttattataactattttgagaattaaatgagacaatgaattcttttaaagcacttagaacataatgggccccccaaaaatcatagctttattgttgtcagtattaaaatatttgactttaacacaaaatgttattatttatttgtattttaaataattgaatataatccaatattcaattatttgacattgctctctgtttctatagcttaaaccaagatccatttttgtaaataaagttttattggaaaacaaccattctgagacacactcacttttgtacaatttcagagttgagtagttgagacagagagagggtggtctacaaaaggcaaaatgtttactatctgggtctgcaagaaagagtttgccaaaccctggcctaaactcaagacatctttataaactttataaaaatagaatatattatgaaaaagtaagtttaattaaagtgactttttcacattcatttgaaacaaatcactttgtctcatgtataagtttctgatacaaagagaaatggcaatgtaatctgaataaaaacgaaacatacttggggaaagtcaaacacacaaaatcaaaaacagagtggaacggccaggagtgatggctcacgcctgtaattccagcactctgggaggtcaagatggatggatcgctcgagcccaggagtttgagaccagcctggctaacatggcgaaaccccatctctactagaaatacaaaaattagctgggtgtgcctgttatcccagcttcttgggatgctaaggcaagagaaccactggaacttgggaggcagaggttgcagggagccgagatggtgccactgcactctagcctgagcaacagagtgggactgtctcaaaaaaaaaaaaaaaaaaaaaaggagacaaaaacaacaacaaaaaaaccccaaaacctagagtggaacaaattcagaatgcttaagtagttcaagagtacactgatggggtctatctggttgtttaagtcaacaaaatcaccactacctagtttatttatttatttatttttccaggatttcaagttagtttttagctggttaactgatttgccgctttgttaagaatgaatgacatgtggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaaaaaaaaagaatgaatgacatgttaaaagctgcattcatgtaatgtaccaatgtgatgaacttgggaataagtgtacccctgtgaaaccattaccatcaatgccattgacatatccaccacctctcaaagtttcctcccacaccctttcttattattattgtcaggggacaacaattattggacacataatatatactgaattccaccatccaatcctgtctgtctgttgttgaggttgtttttatttttaatattatataaaaaagaaaaaagacaaggatttaccaactacccctggactctacaatacacttaaatagtaaccagtcaactctacaacattcaattatttgacattttgttggaatttcttaaggtatgaggataaatcatctaccatacataaacacattaggaaaggatcaattctgtacatgaaaaagttaggtaaaatttactaaagaattcccttccctgctgttgccagtgtggagggcctattcacttatgctccaggactgatttagtgtgaccacctgcccaccctgtgctagatcacaaaagcaatgttactgtaatctctaatgtcaagattccctcaggagcagatgcagattcctcctcccagagagataagcataactgtaatctcttgtggtcatttctgcttttgtttcctggcatttttgccagcaaatctttacctactgatgctattactcttgtatcattcttctgtctcatcgatcttcccacttctccctcctcagagccttgaactaatctttgagtctctcctacgttaaataatgtcctctacattatcaatctctgttcccagaatctactttctgtctgtgcctcaactgattctctctcaaatacatgagttacccctgcagccctttccagccctttctagtagaacatgtagacgaggaagaggtgcccatccattactccttgatactcctttgcaacgtattccatgaggttaaaccatgctgtcacccactctccctgtagctgtcttctgtccttctgtcaatctgttcatcagtcactcgctcattccccgtgactttgctccctgactccactcttctctccaagaactggcctcactctgagtgacttcaatgtccatgtgaagactcagccagcgccttagcttcaacagtcgtttccatttctgccttgactccatcaatatgtttaagccacccacattcacgtgacaccctagattttatatttcattacttagaattaccctggaattgtaaaatcctggactccactctctgatcataacctcttctggttctattattccatcactttggtggtacccgtcctttaaccatatagagaccattgatccttcaccttcactcctccattctcctcccatttccacatccaacagaaaccacagggtcatcatttcaactcctttgccagcaatccatcttttccccttgtttctcagttcccctaacctgaaaaaaatccctaaaggtggattgatttaaatgttgcttttccctcttcttatacagggctaaaaagtcgcagagctatctgaattggtatcactgtaaatccatagtcctaaatggatctttaatgttgcatttgctgtattgttaattttttgcctaaccccaggcacctcttccctctcccctttctttgccaacttcccacttcactgtctcatcatctggctggatgcagaccttgcttcctacttcctgggaaaaacagaaataacttgatgaggcttccttcattgttctttccctgtgttagaaatttacctgcaaatattagtatcagtctaggcttctttctgcttttttttttttttttgagatggagtctcactctgtcaccctggctggaattcagtggtgcgctcttggctcactgcaacctccgcctcccaggttcaagtgattctcctgcctcagcctccagagtagctgggattacaggtgcccgacactacacccagctaattttttgtatttttagtatagatggggtttcaccatgttggccaggcttgtctcgaactcctgacctcgtgatccacccgccttggcctcccaaagttctgggattacgggcgtaagccaccatacccgaccttctctctgcttttattgacaatccattcatcgtgtgctggattttcagcaaaattatacctatttttcagaggctgggctggatataatttcttcatcagcccctgtcattagttctccatagcacaaaactcttattgtttattgttttttttttttttttttgctagattgtaagctccatataccaggtggccattgggcaaatgttgcatcacagagactgtagcccagtaaaagttttgtattaacggtattttgtttcaggagacatacttccatgaagaggagaattcagaagcgactacttaaaagtttcttgatatccacgtagatgtctatgctcgttaggtacatgcaatcaattctttttcagaaaagcttgtgcgtgggtagactaaatttttattaaccaaatcaatttttaaatgtactgagagaattctaggaatgtaataacacttaattatatggcaaattgattttttttatgtgaaaaatgctttggtaaaaataataaaattgtgacttttttctgtcttttcagtttactttttcataggttggatttattgaagcgttgtacaactgtgtatgtatacctcactcacacaatgaatgggtttctacgttgtcaatcaatttttttgtaaatatgtaaccattgaattctgagatatattttaggtaagtttttacattaaaaaaacaaagatcttggaaaattattaaaatgctttaatataaatgcaaaatgcttattgaaagaaataaaaattaaaatattttaagaatcaggtattaacaaaattaccttatcaataggaagtactattccaaaactgtaatatgatatgtagagtgctagggagatgcttatttaatcatgaaacctacctttaattggtgtctttaatgtaggttgtaacacccgtttctagaggagtaatttatcattaccatctctctatatgtccttccagccctcttctacgtattgctgagctgaccagcttatttatgatcttctgaatctgtgcctgcttgtacttagtaggaaacaaactaatgtacgctgagaaagggagagataataagaggtggataggaaaacagcaagattctagagtaagacccaggggaaaagggttaccctggcaacgtgacatactgtgaggaagatgactcaggcccgcggtgacaggaaatgaatcaggccacactgtgaccagaggaaccacttaagaagcagacaatgattcagctttggtgaaagtcaagtaatgaacaggctacacttcacttttgcatctctaagaggcactgtccgcggttcacctgctccttgcccagcgatctgcacggtggagagctgcttacctccgccaggtagaactcgtcgtactgcctcctgaagttttctcctttgtagtagttgctagccgccacgatcacgtccacggtcaccatgctcaggatgaacatgtggaaaacggatgaccgcatcattttctgagggggcgaaacagacagactcttaacaaagaaataaacctcatgattaagtgtaattgacttagtccttggctgacagcacctttgtgatgtgctgctatgcaaaacagggcttccaagataaagccatccatgtcccacactgctgaactgggcaggcaagggaacctttctttcaggcagctaaacagtgactaggaagatggtttcagagacttttgactaaaaatggaaaacatatatcatttgtgtatggcttgcatcttaatttttaattggttggttgggtagtatttatccttaattctgactgtatggataaatggcttttaaaaagctagtaacacaaaacaagtatttctttattctgtgtttagggagaatactgcagatgaaaatattttagagatgattattatacaactggaaaagtaagagaaacctgagatttattttttacttattacttccataaatatttgttgaaaattttactacaacttctagtaagtgacatgtacatcatacttgctctctacctggagtttttctaggtgctttacataaattaactcataacagccctaggaacctattctaataaggaaactgaggctcaaagaggttaagtaactttcccactgtcaaacagggattgaagatggactcaatactggaacccaagtctggtccaagtctactgcctacattaagataaagataattaaacattaaaaaataatgagtattatttattattattattattattttgagaaagagtctcgctctctcgcccaggctagagtgcagtggcgtgatcttggctcactgcaagctctgcttcctggattcacgtcattctccggcttcagcctcccgagtagctgggactacaggcgcccgccaccacgtctggctaatttttttgtatttttagtagagacagggtttcaccacgttagccaggatggtctcgatcttctgacctcatgatccgcccgcctcggcctcccaaagtgttgggattacaggcatgagccaccatgcctggccataatgagtattattataaaggttatcatgtattaaacggttactatgttccaggccatattattcacattaaaaatatttgtgggtacatagtaagtgtatatatatatatatatatacacacacacataaatatatatatatacacatatatatttatggagtacacaagatgttttgatacaggcatgcaatggggaataagcatatcatggagaatggggtatcctttgagttacaaatgattatgttacactctttaagttattttaaaatgtacagttattattattgactgcagtcactgtattatgctagcaaatagtaggtcttatctattctttctattttttttgttcccattaaccatccctgcctccccccgtccccccagtacccatctcagcctctggcaaccaatctctactctctatgtccatgagtttgattatcttgattttgtgatcccacaaataagtgagaacatgtgatgtttgtctttctgtgcctggcttatttcgcttaacataatgatctccagttccatccatgttgttacaaatgactggatcttgttctttactatggttgaatagtgctccattacgcatatgtactgtattttctttatctattcgtctgttgatggacacttaggttgcttccaaatcttattgcaaacagtgctgcagcaaacatgggagtgaagatttctcttagatatacttatttcctttcttttgggtatatgcccagcagtgggattgctaaattacagcagctcaatttttagttttttgaggaatgttcaaactgttctccatagtgattgtactaatttaccttcccaccaacagtgtagaagggttcccttttcttcgcatcctcaccagcatttattattgcctgacttttgaatataaaccattttaactggggtgatatgatgtctcattgtagttttcatttgcatttctctgatgatcaatgatgttgaacaccttttcatatgcctgtttgtgtcatttgtatgtcttcttttgagaaatgtctattcaaatcttttgcccattttttgatcagattattagatttttcctatagagttgtttcaggtccttatatattctggttattaatcctttgtcagaggggtagtttgcaaatattttctctaattctgtgtgttgtctcttcactttgttaattgtatcttttgctgtgcagaagctttgtaacttgatgtaatcccatttgtccatttttgctttggttgccggtgcttatgggggtattgctcataaaatctttgcccagtccaatgtcctggagattttccccagtgttttcttgtagtaatttcatagtttgaggtcatagctttaagtctttaatccattttgatgtgatttttgtaccttacagagataggggttagtttcattcttctgcatatggatgtccaggaccatttattgaaggaactctcttttccccagtgtatgttcttggcacctttgttaaaaatgagttcactgtaggtgtgtggatttccttctgggttctctattctgtttcgttggtctatgtgtctgtttttatggcagtaccacggcgttttgattactgtagctttgaattataaattgaagtcaggtaatgtgattcccccagctttgttcaatttgtttaggatagatttggctcttctgtggtttcatataattttagaatttttttctatttctgtgaagaatatcattggtattttgataaggattcaattgcatctgtagactgctttgggtagtatgaacattttaacaatattgattcttccaatccatgaatatggaatatttttccatttttggtgtcctcttcgatttctttcatcactgtttgatagtgttcattatggagatccttcaattttttggttaattgcaaggaattttattttatttgtagctaccgtaaatgggattactttcttgatttctttttcacactgtttgctgttggcttatagaaatgctactaatttttgtatgttgattttgtatcctgcaacattactaggtttgttcatcagttcttatagtttccttgtggagtctttaggtttttccaaatataagatcatatcatctgcaaacaaggataatttgacttcttccgttccaatttggatgccctttaatctttctcttgtcctatttttctagctgggacttccagtactatgttgaataacagaggtgatagtgggcatccttgtcatgttgcaggtattagaggaaaggcttttcagattttccccattcagtatgatactagctgtgggtctgtcatatatagcttttattatgttgatgtatgttccttctatccccagttttgctgaggggttttaccatgaagagatgttgaattttgccaaatgcttttttagcatgaattgaaatgatcatatagcttttatccttcattctgttgataggatgtatcacattcatttatttgcatatgttgaatcatccttgtatcccagggataaatccgacttggtcataatccacattattcaaatgttatttgttttatctactttaatatccaccatagctctatatggtgagatatattactcacatttcacacagttcagagagactaagtcattttaccctagtctatttaaagtccattctggggcccgctgcccactgtggggtagagaatacttaaatggagagagtggaggctgaaggccctgggcagcagaaagaggagagagaagcagacctatggaaaggaactgagcacaaacaacacaccactgagccacatctgcccagggactagcgccaccacacatcctctttctgaggtttcatttcttctgggtatttattaacacatgcccttactgtctggtctgacctgagaatcctttagtccttgcagctcaaagagctattttccttagctgtggatttatgtcttaagcaaactgttattactaaaatggggtaagagaacaagaactgcctcttctgagcactgccaatgtctccatgactctatgtatgtgtttcatggggtcttccttatcctacatcaggtgctctgggccaaactgcctggagccgtaactccaccacttactggcactgtggccccaggggagttacttaaacctctgttttctcattgataaagtggagaaaatagtacctactccaaagacttgttattaattttaaatgagtcaatatatgtaaagggcttagaacagtgattacacttacaaatattctacaaaggtttacagaaaaaaggaatgcaattttgtgaatcaagcatttttctgttcgggaatgagaaattaattacccgaggttgaagaattaattatgttgcatatcagactcagcccatagtctagtgaggtaagtaacattgataaggatctaataatttgagacatgccagtgacatcgggaaagtagacttttattaaggcttcctgtcaccgtggctattgatgcatatccgtttccctttgactttattttacaggtaatacaaaaatcaaattccagagctgccaatcaacatgtttatatgcacatcaatttacttgcagaaatgactgaccttcataacacagataggcaaatcatctggcacatttctatgctcattaaaatttttattgttatttagtctttcttgcattgtgagagttaaattccattactattattccttttctatactcctttcagcataatgttctattagaaatatttctgctgatttccatttcatctgcatggcagaaaagccacaactttctttttctattttccttagctgtggatttatgtcttaagtaaactgttattactgaaagatccaaacaaagcttttagccatggctgtcaggaaacttttaaattggttttgtaactgtcacagcttcactttggtgctgtcattataattaggttgttttttgtctgaatgtctacatgtccctgttggttcagagttattaaaataatcacttacaatggattttgatacactataatcaccattgcttagctgactttctccaaagcagtaactttcaaatattaaataagaattaaggtgataaatatgtgcagtacctacatttaaatattaaaatcagtaactccagctttaaagttagagctagtggcatggcccacttcaactcaattcacttcagccagtgcttgaaactggctatcagtttctttaatgtaaaaaggctgatgacattacatttagattcatccttgtatctacaggaaagtccaaatttatacttttcaattttttattttctaataaaaattaatataaaggaaaatgttaaagctgagtcagtaccacaaaatattatatgacttgaggtcttcacaattgcattatttaatatggatgcatgatctatccctctacctatctatgtagacagatgaacacatacatctctagtatatgtgtatgtgagtacatacatatgtggattcacatatgtgtgtgcatattcttttttatttatatattttaatataaggtccttcagactccacatacacatttgattttttaaagtttcctttaattgcaatgtcattttggtttacattttttaaaagcagaggagttttggatatgtttttagtttggctttgatccaaaaattacttatctgtgtatatgacagctggaattttcaaaatacaaagagtctatactagattaatccccaaggcagcattatctgtcaggaatgagcattgttactcaaagtgtggtccctggaccagcagcaacctggaagcaattattaagaatgcaggatctcaggccccatcccaggcctactgaatcagaatctgtatctttaacacggttcccaggtgattcgtgagcatgttgaattttgagaagcactgttgtaggggatactccttaatagcaggctgcactgggtgacctataagattatttgcaacttcacagtttcatgattctaaaagtctataatgactagaatagaataccacagatgctggctggaatgtaatatgttggactacactaacataaaaatggctgccaaccttgtccccataccccaactccatggtcaaaaatcaactaaatctgtttggcttcataaaaacaaaagcatgtgttagttttgcaaccatttggaggcattataaagacatcattacagactctcataaagttaagaaatgcaaatgcaggtggcctccaggatgtgaaaaaagcaaggaagccatttcttctccagagtctcccaaagcaatgcagccttgttgataccttgtgtttagcctaaggaagtccattttggacttctaactgcagagttctaagagaatacatgtgtgtggttttaagtcactgaatttgtggttatttgttacagcagcaacaggaaactaacacagcattgtcaacgattttgacagacaccagctcaaactgtcttgtataccagctcaaatcaccttctatgaaacatgattgtataaaagtgcccagggctacaaaatggtacctgaccatagggttccacacaaggtgacttgccaacgtggggtctctgtaactttgacaactacagatataaaactcataacagcaaccaacgctttcatcttgctttgtgtccaaaagtgtaatgagacaatgagtctggaacaatgggactgagtccaacctcaagcagaacaacaagaaaggtcactttttcccgcattgattctgagtcctgccatgaaagcaaacctcccaggagactgtggaagtctaagccaaacacggggagggcttctcacgcaattaaaatggacaccaacaggatggattattgaaataagagctactgttttctggagtgcttggtttgtgccaagattcattccaaagatgttgcttgctcatgtaataacatctttaatcctcaacaactctgtgaggtagatacttttgcatccccttttacatatggagaaacaggctcagaaagtctaagtagatttctaggcccacagagatagaaacatcttagacattgtgagcccaaaccaggtagtctcttgccttgtatcagacagtcaaaattcatcagtcaacattgctctatatattaaaaaagagtgacagcagcttcctcaccaagtatttgtggttggatagaaggtataagtacatgaaccctaaatctgaaagctgaagacaatctgtttttcacagaaagatttaagattgccatggtttaatggaatatcaattttgaagacaggatgaactgagtttaaatcttgtctctgtgctggatttcacctttctgtgactcagttttctcacagaggaaatgagtatgatgacatctacatcttttggctgtaaaacgaaaataaatgagacttcagtgtagagtctagcctgcagtggacaccgtgtgctctgtaactctcattatttcagtcttggaaagcactctaaggatttgaaagtagagatgcagtcagttgcttacagggaaggcctgaaggtgtaacataagaaatcaggtggaagagattagtaatcttgaaatggaccgtgaacatttataaactttcaaaatgatctaaagctatcttatctttttttgtggtataaatgcttaagtacttcataaaagctctttctattaaatttctccaataatttttcctatgaaacagtaacttaaagattctgaagactgtaggcaaagagacaaaatagtggtctcagaggttgcaataaatataaattaggataatgaatagtacagctcagaaatgaaatctgtctttaaattgctgcttgagtgagtaaaacaactcaacttagtaaaacaaagtctcctccactgaatactgcatcagccatgtactaaaacttgtgttttaattggattttgaaataaacttatttggagaacaatgcaattacatgatgaaattctcagaaaccatcttgcatatgagccatgaacataagaacaaggacacaatgtaaaagaccaaatgcataaaacctaaaataaatctcccatttgcaagtgggacatcttttgcttcccttatttagaagacatctggatattcattacttctactatcaatgtacacaattattctgtccaatacaaagaatttatatgaaaaaggtaacacttatatcaacactgaaaacataaccagtggatatccttagagactgcctttcccatctgtctgttcctgatgcgtccttagagagtcaggacagaagggaatccacatgtccatctccacaaaggtaccaagagcctatgatttcagtggacaccctgccagctgccacgccctatcagtggctggctctctttattggaatggagagccgagtaagggaatcctggacagaccctttatctctaggccatgtgagtatagctttcactctactctgtaagagtaaggttagatgtgaaatcacaaatcaacaaacacatgtggatgttatttttttcaatcaccagctcctcttgactttacaacacaaactagattttaacaagaaggaaaaagcaccagtaatggctggtgtgaaagaaatcacctctaagcaggattgattatgatgccaagccagtgattttcaaattcctcttagcctgtgtgaaaaaacccagtggcctccaattgaattcacctccctgtatccacacatccttggcagtatcctccacaccaactccagactcagccatgtgacttattttggtcagtgagatggtagcaaaggtgaagtaagcagagacttggaaaatacttgtgtattagaaattactcttgctgctcttggaaccccgagcgaccacatcaaccctgcagcctagcctgttgcatggtggccaggtggccatgggccctgccattctcttcattccaattaatggcgagccacacccaaaatcagagatgccagctgacgagtggctgaccgcagaggcaggggtgagctcagctgtagtcagctgagattggctcagactagcagggctgttcaactgatccgcaaattcatgagcaagagttagtgtctgtccaggccattaagttttaggatgccttgtggtttagcaaaagctattatacctaccaagctggtttcctcttcctggcatatagctcatctacatcactcagcttactattactgaagtggagcaatgtgattggttctcacaaccagaacagaaatggaagtgatgcatcactttggatgtgtcactttgagaaagggtgtgccttctcgaaagtctccctctctctttccctctacagtgatgttggaaactaggtactttggatggaggcatcaaaaattccactttctgcaaacaaaattttgcaacgtgtttacatagacatgtatgacatgtatgtatgtatatgccatctctgactgcagtgggagtgcagcttgccccagctgtggtgtgctggagctgcaatcacatctctctccaccttcatgtttactgatgtcatgttggtgacttgaaattggccatggtgggagcatttacattatggaaagcagaaaatgctaacagtcaggactcctggacttcaacttgattgttcaccacccagctcccccagctcttatggcatctctgagtctgctgtagggtatttgaaaactcatacattgatcataaataataacccttgtgggaaggggagactattttctgggcttttctaaggtgtttagctttgttactctagtctgggtcatatatattacatatagtccttttctgctgtttagagactccttatcaatcataatgccatggcagtcacatagctatgatgccttactaagcactaggagcacacaaaagccatttctgggcattgggatactgccactaagactacagagatacaaatatatcagttaaagtaagaaatatttaaaacagaacttttcctatatcctgcccaataaaatcatctgtcttgaattgatttaaaacatgggaaattttctttatgaaagcttcaatttaggacaacatgtatttcctagagtacaatgccataatggatattcacaatttaaactatcttatagaacactacttaaaatctcctggtttcctcacactttgtggcctacatttatggattagtaggagaaaggaaaagtaaatgatgacatgtacaaaaacctttcaattaactaacctataatttatggattaagaactcaatacccctgcatgacttcattattgacttggaagaaaaattaagaataaacatgctaaaatcttggcttttcaacaatgaagtgttcactttgcttacttggctggacatgggtaagaaaaataaaaaatattagttattccgcaacacttttctttcatgttccttggtgtccagaaagagtagaaaaagctcatatatatatatatatatatatatatatattttagcctggtgttcctaagcttcagtactcagttcctgcaaggctggattcatagtagattcaacaataatttttgatataacttaatttcctccatgtactcaattggccatggagcatcttctgcctccttctgaggaaagtagcctcgggggtgaaacatttctctatctcctgtattaaatgaaagtaatgttggtactgttgacatagttaactggaccatgagccaggcttcagaaaggcagtttcccctgaggtgtcttagcaaggactcctaaaagagggatgctgtaacctagatggtggtcccaagaccctttcatccccttccctatctttggcatgtattaatacaaagtgagtaaaacaaattaggacactagagttcaagcaatacaatcttgttgcttcaagtaatatgatctcctattccaggaagccacaccattctgctttgggcacaagaagacccagggtgatggtcaacaaaggaggcctcactatacatgttccagcagtaagtctcagcctgtggcagtcaccagggctgtcccttcttcatgaccctctgattctgacatacactcaagtgtcagtgaaatactagagtaaaaattaagaatgaaaatgctaaaatcttggcttttcaacggtgaagtgttgaccttgcttacttggctggacataggtaataataaaaataagaatattagtccttccacaataattttctctcatgttccctggtgtctagaaagagtagaaaaatccaaccattattttttttagcctgatgttcctagacttcagtactgagttcctaaaaggatggacgcattagattaaacaatttgaatatacatgatgttttatatttttctcactagtactccgccaaccacatagttactgaataatctcaacagactttgacaaaaggtgctttcttagttacctgtattgttgtgagtttttctttatctttgtcttcatgggtaagttagtgagaagtcaggaaggactacaatagggctgctagacaggtgacacgacgccatgatggttttgagatgtcattgacattcccacagctaattaaattcctacatctagaatcacttcaaattgacttttatgttcatcttttatttttagtattaaacggtgggcagttgaacacaaaacttttgttttaaactcaagagacaaattatgaattcaaaattgaagctagctgtcctttctaatacactgcatttctaatgcaatgcaggacctcacttgtgatatttaataaatgcatacataaataaaataattttgagctatgtagaatctttaaggaaagactcattttgaaatatttagagtatttaggaaaaacattaaaacaaatgcgaaggactgaactgcctgatacacaaagtgacttacattttagattatgtctaaacctgtcagcagctttagagtgcataaggcatcatattgctgctccaaacccttctactgcagattgtgttgaacactgagaaaatacacagcactttcaaaccctgggtttaagtcttaaagaaggctgtgtatttaacctggagatcaagacttgcaaaaccaaaccaaacgaacaaacagaaaaactcatccttcatttttgccaaaggtgacaatgcaacaaatctttggtgatggaaatttgtctccaatggacattttaaaaatgcttggcataagttagcacatgtctcctaattaatataattgtaaacattcaagagttataggactgattcaaactggaggatgaaaatataataggagacaggaatttagtttgagataatgtggcatgcaaataattttaaaatgttctgcatatttcttccagtgaggtttaaaaatcaaagaagcaaaactgtttaattgccagtaagacagataaacaaataaataaaaataacactgatattttaatcttattttttattatcctatgcctggtcatctggtgtctattctaaatataattattatttgaaatataatcaggatatattagatacatattgaatatatatttaaataaatatatatgggatatttagaactgaggatttatacaattggcctctctgtttagtttatttggccactgacttcaaaattacaataggcctttttcaagtagcattttagctacccctttctacatgtagctattttatttttcctggttttaatatttattccaggtaattactgcataaccatttttatattcactttttcctacaaacttttcctccaagcagttgttttatattcccctgagaaattgaaaatgaatgtgtgtgcgcctgtgtgtgagtgtatgtgtgtgtgtgaggtatgtgcgtgtgtatgtgtgagcatgcatgattatgtacaagtgtgtttgtgcatgtgtgtgtgcatgtgtgcataagcatgtaaatgtctgtgtgtcactgtgtcactgagtatgcgtgaggtgtgtgtgtgtataagcgtgtgtatgcatgtctgtgtgcatgcatgtgtgtgtgtgtcagtgtgtcaccgtttgtgagtgtgcattgtgaggtgtgtgtgagcatgcacgtgtgtgtagccatatgcatgtgtgcatatgtgtgtgcgtgtgattgtgtgtcactgtgtgtatgtacgtgtgaagtgtgtgtgcatgagcatgtgcgtgtagatatgtgtgtgtgcctgtgtgcatgtgtgtgtctgcgattgtgtgtcactgtgtgtgtatgtacatgtgagttgtgtgagcgtgcatgagcatgtataagtgtgtaggcatgtgtatgtgcacgagtgtgcatgtgtgtgtctgtgtcactgtgtgtgtttgaggtgtgtgtgcgtgtgagcatgtgtgagcctgtatgagtgtgtgtgtgtacacatgcatgctgtgtttttgactgtgtgtctctgcatgcatgtgtgagcctgtatgagtgtgtatgtgtgtgtacacatgcatgctgtgtttttgactgtgtgtctctgtttgcgtgcatgcgtgagcatttgggggaagtatcgtttgacacctgcctaaggggagagtaagaatttgggtctgctgtgtgtgaggctatgttttctgcacgtgaacgcagctggatatgtacaatcacgtataattcagaaaatttttggcaaatgcctatcgtgaatgaagcaatagagaagaaagagaaacaaaaaagaaaatgaccaaatataatcaaggaatcagagatcactctgttgaggaagcactgacctgattttgagggcaggaatatgaagatggagtggagagaatgagtcaaaaaatatcaaaatactgaagtaatgacagaattgaagaaggatcagattgaatttggagaggacaaaaggagaagcataatgggttggtttggaggtttctggaaatgcagggaaaacctagtttctttgtgggaatgggctggggagagagctgcgttctggagggaacctacattctcatgggctccatcaattcttgaaatgatctgccagtttgtgggaaggttcacgaagaagacagtttcaggagtgcctaggatgtcactttgtcacttgaaatgctcacatcacacaggccacctcccctcaatcttagccttcaatggaaatgttttcaaagagcattaaaacactgaaggaataatttcgccaccgtttgacctactttcagcaagcacctgttacctccctctgttcctcacaggaggcacgcggtggaatatgctaccagagggaaactgacatccattgtaccacgtctcatgcatatgtactttcattctcttgtcagagactttcctcatggtaatagagcacgggggtgtgttggaagatggttcaaaagtgtgcagccacatctgtcaaagtgtcaagagatgaaaactcctacctgagcagcagcgggaaaacggcttgtcacagcagccgctgaggaatgagggtccaattgaatagacttctatttatcaagcactggagtgacccttcccacagctatggcttatgctaaaatagtatttaaacagctatatacctgcttggtttggtgctaaaagagtcaattataacttttcacctttctaagactcacacttaagcacacaacgaagcaactttctaatcggtttctttaataccacataaaagaattgccttattgactaaacatgggagagatgaaaaaggcacatgtgtcaagcatttaatattttagatttgtctttatatctaatatcttaaatttttatttagaaagaaacaatataccctttagaaacactcagaattcctgaacatcacttagaaaaatcaacagataaatgggcaaatgagataaacaagcaatctacagtcaggagatcgagaccatcctggctaacacagtgaaaccccgtctcttctaaaaatacaaaaaattagccgggcgtggtggcaggcacctgtagacccagcaactcgggaggctggggcaggagaatggcgtgaacccaggaggcggagctttcagtgagccaagatcacgccaccgcactccagcctgggcgacagagcaagactccatctcaaaaaaaaaaaaaaaaaaaaaaagaaaatgtgtggcccttgaacctaaaaatgttcaacatccattaatcagggagatcagggagatgcaaatttacattacaggacaccatttcgtgtcatctggtgtaaaagcctgataacatcaagtgcagatgaagatgtagacaacgagcacccttacacgtttctagaaggcatacaaaatagccctatcatccggagagccatctgccatatctcagagagtcaaaggtgctcatatcctttaacccagaaattgctgtcctagctatatatgttagaacacctctctcacgtgtgcatacaaaggcacggataagaaaggtcttagaaggtctgcaatagcaaaacaatcaagctcaatgtccatcgatagtggaatgaataaatgaatgaagaaactgggttattttcacagtagggtaatacacaggggtgaaaatgaagtagttaaaagtataacgtggactgcctgagatgaaatccccattcagtaactatgtgaccttcatcaaattccttatgctgtctgtgcctcaacctcctcttttgtaaaacagatcgtattagtacctacctttatggtgctgtgagcattaaataatttaatacctaataaaacacacagtgagtggtccataaatattagctattattatttctgacagacacataggtattttttatctgtgtttctaaattatttcagaatatgtattttttaaatgcaaggaaatcgacttaatattatgttgtaaaatagcaccaatttacaaattgtccatttgtaagtttatagtaactacgtggtgtttctctaaagaaactatcttatacagcatgatttgagcttcaggtgagactgtaatagcctatttttttagctcttaataaacttctcaagtcctataagatttagaagtttgacaggaaaaatgatccctgagttgtaagtactgcagtcaagtctcaccacttagtatggccaaagagttgtgtcctctctcctcccattccatgaagctaaggagggtggttgagtagtggttccagcagagatggggcaaggctttcagagaggattaaaaagggcggtttcaaacgactttgggtttgctctgcagggaaatccaatacttggcttcagcagacctgctctttccttccatttgcactctcctgacctgctgctcccggccacgcctcctgtttctgatgcccccacgcaacttcattttttcccagtgcaccttcacctttgggtgttttctggggagtctcgttagggcttttgattgggaggtcattacacccagtcacaatcagccatacttgggtaatatgcaaggagagaaacaaaccaaaacaaaacagaataaagccagtgttcaaggtgagaaaacagaggcaggctcacagacagaaatcatgtggctcaaacggagagtgagagacaggcagagaaaggccgaatgacacttgcaatcaatgttccctttgagcagatggtctgttccttccaaataattctttactaagtcataaatactcaataattctctcaaacccaggaaaactgcattctcatccccattttccataaacgtgtcctgtcgcgtaccactggtaggtagtgtagctgaaatatgtttccagagtcttatctctaacagaccacaatagcgtgtagtctcaaaacaagatgttgtgttgggtgtctatgcatcaggtgaagataaggagatctgtagctggggaggaagaagggagaggtgaggaggtcatgttgggagatgcgcatttaggcagttgtagcacaaaaaggaaaagaaaccaggtatggggcttggcttatctatgttcctaggcttttctttttcaccacgagtcatcttgtccccacagtatggaccaaaaacaggaaaaggcaggcagatcacgaggtcagaagatcgagatcatcctggccaacgtggtgaaaccccgtctctactaaaatacaaaaaattagctgggcatggtggcgggcgcctgtagtctcagctactcaggaggctgaggcaggagaatcgcttgaacctgggaggtagaggttgcagtgagccgagatcgcaccaatgcactccagcctgatgacagagcgagactccttctcaaaaaaaaaaaaaaaaaaaaaaaaaaaaaaggaacaggcacgaggggcccctaagtgacaagcacatcagcaatgcacagagatgagaaagagccagaaagacattgcaggcatgacagaggatgggagggggtttttcaggggttctaggacattcgcttactcgttttaacgtgaggataaatttattaggaattgcacacatttaccatgctcagtatcttattaaactcagccttattaagcatggtataaatttcattaataactggataaacatgagaaatgtcctagacaaattaatataattaagttgattaacaaaaaattttaacaagtggcgttaaagagctcaccacatataacttaccaagctaacaatacctttctgctagtcctcctgctccaaacttgtggtcttgcagttaaatttacaagtatgtgcattttcatttattataaaaacagaaagatcacttcaagggcaccagattgaatcgtttccttgcatgcctgcatatggttcctattctaattataattatagctatgattgtaattgtaatttgtgtttcagaacacaaaataaatttgtggtttcaaactgcagacaaaagatgcctatattctcctccacaaatggctcaatagagcctattttttctgtagaagagtaagaagatcttttatgtgccctaattcattgactatctccataagcaatatttgaaaagaggaaacaaataccataataatggaaatatttgatataaggtaaaatatgtatgtgcacatgtgggaatgtaggaaaacaatttaaaattagttgctaatgtgtgatcagaatcactgcccattgaaatatataaaatcctaatagttttatgccagcaatgtttctatatatatgtatatacacatatacatatacacacatatgcacttatatatgtatatataaaaacgtgtgtatatatatgtttgtgtatatatacacacacatagagagagagggagaaagagagaataaattattactcgtaaaaaactcagcatcacagaagcattggttacttcatgtatttaatttaataatggtgaggaaaattaagccaccttaatcaatcttgttttattaaattacctaattacttatagtaactggatgaggatacagagtagaaaatatggtgaaaagtataatacataataccaatggagacagttttgattttttagtacatttcatttataagagaacttgagccagcttccaattatgctgagttatgattttaacattttaaaatgttaaaaacataaaatatatgaaaatactattttggaatcactgaaatgtgtggactaattgttattatataatctttgtgatctaaagttacattattttcatttattccgtgagtcacccaaccaagtgcctcctgagacctagcaagtaacataatgagaaaactaggcttagggttacatatttaacacatcggaataacttttttcttaaaatactaggttcatttctcattgttttctgtaatcacagggtgcttttaaaatgccttgtatttattctttattcattcatccatgcatttgtgtatctttatacatttatatatttatgaatttattacttgtttatttatttccacacgatagagtcacggacaaagagaaatctttctctactcttagaaaaataaatgtatgaattcttgggtaggtaaaacactcacctccagtgctgtggagacaatatggagagttgggaaactgaggcacaataaagcctctctgcctctgctcatgtggcagccaccactcagctctggccaactctagccaggtggaaatgagagctctttattgccagatcattctcttttacaagatgggtaggacgtgtgggtttttatgtaaaatactctggtttttaaactttgggtcaaatttaaaaacaaagtcccactttgaacaaaatcaacagttcccagtagttaaatgggaactcaaacatcagtttgctgtctctcagatattattgatacctcattttttctaatttatttcaacagtttcaaaattacaaagtacagccgttcaaatgtttcattccaataaactctgttttctcattaacatacaattagtttgggttcagctgggcacagtggctcacacctgtaatcccagcactttgggaggccgaggtgggcggatcatgaggtcaggagttcaagaccagcctgaccaacatggtgaaacccggtttctactaaaaatacaaaaatcagccaggcgtggtggcgcatgcctgtagtcccagctactctggaggctgaggcaggagaatcacttgaacctgggaggcggaggttgcaatgagccaagattgtgccactggattccagcctgggcaggagagtgagactctgtctcaaaaaaaaaaaaaaaaaaaaaaaagaatgagtttgggttcttttcaatgatgctattcctaacactatatttctaaacataagacaaatttatcttatatgcttacaagatgaaaagagttctgaaagaggtgaaacataacagaagtcagggttatgtcctgccaaggctctgccaccacatattagaggagacatcctggcaaaactatccagagatatccaaagtcctacaacctctgcgaggcactttctggaagcaaactccaagtgtactgcttgctttagactccaacgacatgcatatagaaataagtgttctgtatggaaaagggtgttattgccacagtctattcaatttctagttcttacagacaagaccaggaggacaaacagagcagcttctaagcgagaggtcaaataagtactttcataagccaagaaggtactgcctccttctttcactggactgttctcggttaataaacataattgatcatctctcatgtctaaagcacagttgcagaagtgaccatgactggtatggtctctaaagtaatggaatttcccctggttggagaagcagacatcaacaactaattatatccttaatttattttattaaaattatgacagacataaaagaaaagtgtaggatgatatgaaaacatgtaacagaggtacctggcttattttttgaggataagaaagtgatgtttgagctgagttctgaaggatgagtgagaaggaagtggtgtaggaagaggaaacattctgtgaaaatgtcagtgcttcctggaggcagaaatgctttttcatgtgagataaaatgcataaatgcaggagtctgagaagaatcgactcaacattaacctccaagttactcattggaagaagaatgaggaaggatacattgaaagaagatttcaagtaaactcttccttttaattttatttccatattaattttttatgagaacatgttcacattttgcttgttttaaaaataaaaagggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaataaataaataaataaaataaataaataaataaataaataaataaataaataaataaaaagaagtggtatatgctcctgttcagccttgagggtaagataccatggtagtccaagccagggagtggaagactgagatgaaagttttcctgttacccagttttagatggcattaatcattagtgaaagccatcaagtatttcaggaccattttatcttcaatatatttttacttaattcttttcttttaattaattaattattttcttgctgagacatagaaatgtattctctctctaatcacagctcctgcccggtacaaacagataacttcttggccatcccacttttcttccatgcactcttcattgctgcctctggaaagctttattcagggccaaacacatgaagttgagtggaatgaaacttgtgtcacactgaattacctgacccctttccccccagtttctaagcatatgagtcacattcataagatgtcataagcatgctgctatattcataacacatatctcatataggggtctctgagatgccacatctatacacttcaagcccaacatctatccccacaccattccaatctttattttactatctccttgctcgattttgtcatcacacttcaccctgtcattaatcccttgttattctcaaatctttgtgataaggaggctgacttgcctcctaatttcagatggccaccttgaggcatctattaacaaggatttaatagattttaaagctctggataccatacgactctgatttggcactcagagtagccctgatagtttatttctctatcacgaacttatgattacttgcatatttttttcagctggataaagcatggggctaggagccataagacccagccattagtcctgggttctccctctggttgaatgtaattcacatccctatgttctctgaatcagcactttctcctataaatggctgaccaggcatgtaggtctttctacatcacagggttgtagtaaacctcatccttagtcattcttttcctcattctctctctctcttttttttttttttttgagacagagtctcactctgttgcccaggctacattgcagtggcacaatctcagctcactgcaacctccacctcccgggttcaagtgattcttgtgccttagcctcccaagtagctgggattacaggcgtgcaccacaacacctgggtaatatttggatttttagtagagatggggtttcaccatgttggccaggctggtctcaaactcatgacctcaggtgatctgcctgcctcagcctcccaaaatgctggaattactcaaggttttgattttaagattatgcactaaaaccttccctgacctctcaaagcggaccccaatttatatattctcattgcatcttgcattacttctttcaaaacccacatcactcttgtgattgctagctcaatgctgcctttttccctcccactctcaagcatactgtaagctctatgagtgtggagactgtgcatgtttctttcaagactatcttagtgtctagcacatagttggtactcagtaaatatcagttgatggattaaaaaataatgtcaataaaagtgctttttaggtaagaagctagtactataatctttgtcattattgttattactattagtagtgatagtaggagtaaaggtagttgtagtagttttatattagcagcatagtcaacatcaaatataggatggaaggaggaccacaaaataatacttatcaatattcattgtaagcttttctacttattgccctccatttttttaaactgacagaaataaataactaacaataaacaaaatgaaaaggcagtctatggaacaggggaaaattggaacaccatatttctgaaaaggagataatattcaaaagatgcaaagaactcatacaactcaataacaaaaagcccccaaactaaaaaacaaaaacaaacacaaaatgcaaataatctgattataaatgagcaaattctgagtagatttttttccaaagaagacatatgaatggccaataggtatatgaaaaagtgcatacgatccctaattatcagggaaatacaaatttaaaccacattgagatatcacctcatatctgttacaatggtcaccatcaaaaagacaaaagataactatttggcaaaggcataaagaaaagataacccttttacactgttggtggggatttaaattggtagagccattctgaaacgcagtatggaggtttcccaaaaaattaaaaatagaactaccatatgatcccacaatcccacttctggatatatgcccaaaggaaatgaaatcagtatctcaaagagacatctgcagccccgtgtttactgcagcgttattcacaatggtcaagacagggaacaacctaagtgtctactgatggatgaatggataaaaaaaatgtggtatagacatacaatgaaatattactcagccataataaagaaaaaaatcctgccattgacaactatatggataagcctggaggacgttatgctaagtgaaatgaactagacacagaaagacaaacaccgcataatctcatttatatatggaatctcaaaaagtcaaattcattgaagcagagagtaggattgtggttaccaggggctggggacagggggtagaaatggggagatattagttatcagtcaaaagatggccaagttctcaggatctaataaacaaagtgattcattaatggttaataatactgtattgtatacatgagatttgctaggagattagatcttaagtgttaccccccaccccacacacacagaggtaactactgaatatatgcggtgatgggtgtgttaattagcttggttgcaacaatcgttttacactgtgtacatatatcaaatcatcacattgtataccttaagtatttacaattttatttgttaatcacacctcaatacaaatagaaacaaaaagaagtaaataactctatggtaaaatggccatataaacatagcccacagtaatggctcagagtacaattttatttttcatgtacccatccttgagttgcataagaagtccctatctggagaaagacccaaaagaaagaaaagagatacagtctcatcccacggcagatgtgaacacttctccaaattatgagggcaggatataaacaactatggaaaccaccccttgcgagaagaggatttgtcactgaaaaccaaaaaggctaaagaaaataaaattctccaggtggaagaatcaattctccggtcctacgagtgggctgcttggagggaaaatgaaagtgaaaatattatggaaagttaggggtgctgctcttggtaaggtgacattattttgaatgagttactgatatttagggggcaaggaggggaaaccaaggaagagaagatgtcagtatggccccctgaagaagagataaaggagtttattgggccttattgttattattgttatccatattgttgtcaatggcagcttggagaagatggtttttccagaaagttcacaggcagggacgtgagactccatcttctaatcactgtgagaatctatctcatgaggactctcaggccccacctgcaatccttatgtttgctatcagtgcactttgctaaagaaacacctctacattatgttcctctgaaagcttccaaatgcagaaaaacagagagactatgtattaacatatttttcccagttactcggggaggtatgaaacaatgaatttgcccactgccacataactcagtccttcggtaaagaatatttttataagatttcacatgtcaacaaaattcttcattgattcaataccactgaaatgctcttacatgcctgcagccatcagaaacttatcaaatccctattgtgtatgttaaaaaaaaaaaagctaggtcctgggaatagaggaaggagtgaaataccatctctaacttcaggattttaaatttggacaaatctagagcttaaagagctgtggattttcttggatgaaataaaattcaaagacctttgctgggcgatttttaaaaatgtcattgtactgcacctggaggcaggctggggcgcgtccctggggcttgttgacatccacagctaccagctgccaacctccagcagcatcttcatgaaacatcttcaagacaaagaagggagatgagtcagagacatttaatatggaacattgagaactctatgtctccagctttgtatatttttatgttatcaaaaatttgtcttcttatggatttatatttggaatgaagtcatttcaattatagttctttaacattgaaagcttaaatgaatgaaaaaagaacaatgataataacttgagtttattgactacttgctatgtcaggcactttctgtcttgcatatgctttgcatataattgctcaaatattcttctccacaagagaaatactttagtattttatccccattatattgataaatatctattagatctgggagaaaatgaaaatcagaatttaaaagcattgtgtctggtgtgtttttactataggttgcaaatttttatttttatttagtggacagtcttccactccctggcttggactaccatggtatcttaccctcaaggctgaacaggagcactgacctaataaaaatattctcaggatccataaaataagaagtgtgcgtgtggcatagggaaagaactggtgttattttaatggtagaagattgccacattgcttaatacactttgtgtaattattttaactaggcagcaattaacctgctcagcagaaattttatgtacgtattatgaagggaacaagtagtttcttttggattaaagacccaagtgatgaaattcaagatgctacaggcccactaaatctgaaatccattgaattagatacctaggttattatctcctaggtacctattatctcctaggtatcatcacatattacctatgtgtcaatattacacccagctggaagacatttcccactttcacgtattttcccactaacatatttttctttctagttcttaggagcgagtgtgtgtgtatgtgtgtatggtaggaatagggcaaaattaaacatttttgtttttctaaataatgatactaactacaagtgctcactgtttcattcctacctgaggtcgctgttttacagaaataaatgtttcctttgtcacccttatttatgtcctcctgttagtctgaccctgtattcgaaggggtaactgctgatggaaatacgaatgagatgatgcaaagatcccattacctaggatttgtaattagagtttcaaatccctggtagtagtggtggtagatcctttgtggaaaataaacttgccttctataaaatgagtgaggtggtgagagacagttgccaaaaatcacagtccctatatgtatttttattatttatttatttttggggggagatagagtcctgctctgtcgcccaggctggagtgtaggggcgtgatctccactcactccaacctccacctcccgggttcaagcaattttcctgtctcagcctcccgagtagctgggactacaggcacccgccacaatgcccaactaatttttgtatttttttttttactagacagagggtttcagcttgttgtccagggtggttttgaactcctgagctcaggcaatcccccagcttctgcctcctatatgtatttttaaatgacaaaattaaggtgcacatttacataaagctcctttgacaaagatgccaactgcaaattgctcatctcagctgtccatttacaggattctgattttctttagaataaactgcaaaaactctttttggggtgaatcaagcatattcttcctgaatagctcattctgagaatatagacatcagtggagatgcaaacctgttataggaccttgtaaagtttctgtcaaaattctggaagcctcattttaaggataaaagacaaaaccagcattgccagtcaccagttattaataaaaaccctctgttgatacatcctatactctctaattgtggcataaaggatccctggggcatatattgactttgatcagtagcagactaattttctctcttaaatttttttttcaatagaccaaaatcaaaagaatcaatttaattttcagtaaaagtgttctcccaaggtcacttatttgtatgaaataagtaaaggaaatgcaaaaacgttcaatttctctttaatcccctgaattatacaacatttagattggttaatattacagtagatctttgagacagaagctgggctagctagcagaagccaagaatcctcagagactcaaatccttgcggggagcgtggcagggactgccagtctttcctttgtatctcttttccctgttttacaaagagaatctgtatggggccactaggctaccaagaaaaaaggccagttcttgccctttttttgaagctgagcttgaccatgtaactacatacaggactataggatgcaagcagaaaccctcttttcctgtatttccttcttcttcctgctctctgggatatggatgtgagggttagagctacagcagccatgctagtctacaaggtgactgtggtaatgggggctgtgcaaagtggaacaggaaggaaggtgtctggatccgtggcaacacagacaaccataccatgctgaatgagcacctccaactttatatgagagagaatgggattcctcatcgcatacgtcacctaagcaacttattttgggcttttttgtcccttgcaactgaatgtaacttaactagtatacgtggtttctgttagaatgtccattaattttttttttcattttactgatgtaattttcctttctcattctataattaaatattttactattaaaggcttagaaaatgaggatgagttgcaaaagaaacagcttaaacccattccccagagacaccaccactaacattttacagttaacattccaggtattatacacacacacacacacacacacacacacacacacctgcatcccacagacaaacataggatctttttttgtactaatatgtcatcagcatatcttcacatcaataaagttcaattcttattttaatggtttgcatttattccaatttcataatttataatcgataacttattgctagagactaagattgtttccatttttaaaaaattgccataatgcctcataaacatcctcaaacatatgcccttggctactgcccccaatttttcttaggatacatttctaaaagcggactttcttggtcagatagtatgtatgttttacttttggatacatattgccaaacggttttctggaaaagatgttttaattcatactcttggcaacaatgtatgcgaatgtccctttcagccagcaataaatactgtcttttttaagaaaagaaaagttaacatgaggccagaacaaagacagcatgttgacagcagggcttgtaatggctaaattgaaaggtggtagcatctcatgctgaataaaaaggctcttgcagctgagcaacctggttttgagtcccagttttaccactagccagttatataacattgggttagataattaactttccaatcattgtcattttttacatgcaaagtggagacattaatagtgcccacttcacagtattattatgaaaattaaataagacagtttgtaaagccattagactagtgcagatctcaatatatgggagtgactgtaagaagatgttctgaattagtagaatctcaccaataacacaaatgaatttccatggcactctcctcttagcacaatcatttggaagcgcatggagatttcaactttgagaattctctcaggcctgtccatttgcaactgctacagttttataactggtcggttggtttgtaaagtagctaaaaatgcttctgggattgttccattataggcataatatcatcatcatcaacaacatgaataacaggttatctaatggatagtggtaagagaaagaatcttggtaatggagaatcactagcagctgaattagaattccaaactcaagacaggcacacacacatccacatacacagtaatgcagagaaaatctaaaatttactttgcaatttgcatgctctttggattctttgaaaatttatggtttttcaaaaaatagctaatagtcactatgacagaaaatagtgaaagtggatacctggcttgatttcattacgaaataatatattcaatgatgcaacctcacaaaatttaattctcatttatggtttcctatgatgattgtactattctattattatggtttcttattagaaggcactcattattacaccatgctagaagcacccttccctgaaatgcattaattgaattgttttctcacatattttaatgatgtatattcatgaggaaataaatggtcttggaacacagtaaacacatttttgctaaagtattttctttgagcattaagttatatgtagctttctttttggaggagaaattctttccattttggatcatgtgtcttttcatccattttttctctactttttaacccagcactgaacatttatgcacaagttgctttaggcattgtataacccatattctaagaatgttgatggaaacccaaaggagaaaaactcaaaagtgcccattcttcccacaccagttctacctttatcagtcttctctgttaattaggggatattaattcagaaaacacatgtcagcaagagtgctcaatcagagataataacagacccagaaatgattgctgtctttgtgcaatcagaatatttaattatttaccaaaccttcaatatgatcctattggattatgattcatttataaaagttagatatgtattgactgtcagaagcctgctttctgtctcctaccattttaacagaaaagtagccttgtgtggctctaaaatttagcagttctttgagttctactcaaggcaaagttgggataagctcatctccatcatgagctagtctagatcagaggaccatggggctcataacaggtatctgaagtaaagcatctaaataatgggagtaaaggtctgggttagtgagatacggtactcaggacttcgtctttcagctcacctgcacatcccaacatccagtcatgggacatcactaaaaagttgtggcctgggtaaccctatagtggattaacaaagcagggtattatatcatgggtgtatgaatcacttatccttcaacccaatccacaactgagcacaaggcaatagttacccacgtctaagaatcaggcaggtatgaaatcacaaggctctcagaggccagagtcaatatttagtaatttgaaattttctacatcattttccttctgttttccagttacatgttatattatggtctcctaaagacccttggcattaatgtctctgtaatttgttcctatgctgtgtcttggaggcatttggtggtgaccattcaattgaaaaatattgcttcgttattttaaagaaacagttctcatcacagatttcctttcgcctcccttgaaatggtccctgtcagagccagttcctagtgagctgcctaatataacagaaagccccttctttgttctgaaaatgtgcatatatatatatatatatatatatacacatattttctatacacatggctgttatgggaagtctgcagacttagacatcaacaagtccaacaagcccaggaccctttagtcctttgatgagaatagcctatatttaacaactgcaaattttccatatgctagagaaaggcaagaatgtacttccatgtttgaaaagctgtgtgcattataataatcatctttattttatttccttcaaattagtaacttgtgatctagtgttttaaaccactgaatgagaagtccctgttcacggaatttggtcatattttacaaacataatagcatcatggcaaattatgtctctcccttctctacacataaaagcatcagagggcccactcgcaagtggctagccagggtgggcggggcctgaagctcgttgctaggctgcctgagtggtgtttcacccagaggctgacagcaggagctttggttgcttagcaaccaggtcctcagctatagcatttttcttaatgaaggtttttcacaattctctgtatgattaccactgctgaatatctagacgcattacctctgaattaccaatttattcctcttgattaagtacaattttgcatcaaaatgattctgtacaactttgttccaagtctcttcacatttccctttctattagaaccattgcctgacttggtggtgcttccaaacactattttttccagctgtgattttatacgtgagagttactccataaacatactatggttttaaaggaatcttaggtcatctccaggaacactgcatgtgagttaagggctgagatcatagttccatattccatttaggtctcaaagtcataactgaaaacatgtccttctagaggctgccacctcggaatggaccgggaactttcttatctctcatagtttgcaaaaagagaggagagaggagatgagaacttgctatggttgatttcttgaaggcttttctacatggcatttctgatataacctggatagcatattcaaaaaacctttcatggaagtttgaacagttgtttgtaaaaactgaataagactgacactatttcatctataatgaattgactggacaattcagacttttacagcatcataaagatgcctcaacaccaccaggcttttcccaaattagtgtgtttaattgcattttaacaaataattattaaaagctcaacttgagggttttcaaaagtaaaatttgtacacctcggctccttgatagatacctttgtcttaacagtatttgtaagtgtttacaaagttgttaaatatcctttagaatttaatattataataattacaaggcattatatcattttattcctgattctggaatttatattttctctctcttttataaagattcacgctagaagaagatacacaaatctgcccttcctttttttaacaccacaaaaacacacacgtgaaacaaaaccaaaaataaaaacaaaggcattggatctgaattgccctcttttgtaataactgccctgctgcttttagcaaatctgtagcccaccttcaaattctcaggagccttatggttttatggaaacaatattgctatggaacttatgggaatccttctgaatatatagggattctttaaaaaatcacaaacatgcatttggggttgagggatctttttcatagtttattgtactgtggtttgttctgaatgaaatatattttccattacaaaattctaatcctacacatagacattacataggcttgcaagtacatgaataaatacccataaaagtaagaaattccatagtggttgcattttatccacaagccatttgaggatttgtgatgtcagaatcaaaggtatgtaataaatgtggttgacgatcttggttttgtatcaaaaccacccacggagctgttacaaaatataggtgtcattacctcactgcctggaagctctgatttgattgttctgtgtttgggcctttgaacctgttttattttattttcttttatgttttttggggataggatcttgctctgtcacccaggctggggtgcagtgttgtgattgcagctcactgtacctttgacctcctgagctcaagtgatcctcccatctcagcctactgagtagctgggactacaagctcatgccactactcttggctaatttttaaaatttttttgtagagacagggtcttgctacattacctaggctgatctcaaactcctgggctcaagcaatccctctccctcagcctcccaaagtgctggaattacaagcatgagccactgtgcctgactggcaactgtatttttaaacagcttcctgagtcagactatagaagcccatcatgcaagagcttccccaaggtccactgatggtgagggtgagacatgtgcatgctcgaatgggttataacatcctcttgctgatagcgtacctgggtggtggctgttgaggtagtgctgcttctcgatccccacatttgttgaaactgtactctgatttctgcaaatgtttcaatgataacagcaataaacacgttctgaaaaaaatcacaaaccacatttaccaaagtctaagaatgacaaagcagagggcaaccaaaaccaaacaaaagatctgcagaactatcacagaacatagactttcttagtacaattcttcgcagtaccttcacaagccaggcgaggaagaaaatgagagtgatgaaatagaagtaggaacgccaacggggaaagctgtcaattgctctgtacatgaggaacacccagccttcctgtgaggcggcctcatagacggtgaatatactagttcctgtcatgacagaggaggacagactgagtcacagctgacttttgaaataagaaagcattttccagaaaaacaatcaatatttatccatacttattttctcaatgacaaaagtgcttcaaaaattgattagaatcacatgcaacacattttactgttctcttaaaattttaataaagttgtttctgacttcaagccagggtaatttcaacatctaacaataaaataatttgatattatacctttagctgttaaatgcaaataataatgtggaaaaggaaataaacagtcaaaccaagtatatatatgtataattaaaaaaaggatatgtaccatttaagcttgccacttggagcctaacacattcaataagctgaaaagcacctgctatagttttaaccaaaatgaaataaatgggagaactgagtttcatttgaaatcactttctcacagggagagtaaagtatctcaggctccacaattgatatgatggagcttgtctttggattccatggtgttaccgaacaccagaatgtaaggcagtgaatcaccaaataggactttgtattttctgggagaattacctcatagaaagtacttctagtaatggaaagaaaggaaagctaaaaatatgtggatagattttttaacattggttaagagaacctaaaatgccatgtagggaaaagatgtgtttaatcctaacaacactataagatgttttacagacagggaaactaaagcatataaagataaagtgacttgtctgaggatgcaaagataataattaagggaactggaattaactcagtcattctggtacaaagccccacacatccaactgtgatgatatcttgcctctttaatagtctttctgtagttagtttctccatctgtaaaatgggaaataacacagactttactgtgttgtaaggatttaatgacttaattcctgtaaatcacagggtaggttcttaagatatttcaggtatcatttatgactataaaattgaaaataattgctcaatatgcttttgtgagaaaacacacacacatataccattgaagttgtttataaaataaatataagttgttattcataaaactggtaaacatttgtacctcaataaattctacttctataaataagttttattattacagaatataaaaccaatctccactcatacatgttttagttacacagaaatttaaactagaatgtgcatatgaccaagtatccaaacaaagaggagagttgcacaggttggggcagcctcactgtttctttgagcctgtgcatgagaaagcagaatcagagcaacagcaaacaccaaggcatgcagaacagaaggcaagtccagccgcagacttgatgacaagggagaaaaagaggctggaaagaaaagctaagagaaagaagcaaagtgcagtcctatcgcctattatgcattaatgtgtgctaatatactttctatagaatataacttcataaatgtcctgcctttcattttaaaaatcatattttgtacattggtactgtaactccttgtcatacagctggtatttgtaaagcatgttgagtttctagcctctttaacacaacatgctaaggaaatctctgtcttattagctaggcaaatggcgaagtggggatgagggcagatattatcaataccatcttacagaaaagaaaagtgaaggtcactggttaatgaaggtctccaaggtggaaagtggtagaaccagaaattgaacccatatcatcaggtcaaaaaaaatttttttttaccatgctatttatatttctcttgattgagactggggctttaaaaagaaattattaatgggtacaaacatagagttagatagaaggaataagttgtaatgttccatggcagacgagggtgattatagttaacaacaatgtattgtgtatttcaaaatagctagcagagaggccttgaaatgttcccaacacatagaaatgataaatgcttgaggttatggatatcctaaatatcttgatttgataattacacattttatccataaaacaaaatatcacaggtaccccataaatatgtacaattattatgtatcaataagtatgttaaaaagagattattttctcttattatccttaaatatagttaatgtttttctgagggattataatggctaagtttattgtttctttttttttttttttttttttttagtgaaagctgggtccagggggatcactgccttctggtcctgtgatgccgccaacgtactggatataccagcatttattgttaagtttagtgagggtgggggtagtttagtgagggatttagagtcatttgattatgaagtgagatggtcacatggggatgaagtaattctttaacataatatctgtatgcagaagtacagtatacagagataagaatttacaatattgtgtgcatcagcaatttctaacagagccttaaaacagaaaacagtctttccataacctatgattagcaaggtattaatcagcagtaacagttgcagcaaaagctggttacaaacaatccatagaaacaggacgtgaagctagacaaccggttacaacacaaattctcagaagggagtatgccttaaccctaaagaggcctagaagagccctggcaagataagggcatttatagccctatcttatccatatgaacaggcgccccctcatgcatctgttcataggctctccacagtaaacttataagtttcttaaaagttgacttttaagaaaaaggttcagagaggaacaacacatacataaaatgtcaacagcaaacagaagcaactgtttttattgatgattcataggtactaacactggacaatacctttgctttatgtgcactgaatatgaaacatatttttaacattaaacaaacaatttataatgtatatcccttattttcctctaggtttttgaatgaaaccaaacagtggctacagaaatccactattatctaccattcaagtttaatagctgtattaactgagcattttcatgtagaatatggagcttgtcactataagattaaatttgagaggaacattgaaaattatcctccctctccctgtccagatctttcttaatcacatctgcaagcaagatgtcatttggagtcaagtaaaaaagagcacattgaactagtagccttgaaacttctactccatttttttttctaattggacaaaggaaaaaaggaaagaaacagaaacccacagtacagctcaaagagaagggtttgttgacacaaagaggtgagacattcgtgaaagtataaccaaaacactccccaggaagacgctgacgatggaaagaaatgtttcccatacgtgaactacactgggtagaaaggctgtgaagaagtaacagttacaaaggcaaaggcaatggacgaagatggtccttcctcatctctttactactcctggctttgccaaacatagcaaaagaaatcacttttcaaaaatggttttccaatggtcgaccaatatttaaactgacaaaaatcaaatgtatgttcctttcattttctttgggaagtggaggaccctgagaaagaaactgtagctactgaaacttcttttgcacagtcccgctctcgctgctggccctgcactgcttccctctggccctcttgacagactcctgggctgcccagctcagctcctctgtgccctcagctacactaggcaatggcccttagtactcccagagagcctcccattcaactgtctcatgtcactcgtcatactgaattctctaccttgtttgtttccctcagtaggtgtgagcactctaaagttaaaactgtatctttcatttctgtaccagacactgaggagcactcaaagattgttgataaattaaacaatgattttgtagcctacagacataggaaagcatttctcaaatatttgctttttgattaattcttcctcaatattaatactgcacagataatttggaaactattttgtagtgaattgactttgctttgctgattttcaaaattctcttaaaacacctgcacactcatatataaacataaaaacccatgctatacacacagaaaagtcttcatctactgtttgatccaacatggaaaatttctaggaagaacattgatacatttaaaatattttttctagatgtgctacagaatatttttagtccattttaattatagaactaaaatttctggctaaacgaccatatttttgttaaatgaaaaatgatgctacaacagcacctgggaatataacgcattaattttttagagaacaataaggcctgttccaaaaatatccctggagagctcttggaatagcactactttctcagaccccaaactctcaaggcacaaattaaagctgtgcaagaaatgcaatcacaacaatgatactcatgataatcagttctcctgatttcattcattctttctgacctcttccactggtggtttgaattgattaaataagaagaccacaagtctatgtttagaagataaatactaaccttgaaactttctacacactgcctgtattgagaatagtagaggatattttttatagctctgaacaaaattatattcccatctgttttgattacctttaggattttatttaccgctttgccctcttctgctgactcttttcccatgaaaaaagaggtgagatatttgtgttttgggagtactcccatttgtttcttctagtcttaggttacataaccacattgtcattccactctcaagtgagagggtcataaaattgtgatgataactagcaacacactacaaacctggggtcctaccactaaacctctctccaaacacaaaatacctatagtactattctaacaatggtaatacctgatctgccatgacagaagttgggaagttagaattggagatgtaagcccgagacagtggaataagaatgagtcagtacccaagggcttggtctgaaaaatcaccttcactcccacactcagaatttttaaaagaacaaagaggatttattttatgaccatccatttctttctctctcccagtgtttggatcctcagcaatgttcttgaactttaacccctccagggatatggaacaccccatcttctgagacagctccttaccaggtatgctagagcccattcactggatgctgccaggcttcagtccctttgggaacctctcttgggcttgcaaggcacaacaagctataggagtctgcagaattagtccttgcaccccctttgcgtgaatcatcctttgtgttactcgggtcatcctgctacaggtgcttgttttcttatctggtcctttaactcttccaatctgatctactgtttatgaaattggcctgattatccggcttcatttactgtctgggaatagactttcatctgtggtgaacaaaatggcaactttcttgttactcaagatcatcagtttccctcagacttttctaaatgactctttctgatcctccagctgactctgatcagacatcacccttttcagagagaagctgattgactttgtcctggttaaatctcagtttgagcatccccttcagttggaagggaaaagaaacttacacgttactcaaccactatacatggatgactatgctgtatctgtgtctcaatgaactgtctactgtcagtcagtagatttaactgtggaagtgtatgatcctaatcctaaactccaaatagatacttatttgctcaactacatttgcaatgactaaatattcaatcctgaatggtggtcaaataagagcttgatgttttcacatgtgcatgattagaagtacaacttgttcaagatggggtgggttgtgctatattggtttttatttgtttctgtctttttatgtttacatatatacaacttgcctaatctccagctattttttttttttgagacggtgtcttgctctgtcacccaggctggagtgcagtggcttgatctcaacgcactgcaacctctgcctccagattcaagtgattctcctgcctcagcctccccaagtagctgggactacaggcacatgccaccacgcctggctaagttttgtatttttagtagagacagggtttcgtcatgttggccaggctggcctcgaactcctgacctcaggtgatccactcacctcggcctcccaaagtgctagaactgctccatagggcaatattcttattaaactgcagaactaatgaaaaaagagagcgatgaatagtttaagagagaacttgctgaagctacacaaaatgtaagtttggtactagtgacatctgcaggtggatgatgctttaatgggaaggtctgtcctatgcattgcaagatgtgtagccacacccctgacctctacccactaaattccaacagtccctgcaacccccaaccaaaaatacttgtagacattcaccagtggcccttgttggaaaaattgccaattgagaaacacttttctaacttgacagcctctctgattcttcagcttttgccctgcagtgcctagcacagggtctagcatataatttatattaagtatttttgaaatgaattgaatctcttcacttgagatcaaatacaagacttaaaaatgacatttcattcttctttaaagatttttgaaggctaaaagcctagatcctaagacattgcttatttgtataaagtatttgccacacagtagacagctcaatagtaccattacataaatttttatcattttgctgttttaacaactaggcactggaaagaaaagcttatttctttttaaaattcctgctatgtagtaagatgactgtatacatgcatatcttagaatttgggggaagggaggctatctctgcttgcggaataagccattacaaaagtacattaattaaaatcgaaaataaattaacatattttgaatgaaataaatagtgcaaaatgttcccaaacgaaattaaatgactgccttctgaactgtcccaagacaaaccacacacagggttttttttgtttgtttgtttgtttgtttgtttgtttttgggtaagctttcaggtttttcttctgaatcaagatgagacattcagtatattcatagaaaaacacagaagaaaacagactaattcttaatccacgttggtagactctggttctgtctggatcatgagacagataatacaaacttgcaaaacagctcagtagcctctacaatgaaacctaagcagcagccaccagattaagaacaaagtggccacctcttcaattcagctacaaacttgcatttgaggtcacttttgatggcaaaatctatattgcaattattagtttttatttttggtgaactctcagtttctctcatcctctaataatctcttcactcagatataccatctgttatgcagattttagccacatattaaaaaaaattttagccaaaggtcagtagtgagattgactgtaacttactataatgtttttcttcaccaaatttccccacaccatctcagcactttcttcttaactgagagctggttctgtggtaagagtaaattgtaccccaacagtagttatcataaagtaaatgtatttagtgtgacataattaaaaaaaaaaagcagcagcgaggggtgtgtactcttaaggtggacatctggactcaacataatgaacatttgtcacggtggctggatgatccacatacatgaaataagatcatgtggatcagcagaccagcaacagcaagaaaggtgcatcctgaattgcagagatttactaaacgataaagcagctagaactaaattacttgggaggatgttaccatcctagtgaataaaacctctgtaaaccatgttttctccctccgatcctccttccttccttccctccttcttcttcttcctcttcttttccttccttccttctttttctttttcttctttctttctttctttccttccttccttccttccttccttccttccctccttccttcctttctttctcttttttttctctctctttctttcttcctttcctttttttctttttctgagatggagtctcgccctgtcacccaggctggagtgcagtggtacagtcttggctcactgcagccttcacctcctgggttcaaccaattttctgcctcagcctcccaaggagctgggattacaggcataagccaccacgctcagcctcaaaaaaataaacttaagtatttttccctgatagactgtgctgtaacattgtgcctgtaataataatcttcaacacaacttgtccacacactcaagtcatgtgctccacacacccagcctgaggcttgccacgtggcatatcaaggcaataaaacaaaataaagcaaaaaccacattttttatttgctattccagaacatgggacaaacataaaaggacttttttaaaattataaatgccttaaaaatatttataaactttatgtttttgagctactttaattttgattttggtttctttgtttgttttttacacttaagcactcttttggcacaacttgccatattggtaaactcactttgttaccttaaaccatacacatgtttacatatatcttctaagttaattttttataagtaataaagaatcatagttgaaatatgtttccttaaatgtagaaaatttctaaagttccaagttctgaacagagaatacttcaaagaaaggagaggtgaaggctttcactatagtattcacaaatggaaaagaagtgttgacaagccggatgctgacattggcaggaaagtgtaggtactacagcagaacagttcccaggacgctcagtccacacgccaactacagcactccctgcgccccctgcgctcggcaatttccaggtaggctgagagtaagggtagcaaagaaacctggtcagatacccctcagcctgtgaatcagcattctgcctttgaggagcagtgaggtcaggtcaaaagagcttcttggaagtttattttccattagttgtcttaagaagaaaagaaaggccgggcgcagtggctcatgcctgtaattccagcacttcgggaggccaaggcaggtggatcatgaggtcaggagcttgagaccaacctggccaacatggtgaaaccttgtctctactaaaaatacaaaaattatccaggcctggtggcatgtacctgtaatcccagctacttgggaggctgaggcaggagaattgcttgaacctgggaggcagagggtgcagtgagccgagatcacaccaccgcactccagcctcggggacagagcaagactctgtctcaaaaaaaaaagacaagacaagaaaaaaaaaaacaaaaccctacgctttgccacagttagctgtcatttacagttcctaacattccagtcatccattacttcttacctaggtaacctgtgtgagtcagtacaccctggacctcaacttccatggatgcactagggcagtgatgatactgctgatcaccactaaggcgctaaagaaatgttaattagaagcttttcaattgtcctaaagagtacacaaaatatgtcataccagaaatatgtttcctctgagggtcttttagttttgtcacccatattttaaagatttattggaaggaaatcttttcaaaggaaattgaagcaaaagggctagaagttcgcataatgttaagataatagttatgacataaaaaattcataatagtccaaaaattagaaccaagcatttggcaaaagtactaagatatttttcctcctattctgagatatgcacatggttcatatctgcatcatcatacatattcaataaaaatgaaaatgcaaaaattaacaataaggtagacctggtcagtctacctcagaagagctacaagagcaattatttatttatttatttatttttaataggaaggctgaatgaactagtaaataatctcggaataaaaagatcaaccaagattggaaataaataattgacgtttgtttataaaggcagattaaaatccaattttaaaaaatccgattaggtctacgtgggagggaagaaacatacctgagtgatagggaccaaatgtaattttaaataaatgtgagataagaaatacaaataacacatggaattaactaaaaataaagttcttatttgtattacgataaataccaaatttacactgaatgtcattaatttaaatatttataatacagcactaaaagcaaagatgtgttctaatatcatttgtaataatattacaacttaatggttaaaactgaatagaaaatgttaactaactgctaaaaatttgaagcttgtacatggggaaattgttctgtcttataacttcacgtttacatatgtgaataaaaatattcacagaatttttcctgtatttgctatccacattcttcagtaagcttccaaagcctgaaaacatgtttaaaattgaaatttgttcaactggtttaggttttttttttccaatgtgctacagattccagtttaaaggttaaactaaaattaaaaatcatttttcatgtattaagttatgctgccaagaaagctctgtactgtatattcctacttttccagcatttccaatgtagaccagaactctacagaggtgagagaagaatatgagaaaattgtaaccaattaacttttaaaacactgttgatttccagttactgactttcagtgtgctcagcatttttcttgttatgaagacaggattgataacttccaagctctttacaagcagaaacagaaaccagaagtcaaaaaagcttcgttttgatttaagatatagatcaaaaatagtacagataaatgaacatatttgattagaacgagttttaaattaatgtctacaaagacgtggttctctgcttacatgtggtctagtctgcctggtcacaatttggcttatgcatcactaacagcacaggatgaaaaggccgtcattagcacagagagaggctgaattgtgatggggcgattctcctggtggaccccaagacattatgtcagaataatgcattataagtcattttccccaccaacaactttttctatttacgttttaatatttgcctgttttcttttctgcttgattttaacaactaactgcaaggcaacattagatacagacaacatacttagaatagtggcgaaagaggaaggaaaacggtcattcacggaatatggttcaagtacccattacataatagcacaacaaacttaatcaaagccagagagctttgggcagctgtgatctggcctgcttatgcctggaataaaatgtctttccgcgctctcattaggcacattggcaagacggctgcaccaggccagagctcatttggccagcaatcatacctttctagcaagtatctgggctaacgacctcaagagagcaatcagacatttgtgctgtggctgatggagtaatactgactggctattcctgactgggaggaatacagaaaaatcatccctggaaacactagctaaactctaacatgcagagaaatatggagcaattggcaattatttaaaactttaatagtattttatttaattcactattcagaaggtataactcactgttcttgttcatcaaccaatgcagggtattcataagtctttttgtagagtgtaggtgttcgtcttacaaatcactttgcagccaggtgtttgagcttcaatgacctccatttaaatctgaggaaatatctaaaatgatttttattttaagtttttgtactttaattttatttttaattttaagtacacttatttcagatgtaaagacttttttgttattttattatgttattatttttattttatttttaaatttaagttctgggatacatgtgcagaatgtgcaggtttgttacataggtatgcatgtggcatgatggtttgctgcacctattgacccatcatctaggttttaagccccacatgcactaggtatttgtcctcatgctctccctccccttccctcccaccccctgacaggccctggtgtgtattttgttattttttgagacagggtttggctctgtcacccaggatggaatgcagtggtgccatctcggctcacttcaatctccgcctgggattacaggcggatgaggagctgggactacaggcactcactaccacgcctggttaatttttgtatttcttgtagagaccaggtttcgccatgttgctcaggctggccttgaagtcctgagctcaagcggtccacccaccttggccacctaaagtgttgggattacaggtgtgagccaccacacctggcctggaataatttttttcttttcttttttttttttttttgagacggaatcttgctctgttgccaggctagggtgcggtggctggatctcagctcgctgcaatctccgcctcccgtgttaaagtgattctcctgcctcagcctcccgagtagctgcgactacaggtccctgccaccacgcccagctgatttttgtatttttagtagagatgggggtttcaccatgttggccagactggtcttgatctcctgacctcgtgatccgcccgcctcagcctcccaaagtgctgggattacaggcatgagccaccgcacccggcctggcctggaataatttttaaagaaaaaattattgttattgtttgttgacaaaatccggcattatatacctgacggtttttatgaacctctgtactagattcattcaacaagattaggaatgagagggcaggtcaaacgttgtctcttattgggacatgaagaaatggagttgaatgttgtatccaactctcttacttggttaatcttgtcactttctgccttctcatcactggtggttacttattggttggaaggaaataagtatctcctatgatagttgtgtttcgtaattctcttatagttgaataaatttgctattgcctaatggacgcttataaaatatccagcacaaatcattgaagttaaagaggcacaaggacattttatcatctacatagacattttagcaagacaattctttcatttggcctatttaatttttccagccttttaacccttatgttttgacctagaattcacaactacctcatactgcaaaaagagacaacaatcaaaaggctaatattcaaggttttaatcttatttgcacgacaaattcaagtccaacaatacctcttgtctccttttatctcaaagctttaattttagggagacacagattctgtacaatgtaggttataccattgtttatctcattttattggaaaaatgcagtatttataaaagtttgtccaaattttaaagtttaaagttgtttatcctttttgtccctttgtagattgtaaactccatgaaagcagccactctgtgttggtcaccaccatattcctagggcctgggccagtgcctggcagatgaaacacaggtatgttaatctggacaaaacataaaatgtagattaaatgggcaaaggaaagtaacaaagcagagagaggtcagggagaggggctggtggaaatattcaaagaggaaacacatgtaaaagggaagagtgtgttggaccatgtgaagagccacaattatagaggtcagcagactttgaaagccggccagtctgctcatctgccatcctggagggtctccaggaggggactatccagattaatttccatgaatggtgcccgaggccagttggtgacccacaccagctgccagagctcccgaggctgcagacctgctttgctgactaaggatgccccaggccctcattgccagactcagccacctcccttgagaggtgctgcattccccacatcccttcccacagtatctatcacgcattgctagctcaatggctccacttgtctccagacactggcttccatttcctctgcagatgcccatttcatggcctcatgtgacccttctcccacgtcggtcctcagaaatgtgggccaatgggttgttttaccctctatgtcgagaaattcctctaggtccagccgtgcaggcactgacaaagctgctttggcctcccctctgccctgcccttgtcctggtgattcttttataccagtcctgatgctggctttgactttagagccattgcttgtgtagcttcagtgttcacatggcatttgcaggaggtgggacaccatcgtcctccacctcagcatcccaaacgttagaatatcatcacattcattaaagtggctgagacttgtcatgaattgctgtgggtcaggcttggctcatttaatcctcactgacaccttagtactacaaacaccattttactgatacagaaagcgagttaagccatttgctaaggtcgcatggcaaggaagtgctactgtgggttggatcctgccctccatgcaagcttaatcccctgtccctatcaggctttctttgtgtggaggaagttcaggtgctattatcaggtgcattttcttggactctgagaacccaggctccttcctgcggtttctgaggtaaggggtggggctctgagatgccttcagtccctggaagagccaagcataggctgggtttgaagttcatgttgttgcatgattattaaccacaaccaatagacatgagcatcttgtttggggccattattgttatgaacttctaagtcagggtaaggtctcagcttcattttcctgctactattatggagatccttgggtgcttagcccctctttgtcgcttggagaaaaacctcatgttttggtatgattagcttctgagcagagcgatggtggtctgggccccattagacagctccaacccatggaagccacagacaactgttggccacaaacccagaacagtcataactttgaacttcctaggactgtcacagattacacagatggagagaaacatcctgttacacaccaggcctttctctatttcagttctccaccaacacactggcaagtcgttcttatcactcttacattaaaaatgaaaagactgtggcttaatgagactaaacacatccctgagttcacccagagtggatgtctggagcggcattccaatgaatccgtgctcgcctccacagactatgttctttccactctgccatgcatgtctgaactttctgaaacttttcttggcttggttttgaggaatttgaacaaattcctgtctggtatactttgtgagagcaaaaattctgcttttaaagttaaacagactagcccaagaaaagggaagggaggaggggtgaaatttccttcctgcattttggattagcaatagttcttctgtgcttttgcttgggttgaggagaacatttctctgccttctctgcactcttagctcctcaaatgattgtccaacaagagtaggtaaagatagttttaaatattcttagagttctaaccaaaatccgatatttaaaatttaaaaagcagcaagattttaattattttcactaatctgttaggtaaatcagaacaatataaaatttagcagtgactctggtttagcttttgggtgtattgggtgtaccttttggatattccatacgattactgaaattctaactatggctttgttctgtgttaaaaatgtaatcatttgagaaatataaaatagagaaattagtttataacaataaatttgttttgacttcaataaatgaagtcaaatttcatggcttcatttttggaatatatttataatggactgggcattttgtcctttggttatttaagcctgtagtagatattgctgcttgcgactctagactcattcttctcttcttcctgggcgcatggctgctcagtgagggaatatgtttcctagaatttcctgcaaggagttgtggccttgtgacaaagttcttcctgatgtatgcaactcccaagccatctacaaaaactccttccctggactcatttttcccttcccttccaccagctagaaatagagaagccaaggacagacttggagagtaagtgttgagtttggcagagatgccacagaggcctgcactttgggatgacttcatggggcccagctcatccaaatacccacatacccaggatggcagcttcagaaagaaatcaacttgtgtcttgcttgagccattgtgttgtgagttctctctttaaagcttactttaccccaactattacatagactgagactcaaagtagctatggtccgtgggcccagttctcagaaacggctgatgttcacaaggatgtctgtttggaaaaaatatgctaactaaaaattattgacatacagacattttaggatttcacacaagtatatgaagcagattggacggttcagggaaacaaaacaaggcaaagttccaactgatgtctgataaaacagctctttttttctcacaaaagccactctactaaccttgccctaagttactggcataccaagacacagaaattcacacttcatacctacacttagcccgaagaatgaactccacccatagatctaaaataacaaggtaaaatgtacaatttaatgtcacataaagatttgcttaagattctttgaaatgttcaaaggagatactttgaatatgagattgttactttttaaatatagggttttggtttcatgactaatggtatgattcaacaacatggagcaataaattatttctcaagaaaaagcattatactttaatttgtcccatttcaaggctttaaaaatcttgccaaaataatgctatttttaccaaataaaatgttaaaatacaggcaaagtcttaagaataatacacacacacacacaattcaacattactaaactcagacataccaaagaaattcacattcttgaaaggactaccaagcctgcatcttgttattctaggcaaacaaatatgagaaatatttagtactggaataggaagtattttggcaagtttttgcaagtgctttgacctcacagttcatgaccataatgaatggccacctcagtgatataaatcagacaccacatagtttgataaaatgtagggatacatttcctcatctgtcaatcaaagcatgctcattggccacttcagcacatcaaccaccccatattcattttgtctattggcaaataattcctaagacagtctgtcttaaatttcagcaagactctagtgtaatgccttgtggtttgagtgaaattcacatcatgtaaccaagcttttgcaaatttgatcattttactttatggaaaatattttcatctcagccattgttgactttgtattcttgacaagaattaagcaagtctcattgatcctttactgtgtcaaagaaaacaattttaaaaaaattgagcatgtgtagttttcattattcaatcatgttttctgttttgacataaaaagtgaaaaaattctaccagctatagcattttcaatctaatcacattactggaacttaacatgtaatgaaaccgagatcctcatatttcccctcaaacatgctcttctggaagttaatggcaagtctatctaatcactgaggccagaagctttagaatgatcttttccttttaacacacagccaatctcttagtaaatcccataaagtaaacatgaacactatattcagcatcttctgtgacctccactgctaccacctttgtccaagccactgccatctctcgcctggactcttaggacagtctcttctgtcattgcttcccttgattctattctctgcccagcaagcagagttgtcctgatcagttttgtctcgcctctactcaaaatgctccacgggctttccatctcatttaaaaggaatagccaaggtcattacgttgccctggaaggctctacgtgatccattccttgttacctttccaatcgtattccctttctctttctccatagcttcattcaagacctgttggcctcctcatatgaggaggagagcatggggcatgcttccttctcaaggcctttgcaagggctgttcccgatgccctgcacactcttccccagagagccatgtgacttgccccttcccaactactacattttccttgaagggacaccttcatggccaccttatctgaaactgcaattcctgctcacaccttcccctctctttgtctgctttccttttctccttgacacttattactacgtagcatgctatttattttacttacttattttcattatttcctgtttcctttggtagaatttgtcaactccatgaaagcaaggattttttctctgtttttcactgttgtgatcaaatgcctagcacatagtgggtcctcaataaactatttttgaatattgaatggataaaatattttcccatataatcaattgaccaggaaggaaactgatagaaaaatagtaaagaaacacattcacatataatggaaataaagtcagaactgaatcagaaaataggatattcacatatggaatgtgtaaaaaaatctcttgatggggatggcactgaatctgtaaattaccatgggcagtgtggccattttcacgatattgattcttcctacccatgagcatggaatgttcttccatttgtttgtatcctcttttatttcattgagcagtggtttgtagttctccttgaagaggtccttcacatccctcgtaagttggattgctaggtattttattctctttgaagcaactgtgaatgggagttcactcatgatttggctctctgtttgtctgttattggtgtataagaatgcttgtgatttttgcacattgattttgtatcctgagactttgctgaagttgcttatcagcttaaggagattttgggctgagacaatggggttttctagatatataatcatgtcatctgcaaacagggacaatttgacttcctcttttcctaattgaataccctttatttccttctcctgcctaattgccctggccaggacttccaacattatgttgaataggagtggtgagagagggcatccctgtcttgtgccagttttcaaagggaatgcttccatttttgcccattcagtatgatattggctgtgggtttgtcatagatagctcttattattttgagatacgtcccatcaatacctaatttattgagagtttttagcatgaagggctgttgaattttgtcaaaggccttttctgcatgtattgagataatcatgtggtttttgtctttggttctgtttatatgctggattacatttattgatttgcgtatgttgaaccagccttgcatcccagggatgaagcccacctgatcatggtggataagctttttgatgtgctgctggattcggtttgccagtattttattgaggatttttgcatcaatgttcatcaaagatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcccggactttttttggttggtaagctattgattattgccacaatttcagagcctgttattggtctattcagagattcaacttcttcctggtttagtcttgggagggtgtacgtgtcgaggaatttatccatttcttctagattttctagtttatttgcgtagaggtgtttgtaatattctctgatggtagtttgcatttctgtgggatcggtggtgatatcccctttatcattttttattgcgtctatttgattcttctctcttttcttctttattagtcttgttagaggtctatcaattttgttgatcttttcaaaaaaccagctcctggattcattaattttttgaaaggttttttgtgtctctatttccttcagttctgctctgattttagctatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcattatgtacccagtattcattcaggagcaggttgttcagtttccatgtagttgagcggttttgagtgagtttcttaatcctgagttctagtttgattgcactgtggtctgagagacagtttgttataatttctgttcttttacatttgctgaggagtgctttacttccaactatgtggtcaagctaccaatgactttcttcacagaactggaaaaaactactttaaagttcatatggaaccaaaaaagagcccgcatcaccaagtcaatcctaagccaaaagagcaaagctgcaggcatcaagctacctgacttcaaactatactacaaggctacagtaaccaaaacagcatggtactggtaccaaaacagagatatagatcaatggaacagaacagagccctcagaaataatgccacatatctacaaccatctgttctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaagacttacgtgttagacctaaaaccataaaaaccctagaggaaaacctaggcaataccattcaggacataggcatgggcaaagacttcatgtctaaaacaccaaaagcaatggcaacaaaagccaaaattgacaaatgggatttaattaaactaaagagcttctgcacagcaaaagaaaccgtcatcagagtgaatagggaacctataaaatgggagaaaatttttcatctgacaaacggctaatatccagaatctacaatgaactcaaacaaatttacaagaaaaaaacaaacaaccccatcaaaaagtgggtgaaggatatgaacagacacttctcaaaagaagacatttatgcagccaaaaaacacatgaaaaaatgctcatcatcactggccatcagagaactgcaaatcaaaaccacaatgagataccatctcacaccaatcattaaaatgtcaggaaagaacaggtgctggagaggatgtggagaaacaggaacacttttacactgttggtaggactataaactagttcaacccttgtggaagttggtgtggcgattcctcagggatctagaactagaaataccatttgacccagccatcccattactgggtatatacccaaaggattataaatcatgctgctataaagacacatgcacatgtatgtttattgtggcactattcacaatagcaaagacttggaaccaacccaaatgtccaacaacgagagactggattaggaaaatgtggcacatatacaccatggaatactatgcagccataaaaaatgaagagttcatgtcctttgtagggacatggatgaagctggaaaccatcattctcagcaaactatcgcaaggacaaaaaatcaaacaccgcatgttctcactcataggtgggaattgaacaatgagaacacatggacacaggaaggcgaacatcacacactggggactgttgtggggtggggggaggggggagggatagcatttggagataggcctaatgctaaatgacgagttaatgggtgcagcacactaacatggcacatgtatacatatgtaacaaacctgcacgttgtgcacatgtaccctaaaacttaaagtataataataaaataaaaaaatgtatatagggaatgattaaaaaaactgtcattaggcattagctagctgcatcaatcagagacacggaaaacaaacatatgagtacatgtgaaattttggagcaagggccagactaatgtaggaataggtggcattttcctaatatgcttattctatggcagatggttcctatattttacagcctgaatagttcagtcactgtgaattctctatctctagtaaaatacaatcatatttggggactagctgtacataccacagcacctcttatttccacaatatcacccacataaacccaggaatcactcagttctctattctcgatattcgaacaaatgcacaggacaatttttcaaatgaatacaaaatgcaaattatactgaacaaaaagaatttcatgtcaaagatcctcccactaataaggctttgattcagcctttaagtttcattaaaacccagcagcagcagactcctgtacaaaggcaggtgagcaaagctttgtatttaacgtgtcatttggatgcatatgaaatctgttgacttgcctgtacttaagttcatacctgagagtgtacttgttagttggttcccactggcgggaagaggacaatgctggcgagatactaaagtgatgctgcctgaacgtacctccagtgagatgctaaggaagggcttacaaaggaaaagggttaacgatggagagaggctttaaggaataaaacgtaatacaaaaataaataatcattatttgtttaattaatatgtttaatcattatttaattaccagtaaattaacgaactgtaatgctagggaaaaattggtcaaaatgagaaatatgatcatattcacaaaatgccaatgtggttttaacttagaaagaaaaattgtcaaaacgataaaataatcattaattctagaaagtctagataatctgaacacccttaaagaagagagcgaaaactgtcaagagccagcaaaggctcactgggaaggcatcagttccaaccagatttcttttccttcttaaaatatttatgtatgtatgcatgcatgtattgatattacaggatcactagcagtatagatctagtagcacttaatttcaacaagatagttcatattttattctttagaggagatgaagaaatggtagtaggcctagatgaattcacagctgactgcacaagcttatctatactaagtttctatgtagaaattaagggagaaattctacattaatttaagatataaacagcagaaaactttcttagtaagaatgtgtacaccacccatttaatatataatctctcaagaaaagtctttaatgaaactaatctatgcttttaaactagtgtctaatcataatgattaatatcaagtaatcattaataagaattgatctaatggtgtttcttaaatatagtaaacacaaacactagaaagcatatacttagaaataccagactcttttaccctaagagggtaaaaatgaaacatcactactgaggtgagtgttcagagttggtaagacttgactcctccttttaagctaccaagcctgttttttttgttcctatctgatatgctcctgatctgtcttcagtgccaaaatctcccctgaaatgaccagtgatgggacaagatatattctcctcttccttgccttctttccatgttatgcagtgtgttcgacttggaagagaagtcaagtcacccaatactcaagtgacagttgtagctctgtcactaatgaaaggaaagaatcaaacttagtctatagactaagatacttagatcatatatgagaatccactcttaaagtgtacaatgctattcaataaatgtccttctcatcaaaacttaaatgccttgtcctcttcctctcccacacagcaacagatgacaatggtctaattcatcatgctaattagcaaatagattaaattatgtactaatccctctcagttcgatcagccctcaatctaactgaaggtcatttattgcctagaggagtcctaagtacccagacattttatgttcataagtgagagagacctcactggttagggcgacctcctaggattccagatttattcttcacctacagagcatactggcaccacccactgtatctaaattacctatttatttcatgtgttcaagaacattttgtttccacattcatctttcctgactttctgtcattactgaaaatattatgtgaggtccagcaaagaaagtttccattttcttaagttcaaacatcaaatttttcttggatggaaatcttagccatctgtcagcactctgattccctgtcaagaatatacccttttatacctgtactctggaaaattcttttttaaatttcttgtatacattgcaaggagaaaattaatgttcagtttatatgttccttgcttttcaaatgttccaaaggttgggaccaggtgaccatccactctaatccttacaaattttaaaattatgtcttcctgtagattatcatagaacagatttatgagaaaaaaaatgcttcactgataggtgcagataattaagtactttcatgatgctaaatataatgtatttgatgtagtttttagattgttaaatgccttttcattttaaaaataaatctataattaccttgtatacttaaccttaattttccagctattctgtaaattctttattgaaatgcacagtgttcaatatattttttttagcttcatctcctcatcttaggattttctaaaaattaaccaaagccaaattttgttttcgagggattaaatggctatttcctgaaattgtttagtcaaatatttagaaagttgttctgaatcatttaagtttgcttccacttattttactgtacaaaaaagtctttttaagaaaatataattatttgtataaataataatgtttgatatagaacatctttacaggtgaggacatagagataattttatgagatgaaggcaagacattttactcataaactagacatcctctggaaatgctatgaaagtcaaggaagaattttgatctgattcaccctccttagccattggcttgccaatctccatctgaaaagtgcacaccaaggacattgtccagaaaagctaacttctccctcgtaagcatcattggtttaaacccataaggtatggtaaccataggggatccctgattaatttcctattgtactgctcaggatggcctctgtgatccacctgatctggtcaattgcatcttctaacatcactccagatttcctccatataaccaattaaactactcctttagcgactcctgtgattttgtggtttctcaaacatggacgccctctcttcctgttctttcacacccttacctctacatgggccaagagccactctgaaagcctcagagatttaggaaggttatgtttcctcaccagtggctcatcagtgtttgctttattataatgcttacctctgcttacataacccacataaatgttatgtgcatttattctttatatatgcatagattattccacttttttttaaagctaaaaacattatctacttattttttaacgtattgaaatgtcagttcttccgggatgaccctgtgataatagaggagggagatcctttctttgtggttttgtagtatacaaaagtacattatttacagatatacttgctcaactgggttttaaattccttaatctgctctatcccttcattaccccttttcccattgtcacagaatccttagggtgtcacttcaccagccggaaacctctgtagccagtggcacgtttgcccaagtttttctcacccgctgggctcgttctgcccacccggcctggcaggcagcatttgactttcactaccagcctggatcccatgcccaccaaggttgagccaggtggggagcagtgcggggtgcatgagtgagtgagcatggagtctggccatggtgcacagccagacacgctggctgcggtggggtggtcagctctgggaactggcatgggcgccggctccctgctgtggctagaccaggcatactgcaagtggtttcaggatccctaagcatgaacattattagaacacagtgaagctgctgcatttggaattttccattgtcatcagaaactaatatttctgaatagggggaaatcttaactatgtgaagagacacctagcactttcagctatggaagacctatttgacatcaatttctgaaaatgacttggctcttgagcagaaaaatgtaattaattcccagatatgtgtacttcatgtcccttttatccttagtaggctgaagaggctagaattatatgcaactaaggaaatccaccccagggaacttttcaagaaagcactacaattattgataattcaccaataagaaagccctaaaactcaaaactgatgtttaaatttttaaaacctttgtggatacaattaagcatgatgtatttttagaataattatgacactgcgcaagattgtcctcacatcttttttttagtgaagaagacttcattacagctgacaagtgactcataaaaacagaaatccctgcctactcttcaaactcaataaacctggacaaaagaaataaaaacctaataaacacccacctgtgggtaaagtgctgctggatgttgttatgagttgaatggactagaaataataaactgggtaccactggagggaaaatacctgcagctcaaatgcatctcaaggggcacatgaatgagaactgcagtatattttgcagaatctcttagcaggactgtggatgagcccagacaaaatggaggaagtcccccaaggtacagccagatatagaaagtgctcagaaactctttcctctgttggtcacagggcttgtctagtcctaacctgctatagtcagggaacctcattatcaggacctctctgctcctcctgcagcctctcccacctattgttcttggcccctttagtttgatgttcttgcttcatcctgtgccaaacctactgatagtggaagcactgatttgactcaaccacacaggacacccaggctggagtgacacttctgaaagatgaaaccttctgctttaaataatgaaatactcagaaaacacaataccttctgaatcaaagcgattttatcatagtcaaaatattggcctaaatatactttgttatatttgattacatgtttttagaagatacgtaaaccatgattttgaagtgatttttttggtacatacgttcccattttcaaacatttatgaaatgcatgtgttttacctttatgatgagaaaaaaaggtaaaagattttaaatcaacaagtcatgtatattttatatacagccatttgttgcatagaagaaggattttcttatatatgtataatgaacaaacaaggctgaatttagatggctctgaaaatgtggactcatatcaggaaatatatcaaattatcattttacttttatataaagttgataattcactgctgtgaaaactaaccaatataaaatttatgaattaaaaaaatagctattctattccctaagcatctgtggatttttaaataggtctttttcttttaaaaatcaatctcaaacacacaatccctaaagccaaattcttcttatgtttcccatgatagttaactaatcttgttctttctgcccatctcatgtctcactcctgggtgatcagagcacttcctggcatcccagtaagttctattgtccatctttcctgcctattagcacagaatgaacatcatgattatttagtgtactaaaatctaccttcaggtattcaatttacaacaacaataacaaagcaagtcttacacgtatgcgacaacttttcaggtataaaggatcttagaaaaccatgagtttcctcaaattacaactcactaaaattaatacaaagtcaagaaatttgctaagcattctgaaataaaatataagctagaaaacctctggttgtcattttaagctggattttagattaaggttgtttttgcttcccctatatttctgttttagaaggaaaattaaaaattctgggacattttccattctgaagtcatttggttgttagctttgtacctttcagacacttgagatgctcaataatactgcaaagtacagttcttgctgtgtgctattatttgcagtgccatataaagaaggtttttaaaataggagaatattagagtgggggaggaaaaaaagactctatttttatatcccattagacagtttactgcctttcaagacaccgagtataaggaagggtccattaccagtttttcaggttcttggaatatgtctcaaaagggtttttgttagtgactgcagtcagctttcagagctctatccttccttgttcctgacagatgcccacaatgaactcgcctattatttttttgttttttattcttggaatggggatagctataaaatctgcttctcttactacatctatccctccttttatttgattctaacaccctattaatacaatatcttgtcgcatatctttttccattgtaataatactttcccagggttagaagaaagggcaatgagatttgccagtctgcagagcaacaccgttaatttcttgatcatggtataggtgacaataccattcaatgatgccgatgttatgacaaagtcattcttgattctctattgcccataaatgtctgtgaaattccacatttttcttttgtcccacaagccaaatccttatttagaacatggcttctgtttagaatcctatgtacgattctgaattctaggcctccagcattttatcctttcattaactctaaaatcctataaccttaaaataaataatagacaaaagtcaaatataccaatatatgtaagaaaaagacacacacacaagtccagaaggaaaatgggcgaagcatgtgaaccagcaattcgtagaagaaaaaaacctgagtggccaataaacatataaaaaaatgcttaacttgattataacctcatcagttactataaaggaatagaaatcacactcatttagttggctaaaatttacaagtttcattatatcaaatattgacatgctaagaggaaaacagatacattcttagtactggtgggagtatgcaggaacaatttggaagtatatattaaaaattaaaaatgtgcatacccagtaattctattttcaaatacagaactattcccatggtacacaaggagactcatgcaagtatattaatactccagtattagtaatcacacacacacaaaaggcatcaatcaattgtagaatgaccaaataaaatacgtgatagtcaccactaaattacctggagtaggtgtatatttattcatataaataatatgtaaacaacactccatatattctatgtaaacatatgtatatacccatatgaaagtgagtttcaaagtcaaaaatgtcatacattaaactcataataatgttatcttggagataccggagagaggaccggaattgtagataatcataaaaaagactttgctgtcttaatagtttaaagaaaagaattaatgtatttcttatgtaattgagttttttaaattcaagaaatatatgaactgtaaggcagacactctttattactaaagttttactttacaagtcaaacatggaaaaaataaaatatccattcttagattaattcattgggaaaactagaggcttataggatttttttctaatgaatttctcctttaaaaacctttgtattcattaactggatatcatttcatggggtgtatttgtgtgggtatatatgaacatgtccatgcatgtggaatatagggaattcacacagatctataactgtgtgactctggtgtgcaatgtgcaaatcaactgataatgcacaaatatatatgacacaaagtacgtcaatgtgaacaatacagatgtgtaaatgatcgtgtgcaaattatttgacaatgtacaatgcacatttttaagtataacatacacatgctaggctaagcagtgtataacttaatcagtataaaattccttactttaaagtatatgtttttatattaattccaaaagaacagcaatttttaaaatgtttccagtttattaattcaatatttttaaacagactatcaaagaaatcatctggttaacgtttgatgtgcttttcatttgaagtctaatatcgtagcagaaggttggacttgatgatctcatatgtttagtttcatctctaacctctatcatttgtgatttaaatagaaaccacttgttttaactattatagaagtattgaaactaatttaatttaaaaatctctaagcgtggtttttttattttttatttttttgagacagagtctcactctgtcgcccaggttgaaatttagtggcatgatctcggctcactgcaacctctgcctcccgggttcaaacaattctcctacctcagcctcccaagtagctggaattacaggtgcccaccaccatgcctggctaattttgtatttttagtagagacagggtttcaccatgttggccaggctggtctcaaacttgtgacctcaggtgatactgcccgccttggcctcccaaagtgctgggattacaggtgtgagccactgcgcctggccctaagcatccatttttaagtaagataactctattttgttgaataaacctttaaaaattctaaaaaatcacttcaacaaaataacagtcatgacttaccattattaacatcttataatccaataataatatgattttatttcacatatgtatacttaatataaaaagtttactattaattgtatcagtatataaaacagtcaattaatttggaatagtaggtagagactgatgaataatgaacttgccaaatttcttagcttaaataactcataattacagaccttagccatttgtattaactagaataaatgtctcagcattgtcaagatttgccaaacaaattacaaattttacggcataatctgttgacattaacaaacaatctgtactgaatttgctatgtgaacgacacaatgcaactctattaattcagcatatgtacaatatgttcttagattctatttccacaggtcccctgctataattccatcttcttcaaaatttattttaatattgtatttcctcagtgcatgattattattttacagtcaataacttttgaaaattaccctaatccaaagagcagaacataaagtctgacatgtaaatcttatcctctgcctacagcctcaacatagtaagctcaattattggttagaatttataacctatacaaatagaggttttataatggaatccagtaggaagaaaaaaataagtctcatgattttccatgcattcaggataagacagggaaacagtcacatgtactaacatgtaagttatgcatttatgcaatctccttttctggaaggcaaatattgtgcactgcctgtctgaagacttctgtttggaaaataaggtattttttcaaatgggtaacttttcttctgccattttgttgtagagtagtacaggagtcactgagataggttcctctatgtagagaggcactgaataagcagaataaacacccatcacccagaaaaccatgggaagcaacgtttaacttagtagcaatttcacatgacattaacattcagaaaatatgcattattagtataattctatttaagtatgcaaccagagggtaaaaaaatttactgtgaaggttagaatggcttgtatacttcataattgtatgacatttggtcaccgccaattagaatattttgagtcctcgtaacacgtctcaactggcttgtagaagagtaaatgatagaaacaactcatactactgtgcaacaagtatttaacactgacgaaagcaaaaaatataatgtcaatcagttaacattttagtgggtttctgttttgtaaaaagaacaaaagaaacactaaaactttgtaacaccagaatttaaaatattttatcagattacacaataaatatattttaagtacaatttgttccccaacaactttagtttttaacaattgtcgagcagtggtttgtagttctccttgaagagctccttcacatcccttgtaagttagattcctaggtattttactctctttgaagcaattgtgaatgggagttcactcatgatttggctctctgtctgttattggtgtataggaatgcttgtgatttttgcacattgattttgtatcctgagactttgctgaagttgcctatcagcttaaggagattttgggctgagacgatggggttttctagatatacaatcatgtcatctgcaaacagggacaatttgacttcctctcttcctaattgaataccctttatttctttctcctgcctgactgccctggccagaacttccaacactatgttgaataggagtggtgagggaggccatccctgtcttgtgccggttttcaaagggaatgcttccagtttttgcccattcagtatgatattggctgtggttttgtcacaaatagctcttattattttgagatacgtcccatcaatacttaatttattgagagtttttagcatgaagggctgttgcattgggcttgctatccttttccttaaaggattaaacttctggacaagctggttcctggcaataccaaaacttcacctgtctgttcatagcttctcagtggcttaaatccgtacagggttggtcagtttggaatactatcaaaaggcaagcatcttccacatgaaacagcacatactacagataaagtaacaaatgggctgactttatgaaatatctcaaacaagtgtataaacagagatgaccaaaggaacttccacttgccaacctagtacacttgagctgtaggagccaaaacactgaagggtttctctgcttattaagtttgttggcctaggtgaaagtacccctccagtgcttggcaatttgcaatgtgggcactgaatggatgttgatttttctctccttattacaatagttaatggtcactgtaaatcacaacgattcacaaatcctcttgaattttgccccttacacaaaacagccagctgctgtcccttgattttgtactgtctgccatcaagactttcttcccaggtcccattttcagggggcaaagggcctcttaagccctcctcaaaggtcagcaaaatgtgcttttcctcagcagctgcttcttttctttgttcatcatccaggctagtgctagctgctttcttacggctgatatccgttttatcctctgcagactagtcacagacagctgcaagctaattaacccctccaggtgtctctccttttaggtttaaacatggtgtgtgtggctaggagacaagatggtaagaatatgtaagaggtgttatcattattttgactcaatttctgttccttctggcctcatttcacagagctttattaatgttaccaacaccaagaaaaattagcacaaggtattcccttttaaactgattaacagaagaaaacagtttagtttagaaatttgcttgagacttgagagttcagtcaaactctgttaatgcctcaactatctttagttattaccataatttagattttatttattttggtttttgtttctgcctacaagtttccttttttacaaaaactaaacagcaaacctgtttgacaatttacttcttgaaatctagcactatgttttaagctagacaaaaatttaaggacacaattggagttctaaaacttgaaacaaatcagctcttaataaggtaggtaatcaacttataagcaagaataaatttgtaatcaaatgaaaatgcaatgccatccatctcaggttctgtgtttgtacttacctggtgcctgccttccagtggtaaacatagtgcctaacatatagtagatctcaataaatatttgctgaatgaatgaatgagtgaatgaataaacttaaaacactgctcagagatgtgactgcacatctcaggttttccaaaacattcctgatctcaaaaatcccaacaagtgcaaaatactggttgagaaaactctacttcccagacgactacctctgtcttcagaaatgctgatgacacaatctaattagtttttggaaaatacagagtatagtacagggcattgatttagagtatacatttttagttggaatgatttgcatctaaatccctgacttgccatttacattgtgggtttaggtagttgcttaatgtcatgaccccccttctttggtaaaatgagggtttttcaatgatatgttgccatataacaaatcactgcaaaatatggtgggttaaagcatctgctatttattggcccgtggttctgcagaaggcaatttgggctagggtcagatgggtgattcttctgctgatctcagctgggtctaacagggccaaatagtcggagaaggctttgttcagaagtcaagcagctggggctggctgacctcagttctccatgtggcctcttctccttttctaggctagactgggcttctctccatggtcatcttagggcagtactcagataaacaagagagagagccgcagggcctcgtgggaccttagttccaaaacttgcacaatgccactctgccattatctcaaggggaaagaaagttataggcatcagatttaaggggaggaaaaatacattccacttcttggtggaagggaggcaatgtcacatggcaaatgggttatgtgtccagagaagcgacgattcttactctacccttgcaaataatccactagagaaagtaatcagtgggttatttaaacattaaaagtgctatcaatgatagcgcttttgcatgtttattgtattttaacaaatgatagtttattgtatttaaataaatgatagtttattgtatttttattagttttctgtaagataattatttttctccttctctggctcattttcaagtaatttttctagctaaaacattgggggggatgatatttagtattttgattctaattttttaagcaatttctttaatcattcaggctcatgcttccattctaaagaatactcactgattaaatttaacccagattcagtgaattttatgtctaacctattatccacttttcaaaaattccttaaagtgaatgacaggtttaaggcacatagcctgtgtatttgtgagaggcagcagaaaggaggtgactttcagggatatacccatcccaggtaatccttcttttaaaaattcatgtttagagttcaaggaacatcgagtcagggaaagagggccagaactggatttgtgagaaatggattctcacaaatctagacaaaattagagatgtgttatagcctctgagcctcctaggataaagactgcaaaggattctaggcagctgtgggaagatagaatcaaaaaagaagcttgggctgagtggtttttcctacctttattctagtctgggggttggctaactttccgtaaatggccagatggtaaacattttaggctttatgggcctcagggtttctgttggaactactgaacttttctgctgttggagaaaagcagccacagaccatgtctaaacaaatgggcagggagttgcgataaaactttgtttacaaaaactggcagtaagcaggatttgacccactggccatggtttgctgatccctgctctagtcagttgtaaatacacagctacagcattgctttaagtctttagaagtcctgccaggacatagcgtctcagcttagaaatagctttgctggtagtatctcaaagcagtgcaagaaatagtaaaatagtttcaaacattttattcccaatgaaagtctccatgcaagagagcatacaccagtgaatacagcatatactagcaaagtaaaatgtgagtactgtatttttttttcttttttgagacagtatctcgttctacagcccaggctagagtgcggtggcgtgatctcggctcattgcaacctctgcttcccaggcttaagccatcctcccacctcagcctcccaagtagctgggaccacaggcatgcaccaccacacccagcaaagtactgtatatttttaaattacattgtataatcatgagtgttttgccagactaaaaggaggcaatctaaatctaatgccatggaatgaatatagacataggtttgtctcctatttttcccactttctatctgtgtgaccctatgactatttgctctataattccttaatttatttacttaattatgtatctagtaaagataattataatcagttaaatattgagaactcattaggtgtgaggatgagaatagtctactttagtcttcctatgacactctgtgatatgtaccatttttatccctattttacagggcagaagaggttaagtaacttgtccaacattccccacctagtaagatgcagactatgtcctgaaaccaattccttcttttatctggataggaccatccacagaatactcactattgtagctctaccccatgacaggtgaatataatcatcactgagccctgtctctgtcccctaagagctgcttctgttctctgcatctcaacatctgtaccattagaataagttaataacatgtcacacctggggttgatgtgaggactaggtgactttccttacatacaatgtaaggatcctaagtatctttacaggaaagcctctttcagttcaacttcaatttggtgtcaagatttacaatcaccgctagtttttaaatgagataatatatctgtatgcacaaatataggttattgttttactggacataagatggtaagaattgcctaggacaatttacttgttttatatttaggtaattctgaattagggtttttatttcatattttgcttatttgctgaagtacttatatggaaagtgaaagcatttgaatatttgctgcaattaatattaagaagcttaagcatcccaaatcttaatccactggaattgttctcagtactcaataattattattgctgatttgcagtcttgtctcattctcttgctctctaatattattttgtctttacacaaattgactgctgatgtgttgtcttcccaggctgcacagaggttggcataactattcagcagcaaaaaaatactaaaaataataacaccgaaatggaatatttgtaaaattaaaagttcaaggaaataccaacttttaagaactaatgcttaattaataaaatgcattttatatataagtataaaaatacatttagaatataaaatcatagatgcatcatatcaaagaaaggaaaattgcatcattacatgggaatcctaaaaatataaaaacataggctggacacagtggctcacacctgtaatctctgcactttgggaggctgaggtgggcagatcacctgaggtcaggagttctaaaccagcctggccgaaatggtgaaaccctgtctctactaaaaatataaaaattagccgggcgtggtggctcacgcctgtagtcccagctacttgggaggctgaggcatgagaattgcttgaacccgggaggaggaggctgcagtgagctgagatcatgccactgcactccagcctgggtgacagagagagactgtttcaaaaaaaattatatataatatatatatacatatatataatgttattagcagcatatatatatatgggctttaggtcaatgtgttggactatgcttatttagacacctttttcccttaccctcctcaccctatgccaaatcaacacaaggaaatagataaaagagagtaagttttgaatgtataaattatctcaaagctacatgagcaaactatccagcggtcagagagtttgggagaatataaaatcagagctgtgagcagcagctgaagccaaatggttcacagatgtacttggagtcaatataaatcttcagggcttctgggtcccaatagagagaggagttgggaggcacctaatataagacagtaagttggagctgaggtgtctctacaaagctgggtgttacaaaggattgttctgcattttatctggactggaagaaccctggcctccagctcagaaaaaagcagaatgttgcttgacttctgtccagatccatgcggggcaaaagagtctcctcagagaaatcagaatccagacctgggccaactgaagtgtgtagtctaattttacagtgcccccataatgcaaatagttcaaggacctctccttccctgatatggtttagctgtgtttccacccaaatgtcatcttgaattgtagctcccataataatccccatgtgtcctgggagggattcagtgggaggtaattgaatcatgggggcgagtctttcctgtgctgttctcatgatggtgaataagcctcacaagatctgacggttttataaagggcagtttccctgcacaggctctcttgcctgcccccatgtaagatgtgcctgccaccaagtaagacatacctttacttcttcaccttgtgccatgattgtgaggcctccccagccatgtggaactgtgaatctattaaatctttttctttataaattacccagtctcaagtatgtctttattagcagcatgagaacacattaatatattctttaagccacaaaagtaacacgagtatcagtaagaacggctgatatccatgaaactgcagcaaacacaaccccagtcacagttcaggccagagtacccctgaaaaatgagctcatagccagtggaaatgagctcatagccaatattataaaccacacaagaaaatgaactattgtaaaggagagttagaaaatatggaagcattagaaacaaattctaaaataagcatgtttaaaatgtttggtgagatgaagaaaagattagaaagaaaacagcaagaacaggaatctaagataaaagaacaggcaggtttgaaacagaattagatagaaatattaggtataaaaattatagatgttggaattgaaaattcgataaataaatagcagtctagacacactgagagaaaattaagagttcagcaaagaatttgagcttgaaaatacgtaaacaactcttggagggacagagaatgatagaagattccttgtgcaactaatcaaggatcaagagtgtaacccagggtccctgggtttttgggtacacactgtgaagaactatccacttttaactgttgcaccttgagtttccgttgtttaaaagtgttctaggaagaagccgagcccctgcaaaacaaagaacaaacacaaaaaactggtcccaggcatccggggatgcctgagctggagatgaactttggagacctcttcaccttaccatactaaatgccctgcccagggaagagcttatgtgccattttctgtatgggcaacatatgaagaagcatgaacaacagctgtgcctgcctgcactccacctctgcacacagtgactcagctaagcagcccccacaaagccctgtttccacctgtgtctggggaggcactgctttgggaactatccccagtgttctacttacttgttgccagtaatgaaatcccttggttaaatcctccttggttgtggtcattggactcccacctgccaagcaactgaacccgcccattgtgtggtaacaagagaagtcaagaaaatagagggaagttagaaagcacgatttaaagacatggaggatagaataaaaaatatgataaaaacaaatattaatcagtattccagaaaacaaagaatagagagaatggagaagagagctgttttgagaagataatacctaaaaaccttccagaattgaagaaaggcatgagtctcatatgcagagaatgagttcacagtagataaaaaataaaaatccatgcctaggcacaggatactaagaccataagacagcaaagacaaagggtaaatcttaaaaactaccagagaaaaacgatgttaaaaaaaacccaaattcacaaagccaaaaaaaaaaaaaaaaaaaaaaaggaaagccttaaaattcgactcacggtaggcttgttattggcagtaatagattccagaatacaacgaacatatctcaggttttatgtccaatcaataccaaaggagaattctgcactaattgaagctaattatcaaaaataagacaaattaaagccattttcagaaaagtacacaggaagcagaaatatttagccagctacaaaatgaaggtggcacacttaacttatgctactgtagatcttatttaacaaaagcaaaaataaaaacgtaattctctaaagattattttgcattaccagaactaataaaaacatttgtttcagaggttagacaagttacgtaaatgtgagaaataaaggaaataggggaagtgagacttgcagcaaatgtggagtgctcacgcttcactttaacaaagttatagtaaaaaagtttggaaacaatgtctgtacacacgcacacactcagacagggatgcctgcatccagcacatggctgtaagaactactacaagttaatgatccatcgtttcttctaaatttatttcaccttcatttcttgttttattttaatatctctgtttgagggctgttcatatttattaacatcattctattttcagtacctatatagagtaagtgcaaaataactgtttgttgaatatattatttatgagtacatctcattcttctgcttactgtgagaaagtatctcctattctttcagaatggttacattctcagaaaaatagaaatacatctcacttttctacttacctaaaaataaagctgatcaataataatctttatagtagcaattgtggtagtggttgttatttttgttttaatggtggcagcttatatttattagccattcatgatttattctaatacgtttattttagttttaattttatttagcatatttaagttatttagcatgttttagtatatttagaatattttgcttttatgattccagaatcccaagtcctaagggagtgagagctgaggggtagggaagaataaaggagaaaaatggatgggctctctccactgtccagtgactcctcgggatgaccaacttctttttcatagcccacatggctcaggctagaagcactttgtcaaaggctgggggctttctctccagagaaggaggctcttacctcttcagcagggttttggcaaagcagggctcacaagctggaacatggaagcccctagagttcaagggtcaggtcttcattagccttgaggtaagagctgtgttacggctttcctaaataacactattattattttttgctccaactgattagttgataaaacggatttgatttcatagagtgtccagggaattatgttctgcaggctgctgtcgccagcagagaaagtttccttgactgtccatacacgatttccatgctattctattcacatttgtttcacgtgagtatctggcttaacagagaagtcatacattcaaacgaacagtgaaattagagcctagagttgtatttgaatttgatttaaattttcaattactaaatttctgcagaatgatgattttcaaaaggcaatctatcaaatataaaattctcataaatgtgatcagccagtcctcaagtatataccgagttcaatgagagcgagaaaagacatcaaaagaagtgcctgaggctctgctcccacctgagacaactgggtctaatgaacgaatccagaacataagggtaaaacacacacaggcacgcacgtgtgcacacacacacacacactcccagacggtgggacacatgtagaacgaagtaacgaagtgtccactttgatgcacaaaccttgctatcacagttcagacagaagggagatgagtgctgctggcagattaggggaaacttacctgagtaggtcctgacaggtgagtcacaggagatgggggtagggggagcggtaggagagaggcaatccaggaagaatgggatgaacacatacattcaagaagagaatggagagaggcattccaggaagaatgggatgaatacatacattcaagaagagaatggactgccagtgttcagaagagtacagagtacggaatacgaaatgcctacattattttttttcttcaatatttatgcatattgaaaaagaataccttgtatttataaaaattcactcacgcaataaaggcagtactatgaatccttatcttttaaaaaagtaaaccgccagctatctcatattaaaaatgtgcatatcatttcacccagaaattgtttctaggaatctgttctaaagcataatcacacatgagcacagaatgtatatatgcctgtattcaacacagcattacttattgcagggaaagactgaaaaccacttaaatgtctatcagtaagggaagaatgaaaaacatgttataacataccatgaaacttacagagaggggagaagaaatgagaaaagaaaggaagagagggaaggagggagggaattatatatggcagaatttattactttcttaaatcattaaatctcttacattatttgaagtattacttttttaacttataaatgtttaaaatacaaccataaaaatgctaatttcttggaatccactagatatttccaatgaacactgtcttctacatataacatgaaataaatcatcactttatgctctccaaaatttacttttaaaatttcctttcactgtctgatgaaaaactcctctagtcactatcttttctcatccattcaacaagaactcctaaacatctttcagcagacaatggacaaccttatttttaaaaagtcatgcctgcaatttctgcctttaaactcctttcttcctaacattctgaagaatatctggacacctaatttcagtttaagtaagtctgtggccctatttgagaacctgagaaacctaaagacagtccctttaaaaatcctcaagcacacatttcatgtaacctaggggcacttatgattcaagatacaaggataaaactccttgcatttggctaagagttttcacaaatattcctcataggatgtttcttgatcttgtcctcgactcaacaaaaatatgtcaggttttccttgttccatgataaaggaatttttatcagagcaaacagaattatcatagatgaagcccttttagttgaattctattgccttagttctctcttccatatgtgttttcataaaaatcaataagtaattcctatggcaacagtaaacatcaagataaatgcatcagaaaaaccccttggtgcttttttttttttgaaagcattataaatctcaattacatattttacaaattagtctttactgggctttttcttttatgactgcagtaaaaatatacgttctgtaataaatcatggttgtagatatataactttctgttttctatttatttgtaaagttctcatctgatatcacatatggtagcatgaaatatgctttaatatcatttaactctgatgaatcaatttttagcagcagcatcaacaaaattcaatttacatcccattataatttgaataaaagtaattttctttcatcatattttatgtccatatttaacatcagatgtaataagaggcaaattataaaaataatagaatactaatagaaaaagatatagaaagttatttcaaagtcaagcaaatcctgtgttaaaactaaaacactggacccgtgtaagtggatccattgtcaatcctatttcagcaagatacaggggtagtccgaagcacagaactccaccagtgatgaaaataataactgatatttctaaatcaatatttaataaaactgatttatgacccacacagggagctgagtccatagcttatagtcaatactacccaaattcaaagaagaaaaataccacaaaagtaaataacagctacagtatatttcttcttgtaaaaaataccagtcccaaatttcaatactcataattacgttcttcagaagtgagttgggaatataggaaatctggaagactcaatcaccctttaccttagttttctgcattttcttgaaaggcccaattaatttattgttgccaaaagcaattcatgaagattacaagtcatcatcttaaatttgttcttagcatccaaaatccacatgttaactcctgtggagctgacgacttgtagttttcttatctaatattttaaggaggatatatatagaaaagctttataattttttcgtaaagaaaactaataaggtaaatactgtttatgtcacattctaataaagaaattaattaatgtggatttccaaaatcaccttgtataaatttgttggttaatttgtgataatttagaaagcaaatttaaatattcatatctcaaagaaagtaaattcaaatacacaacagaaattaatgcatgtagctatacattacatatagcaaacacatgccttatcacggcattttgaatttagttcaaatacacacaaaacttactaaaatataccaaatagcatattttcttttgcttgctaagttctctcccacatctctagccatgatgtgtctaccacctaattttacatcaaaagtagtatttactaattttttctggcattatctctaatccttgcccagatgtttacagctcagtagcttataaaactgcattgcctcccaggtacattgtttaatatttatattctttcattcaactaacatatattatgcaccaactctctgtctcacagaatacagaatacaagggactagacttaaagccagagaccaaccccttaaggggccatcagtttgcagtggacgtcacattccttcacatttactctttattatttatttatttatttatttatttatttatttatttatttattttttgagacagagtcttgctctgttgcccaggctggagttcagtggctcaatctcggcttactgtaacctctgcctcccagattcaagcgattctcctgcctcagcctcccgagtagctgggattactggcacccgccatcatgcccagctaatttttgtatttctgtagagacaggatttcactatgttgcccaggctggtcttgaattcctgacctcaggtgatctgcctgcctcagcctcccaaagtgcttggattacaggcttgagccaccacgcccagcccacatttattcttttttctaagacttgtctaaagacttcaggacaagagggaggtcaccatgttgcaggatatgccactatggcaggtcactcttttggaagatgtgtttcttccatcatcataatgagactttataatggaccaggtgtcctgacaagccacaggaatgaaggttactcatggctggctactctggtaacgtagtagtttgtagatcaagagcacaggcttcagcctcagcacacggggcagcaagacatggcttccaaatgcggctggtaagaggctctgggagagttcattcttgcttatctcattctccccactcatcagctgagggataatgataccccatgggctgattttgaggattaaaaacacaatggatgcaaaaccttttcactggtgccaggcacataatatgcaatcgataaatgataccaacagttgtcctaagtaatgacagtaattacaaaagtaacgactgtctgatggacaattagtcaccataagaatacagtgtttattatttcctggctttaccttcgacttttgaatatatagaacaggcaaagtgatccaccatatacagctcgtgtagtgttaagggcatatgttgtatgtcttttctattagttattttcagaatgtcttgattcatagtttatcttgcttgtgggcttcctctgctataagctgtttcagttgaatttcatttattctggatttttttgaaaatgggcttttgtcatttattctgatgattctaaagactaataaaaaatgcatgatagcgatttacttcctaagtgacttttcaggatgagttttatcatccaatgacattcattaagttgtttagtccaaactgaacattttttattttttacctgactgtacaatgaatgaagggttcaaataaccacctgaatagttttgttctcatctcttgtaccaaatgttttactttcttttaaaaggtcatgacaaggaatcaccagttcgatggtgtttttttgctgtgatttatttcgcatatatggtatattttgtgttgctttctttctaactggcacatcacctctgtttggataacggtcttccccatcagcatttcactaaagggaaataatgctaacattccactagaaaattaggaataaaactaagctttgcaaattgtttttgaattttcttcttaaacactattttgagttgtaagacggtttggtggaaacagcaagtatggtggacatctgcaaatctggagaagtgagttcagcctgcctctgcccggagttctctgtaattctaatcccactcactctgactctcagatccccacctgtgtgggtaaaatgtatgactgcattatctgttccagctctaaacttctgtaatttcatttccagtgttattacagaaaatcacagtgtcgcctcttttatgtctcagcttttatgtctcatatgtttatgagcaagtgggaacagcggaagtaggaactgaaagtggggtaagtattcagaaaagggaagacacattttctaaatagggtaagttgctgtgattttgtgtcacttcgacagtgtggcttttaggatgttgtcaatccccaaaccttaccactgtatgattcctacccaccttgccacccatactgcaatcacggaatctcaatgtctgctaaataaattttgcgattttgcaagatgtcctttagattatgtctactactcaggaagcttgcaacatggggagtgtgtgatatcttgagtgcacgggctaatgtcttagcagggatgagtcagttgggggtccttaggaaggagccacaggaaagctatccagaaataaagatggaaaggtgcataaatggaagaaagagacagaaataactagtatctcagttgtcacgtggctcagggaattagaggaggtcggaaaataaatcacttagtgctggagcccctgcacatcacagcatggctgtgccttctgctcaatgccccagctggtgctttacttaggctctgtggaaggagcacctgttgaaaggcgctgaaagggagaggctccaatccaggggtcacagattcgaatgtatatggataaataaataaaattaaacatatgcatgatgcttcatcaaactagaaaattcaatgacacgggctaaatgttgatcagattctagagagattggtacaagcacagaagtcaggacatttgtgagaggggaggggaataattgatgaataaagaccaaacatcaccaaaaacttgccttctagaatgctagtcattgattggaataaaatgaaatgggagatatgagttaacataggcaagatgcaaggttaagaacaccgtgccccggcgggtacagtggctcacgcctgtaatcccagcacttttggaggccgaggcgggtggatcacgaggtcaggagatcgagaccctcctggctaacacggtgaaactccgtctctactaaaaatacaaaaaaattagccaggcatggtgatgggcgcctgtagtcccagctaactgggaggcagaggcaggagaattgcttgaacccaggaggcaaagtttgcagtgagccaaaattgtgccactgcactccagcttgggcgacagaccgagactccatctcaaacaaacaaacaaacaaaaaacaccgtgcccctgccccaatgcctctcccttgaataagatactggaaaacctgcatagttaatgtctgtaaacaaagggaatcatatcagatgcagtgtgtgagtgtgaaaatatctatgtcctgccctcccttattattacaccattttccctcaaataacacagagatacattcatattttgcccgtgcatcccaatttctagttcattctgcgtttgttctacgctacacgtactctaagtgtagtttctcagttgctctttacattaactgtataaggtaggtctatcacttaccccatttcctagatggggaaattgaggcaagagagttaattactttcctaaggctgtcacactaatataaagtggagtcatgatctaaaccccagggccattcttttgaacaactgtgcttcaagcaaactttaccacaaaggagtcatgtgcccctaataattttaaacatgctacagcaaatagcataactctattcagaggttaaaaaatatactgtttgttacttttcttttgagaactattatcaagatttagaaagaattgattccaatattattactcatattgaaatgattttttgggacgtggtcatagataatattatttggatttttgagttatttctaaagaaagtaatttctgagtttatcatgcattctcatctcatgacaagtatgcacatatctctattatacatttcatatattgtataaatgttacttttttaactgctaaaatgtgaatgttaagaatatcaacataatcacactatctcccccggttttcatcttatctcttctagatattcataatttataatatttacattgtattttgtaaatcctacagttacattagctttgttcttaaaacaaatagatactagagactagctcatgataagaaattcttgattgactgaatgttttcaagaagatttcatgcaaaatatagtctctatgttcctgcctcttcaaaaatattcagaaagagcttgacccattctttccctaaagaatttgtaagcattgtgccattacattctagagttccatattgacatgaagtttcaggcctctctgatgtacctccttatagctaacttgaccttattttttctggatgcctaatgaatgttttctttagctttgatttccaacaattttactaagatgtgtctcagtgttgactgttctatgttcacttactgagaaaagctgcatccttcgaatctgtaattcagtgctctgtttcctactaagcttttatgagttatatatcatgattttttttcagttttaaaagtacctcaaagtacatttttatagatgtggtcctcattctttcaattatgactcatctttgaaataaatttttgttagaccagatgtctgtcactgtttcactttggggaggaacagggtaatgttctaggatagtgcaatggacagaatgctgatgtttcccccaaattcatttgttgaatttctaacccccatgggggtgatgctaccagaaggtaggacctttgggtgtgattagatcatgaaggtggagcccacattaatggtattagtaaccttatgaaggaggttcaagagagaacccttactgcttctactacgtgaggacacagtgaaaaggtgccattctatgaaccaggaagtgagccttcaccaggcatgaaatctgctgctgtcttgctcttggacttcccagactctagaactgtgagaaataaatttctcttggttatgagacactgattctgtgacattttgttacaacaaccaaaatggatcaagatggaattgaaggtttttataatacaggtgtgtgtgtgtctatgtgtgtatttctttagtccaatggttcataactctgcatgcacataaattaatcacctggagagcctttaaaagccatctattccttggatcactctaaggttgtgatttaattgacatgaggatggtgcttgagaatctgtttgttttaaaaggttccccaggtcatcctaagttatagtggccatgaaaaccttccgtttagcttttatcccattctagccaacccagatcagcagcaacaaagcagttgtgtcccctccactctatctccccaccaactgcctgcagaaatgagggcctctgccttgtgatgctgcatggggtcctagtaagcctccacaatcagcctttgctctgattccctgactcaaatatgagacagttgtgttcctccaggaacatgcattatcttagaatattgctatcctgctggtgctgtctgagatccacagtaggcagaatcttctcaggaagttttctgttagatgcccagtcctgtgatgtggtttatagttacagcttttcagagttcttaaacatgaaaatttcatttctgtttctcaatcttcttgatatttggatgattttggggacacaaagaggcaaagatgtctttactcttcaatcttacaacaggggttccttgtaattttttctactccatgactctggcttttaatatattttaaaatttgaatttttcaacatcatcagtgttaaatcttaatgagacataaagctacttctgccagaaattttataagtgaattgaaattcatgttttgaatggtaatttgattagtaagaaaaggaaatgggctcctttttaactaaccataattacttacatattcaagtatattagccaaattcatatgcataattaggcacctaattatgttttaaattcaaatgcatgcatgaagagatgatcacatgtgtctaataaaatattttattttcctcattttgggcaaaaaattgtcttttgtttccataagaacttttaaatatagtagtttgtgtatctacagagatacataatatcaggaagcagctatcaatttcaatctaaattataacgaccatttaaaaatgttttggttatggtacaagatcaacatttcattatctaacaattagtcatacagtgatgatgaatttgggaaaaataagcaaacggatgaaattaagcctgtatagaaaggaaggagtcatgaggaataatgaatattgccaacaaaaacagacaaaatcaggcaaaagaacaacaagaaaacaactaaattctctattgtggctctgcctcctcatacaaacatgcctggttaccaatgaattaaaaagacatacgctttgttgagcctattagtaaatatttatggagggctccctgtgagccaggcatagccctgtgccctggagacttgaagacgaaaagatgcacttcctgttttcaaggagcttaaatccttgggagataaattaacagtacagctatagtaagataattgctttagtagggggcgactgcctccaaggcaatttcctcctagaactggtcctctcaagtcagcacagtacaaggagactttttctctcaaaaagagattctaccctatattaagcaaagccattgtaagtcagagtgaagaaagatgaatcaacttgaatataatgctgcattttgaatttgggtacaattgttgcattaaaaacggtgagggtatgaggtgctttagctacatgattttaaaaaattggaggttattttctgtaagggcaaccttaaccctggaatggtgaccactctccatagaagacatggatacactcagaccctaaaagaaagagctgcagactctgataaggcatgcattctagtcatgcccagctgttggaactcctgaagcttattccgcacagcctatcagcctatatacatctcgcctcccataccacatctgtgatttcttcctcatgcctaaaagttattggtataattcatgatgcctctgtacttttgagacagagggaaggatttaagactaattacaaagttggataagtttaagagagtatagaaaattgaaattgcttcacatcagttggcttctggatttttgtgaaataggagacaatattactggtcaaaagagatggaagaatgccatctaactataatgcttgaaataaaatatgaggaaatactaaaacataaagatgaaaacctgagatgttatttgcaaaactgactttaaaaagataccatcagcccacgttcagtactatattctatataaaagctgtaactttatggtttagcacgcaggcctgacacttgaagaaattttagtttaaaaaattactctgataacaattctcaaggcataaaatacttgtttggaattatacattttttgctttaataatataatatgcgcaacttgcatggaattataaaaatacaatgatatcaactaaatggcagatgctaaattctttcattatgtatgtaatggcacattttaggacttaataaggcaagccaagaagaatgtacacatttgagcacatagttctcatgcacaagcatttcccatacatttattacttagttgatgcatattcactaagtagttcattaattgtattctaatcaaggagcacttttcagctctaatgcactcatcaatacctagtattacagtttttaagacttaccttgcctattagggtatagttacatagttacatatgaaaggaaaccaaattttgtttatctttgagtcaacaacccagaaccctgttcaacaaacaaatatttttaaatgcttaaatgctgttattgagaatcgaaatagtcaaaaatgagagatctgtaactccatacaaacactgctgcccatatacatacacagcttgtatgctacgcactgtcgggtagaatatattataaaataggcatagaattaaaatttatatttgtatttcttctatactacagccagtcaaaatattagtatcaattatttaattattctgtccacttcataaacatcacaaaatagaaacttaaaacgtattttaccagtaagacagacctatctcattaaagccactgtagcccagctcttgcctgctaagtcccagatcttcaaggtccatgcatttaaatccaggtgggcactggtagccttcttctagctctggtgagcagtgtgtgtctggaatagctaaactattccaggttacattcctgtgaacaacacatgaaagtgttagacaatttcaacaatcataaatgttgattacaatgaataatgtaattacccttcattaatatctatgtatctggccaagtgaggttgctcatgcctgtaatcgttgcactttgggaggcataggcaggagaatcccttgagcccaggggttcgaggttgcagtgaactatgatcatgccactgcattctagcctgggcaacagagcaagaccttgagagacctttgctctttctatctatctatctatctatctatctatctatctatctatctaagagtacagcaaagagaatatatatatatatatatatatatatatatatatttagagagggagagagagagaaagagagaccttgagagaccttcttgctcttatgttgtagataccaaatcactgatgacaagcattgttgatgaggttaataatatttgtaccacacactttgaaatatagagtcagttaagactgaagcgaagatggatcatttggcttacatataagaatgagaaatgaggagatatacgtgacgtgtctgtctaaaatcatatctttctggcccacccaactgtggtaattggtaatatatatatgagaccttgagagactttctctctctctctctctctctctctctctctatatatatatatatatatatatatgatgttatttgcaaaattgtgtatgtgtatctgaatatagttttaagattcataatccataaatgatattcataacattaattacatattaaacattctcaaatgatatctgattcatccccacaatagctctttataagaatactatcaccattacggtttttgccattacagactgagacccagataagcaaaggaaggaatttttctacagatttgcaaagaacgttaacttgtctgaggagtcattgtgattcacaaaattcttgtctcactgtgggcacacattttacttccccacttctaagcaatgttgcatgatgaaaatcattttctttgcagtacgaatactacgaaactcatcaatgatacttgtccttctgagtgttggaaggtgtctagtttagaaataaccagacaaataaggagaaatggaaggaactcaaggtatcccataggaaagagagattatgaggtgatttagtgatagctctaggaatataagaatcctttaggtggataatgacataacccatttttatccttcttaagaataggttggatatcaacttgatataaaggatttagatatgtaatggctttcctgacagcaagtatagataacataggactgctgactgtagactctcattctgggttgaccttaaaaatggaccccaaatagctgctatctgaggtatcccacacagattgagcagacgccaaagtctgggcttgatgatttcagaagccttctaaatccataattgtgttacactaatttcccactacatcaatgtttctaggaatttcttaaatggagaacaaccctaagacagcctcagtcacgtgagtttctgaccaaattgaggtagacttaccagatgactctttttctttaataccttcttatgttcagttgctgcttccatcccttttataatatgctttctctaaagtctgacacctaattgtgcaatcccttagctatttgctgccaccacgcatacacacacgtacatagttttacacacacacacacacacacacacaccccatggctggtgatactttgcccacttctcagccataaacaaagctccagaaacttcacccatgattcaaacaccctaagctattcctttagggttctgccctttgtcagcagcagatgagctcatctgtctgctggtctcaggaaataagtggttaaatcattgctccctctagtcatattttaagctggtcctttggaccccatctgtaaaacccaagggaaaggctctaattgtggaaattaccacaattgggtgggtcagaaagatattattttagacagacacatcgtgtatatctccccatttctcattcttacatgtaggccaaatgattcatctttgcttcagtctgatctgactctgtttcagaatgtgtggtacaaatactatgaacctcatcaacgatgcttgtcatcaatgatttggtacctacaatataacagtaagatggtaaggagactgggcttctgagtttcagagtgaggctttctgggtttgatcccagctctgccatttactggttgtgtgacttaaataaggctctaagggcctctaagctcagcttcctcatctgtaaggtagagagagtaatcataattaaaagcaaagctcatgtgagggttaagtaaagtaaaccaagtaatgcactttgcatagcacctaatgtgttgcaagtactgtactcaaataatgcttgatctaaatgattattaatcattacaataatacaatgtagcataaatcccagcatgtaaaaacagaacaataaagacttgttaaaagaggagaagaaactttagcatgttcatagaactatgcagctaagagatactatatggatcacctagttcttcatttactcttgaaggcaaggtgaagttcagagagggaagggtctactagcccatcaaaattacatatatttttaattccaaatacttttaaaaatacaatagcagaaatgtctaagataacactctgtctacatgaaaaagtttccaaaaaaatcacatttcagatatttggagaagaaattggactttggagccaatcttcttggctgtgagttctgacctacttattacatgtgtgacttaagcatgctttagttttccaatccataatggtgtgaaaacgtctacctcataagcctggggtgagacgtaagtatttacatctgtaaattgtataaaacaggtacttgatagacaatcaatgctagatgttacctactgttattgacagtttgaaagttgtagatttcctagattgaaactccagccctgtgtgtatagcctcagttatcccacttccaaaatgaggatagttattgcattctttgtaggggcattttaatgattaaattagataatgtgcaacactcagaatggtgccaaaaataagttaatcactcaactgttaatgattatgattttttaaattaatttataaatattagagtattttttccttttttcttcctattatatttgctttttctttcatattagtgctgatactcattttaagcacaactctcactagatattattttgaagtctttggcttcagaggcagcaggcttgaaacatttttaccaacatcaagttattagcaaatgtttattagaaacacatttattagaagattaattgccctggaacacatgtatctaaaaccacaaggtaattactgtttttaaaaattgaaatgaatgtcaagagtttcagaatatatatttgttaatctttgtttcatttttttcagttaacaagaatcttccagagtttatttttattcattaaccttaattatttccgtagtcattttccctcaggtactttggatagagaacaagtgactctctggagttgggggtggggtggatggaattcttgccccaccaggaaaatcctggacatagacaatgattctttcagtggtaataaatatccactcatgtttaaacgggtttcaagaccagcatttcttactcacatatttcttgaataaagtatctacttgtaatctccctcttttaactttttagcccatttctgtgactccaagacaatgaaattacttttgttcacttccatatgatatacccaatcagaaaaattttagttttatcttctgtgacctctcagcagtgctctgaattgttgtttttgtggtagagaaaatactggtcccctaaagatgtccccattctaacatatggaacctgtgagtagataatgttgcatagcaaaagggaactaaagttataggtgtgattaaggctaaagacattaaatttgggagatgatcctgaattatccaggtggacccaacctaactccatgaatcactaacagtgatcatggctgtggttggagagagatgtgagtatgggaggaagacacagatgcaactctgctggctttgaaggtgctggtttgtccatatttcttaggccattctgcttttccatctcctctagtcgtgagctgacctttagtcatgagctgctctgagctctgtctttgacctttctcttttcatgataactctcccaggcaatctcatccactttcatgatttctcaattctctgtcatcctttacatcgttgtagagtcttagagctacatgtccaactgcttattagatttctccacttggctacaccacaagtacctccagctcaataggtcccttattcaatttgaaatcctaaaccagagttccctgtcataacaaacaggaccagcttccaaaccgtggagcaaacttgaagtcttagaatcatgcttgatacctacttctccctcaaccctcataagtaatcgtcacgttctccaacatattctcaaaatatcttttgagctaattccattctctccatctccctctctacacacactcttatctggcctcctcactggccaccctgcctcccactcttagcctttctgatacatttggcacaaagcatatggagagacccttcataatcactgtcctaccttaacagtggcaaacctgtaacatggtctgcaagatactgaaggatctggctcctcccacacttcaaacacccctttgtaccccctttcccccaagtatcccagtgtctgaccacgttggccttctcccagctcctgcctaatgcagggtcttctcctccacttggaagtctctcctgttttctttggttaaccccatttttgtagccttcaggccccagcttaactatcattttctcgggggagccactccaagtgccttccactgggccaggtttccctgctataacttctcaaggtaccctcactttttgtttctggcacttgagacaaaggcaattcatgtttgtgtggtcatctgttcattggatgtcttccaaactcaactgttccttagtgtaatttccaattccatgaagtccctgacacagcgtctatgatagttaaatttatgtatcaacttgactaaagtatggtgcctggctgtttggttgaacaccagtctagatgttgctgtgaaggtattttacagttgtgattaacacttaaattgatagactttgagtaaagcatgtcaccctccataatgtgagtgggactcatcttattaataggaaagattttgacttctctgcagggagaggtcactggcctaccacatctttggcagagcctttggcctgccacatcagcttctgctgaaatttccaggctgccctgaagattttggtcttaacagcctacaaaattacatgagccaattccttaaagtaaatctctttatatctgtatctgtatctatagacatatcttttgagctaagccaacatacatatatgtatatacacatacatatatataatatattctattctatattctctctggagaaacctaatatatagtagatgtttaataattattttctgaataaatgaatgaatgaatgaatgtgtctttctaccattatttaaatctatggtgaattatttatttgtaaactacagaaactctttaataagtggatcctgttgttttatgcacttttaagtgtaataatccacaaattggcactgattttcaatgttttaaatttctggctttagtagcttccatgtatcaaaatgagtactagaatccctgggagcagctaattgtttttttaaaagccttcaattatcctcctagcatatgtttgcttgtttgtttttaattcttaacaaaacattctatttacaaataacattttgtaggagtttgagatctaagaaaatgtgttctgaacttgttactaaaattgttgataatggccacaaacaatacctcaggacctcagagtcctgtggttttaagttattcaccactcctagcggtgcagagcactgagctgtatatcacaacacaaagatgatcatctcagttcggtgattaaccaacttaattaccttgggagattcacttgaaacatttgagcttcagtttcctcatctgaaaaatgagaaactttccagctgtttaaaaaacaattcccagaaggacctcataacgctttcatataaaagaaaagggatatacttaagcaaaagcatgtgccccataattcaacatatgcttcactgtgcatagttctcctctcaccacaagactcaccaacgacaaaggcaatagcttaagacttcatgttaagattcctctcttcgttattcacaatatcgtctttctctacagatatggaactaccatcatggcttctggcactgcacttagtgttggccttctgtaatcactgtcattaatgaatatgactatgcttatgatgacttagcctcttttcagaaaaattttcctgtattcgtaggggggcacttaattgtatttgaatgtctgtttattaattcataataattatttttgacaagcctactctatgccacacagcatgctaggaatggagatgaataaaaggaataaaatggactcagggactttactgcttagtatgagagagaataaaaaaggaatgaccacaggagagtgtgatgaatgctttaagagctatctatatgctcctgatgttaactgaagttcaaagcggaaacatcaactatgactacgggtggcagatggtgggtactgggaaaaccttgcaatagggtgttgcttggagtgactattattaaaggatgcacacgtactagttctagggatggaataaatagcataacattctggaaagtgaaaatgtcagagcctgcatttgcatatgagagagagagagtgacagaaagaaagagagagagaaagagagagaccttttcaccttttctctggtgagtgtagctgtttagtgagatacaaggattgttaacaagcagttgttatcatacaaaagcaatttttaaactacactgttagagatttatagattagggtaaaagacaaggattcgtgctaccctaaatggatactgtgactgatgcagcatgagctgattataaactgttcctagtaggtgagaaaggacaaaaaaggtcaaaagatactcacaaaataaattattactaaatttacttgctagattttcaaaacatatacctatgataggaatttatacatagcaattttgtttacattgttattacctttttttgttaaaaagctaaagacaaacaggctaaggattacttcttggtatcgaaatttgacccatttgttgtaaaagacatttgcagagtccaagctacaatacatttctgaagtcggcattccataagaaattgtcagtgatgtaaataaataagtagcccaacaaatccacatgcaacagataacactatacaacttgagcattttgtttttgattgcatctgtaaggcttcatttttatttatatagtatgttctagaaatacatcaaaaatagaggaacacaattctaaataaacccatggagaaaattacacccacacacaatcatacatagacacagacacagactcttttgcactcaagagaataatgaatatagcctttgataccttacgtggtgcttgtcttgccttttgtggcagatataaaaatttagcaagacacattatcttgctaaaagctgacccctagattgagaggttttcctggtcattgcatgtacttacagaaaacttagtctggctgttaccgccttccagcttcacttcagacaatcatctgacttcattttcactcttatttagcttcctctggtcaggattaattataaactcctatgaattggtctagctaattctaatgctggatgctttggaatactaatcccaccctggaaagcaagagtcttatttgcagagataaattatttattgattttggaaaactttcaatggctccgcctggacttttagtggaactgcaaaacaagataaatattctgaagcaggaaataatattgacatcacacctcttttaataaacaagttaacctggcacattttttctaggaaataagttgtaaaactgagtattttaatatgattttcccactcctttcacccattcctgaaagggttggtaggcaaagttgtaaagaattgtagccatcatgcataaaaatggtaaaattaagtattttttcaaatattgtgactatgaaatttaagtgacaatgcagtacatgattttattttaaaggaatattttaaatagttatcttgttatatctgaatagctttttaaaataatatatgttccccaagttgactccctcaactactttgccagtatggataagggacagtgcacctgacagaagccagaagactgcagttgggttaggataaggcaatgagagggcatgaacatattcaaaataatatcagaaaagttggtcgggtgcagtggctcacgcctgcaatcccagcactttgggaggccgaggcgggcggatcacctaaggtcaggaattcgagaccagcctggccaacacagtaaaacccatctctactaaaaatacaaaaattagccaggtttggtagcgtatgcctgtaatcccagctacttgggaggctgaggcaggagaatcacttgaacccagcgggtagaggttgcactgagccaacatcatgccactgaactacagcctgggcaacagagtgagattccacctcaaaaagaaaagaaaagaaaagttaagcatcaggacacagaggatgcactgatcagctccaaactgaaatgtgaaaccgtttgaggttataaggcagtccactgtctttgacttttaaaatctgggccaagagatcctcacgcagcaacttttctccttttgccttaggaactggaaactacagggtgagaatctatatgtaaagagagccagttgacataatggaaaggggccaccagaatttggggccaagcataacagaacttcagttggtaattcagccaattaactttggcaaggagcaatttgctcatctttcttgtgaagatcaaatttatgaaactgtattataaattagaaattgtgaatataaatcacctcttacatacttggaggtcaaaatatatttatgttaattgaatgtggtttgactgagttgtatggctggagagaggcaattttttttccactccaataagctttcatcctttcaaggtggccagacatactaacgactccctgatatagtttggatatttgtccttgcgcaaatctcatcgaagtatactcctcagcgctggaggtggggcctggtgggaggtgattggatcacaggggcagaaccctcatgaatggcttgagccaactcctaggtgatcaatgagctcctgctctgagttcacaggggatctggtcatttacaagtgtagggcacctcccctccactatctctctctcgtgttcattcttgtcacgtgatgtgcctgctccccgtctgccttctgccatgattgtaagcttcctgaggcctcatcagaagctgagcaggtgcctggtgccatgcttcctgtacagcctggagaaccatgagccaattaaacctttcttctttataaaatacccagtctccaacttggataaagagttaagatccattggtatgctgtattcaggggaccgatctcatgtgcaaagacacacataggctcaaaataaagggatggaggaagacctaccaagcaaatggaaagaaaaaaaaaaatcaggggttgcaatcctagcctctgagaaaacggactttaaacaaacaaagataaaaaaagacaaagaatggcattacttaaaggtaaagggatcaattcaacaagaagagctaactatcctaaatatatatgcacccaatacaggagcacccagattcataaaacaagttcttagagatccacaaagagacttagactcccacaaaataatagtgggagaatttaacaccccactgtcaatattagacagattaacgagacagaaaattaacaaggatattcaggacttgaactcagctctggatcaagtggacctaatggacatctatagaactctcaaccccaaatcaacagaatatacattcttctcagtgcgacatggcacttattctaaaatcaaccacataattggaagtaaaacactgctcagcaaatgcaaaagaactgaactcataacaaacagtctctcagaccacagtgcaatcaaattagaactcaggattaagaaactcactcaaaacaacacaattacaaggaaattgaacaacctgctgctgaatgactcctgagtaaataatgaagttaaggcacaaatcaagaagttctttgaaaccaatgagaacaaagagacaacgtaccagaatatctgggaactaaagcagtgttaagaaggaaatttatagtactaaatgcccacatcagaaagctagaaatatctcaaatggataccctaacatcacaatgaaaagaactagagaagcaagagcaaaaaaatctaaaagctagcagaagacaagaaataactaagatcagagcagaattgaaggagacagtgacacaagaagccattcaaaaaattaatgaattcaggagctaatttttgaaaaaattaacaaaatagatagacagactgctagctaaactgataaagaagaaaagagagaagaatcaaatagacacaataaaaaatgataacggggatatcaccactgaccccacagaaatacaaaataccatcagaatactataaacatgtctacctaaataaactagaaaatctagaagaaatggataaattcttggacacacgcaccctcccaagaagttggctccctaaataaaccaataacaagttctgaaattgaggtagtaattaatagcctaccaaccaaaaaaagcccaggaccagacagattcacagccaaattctaccagaggtacaaagaggagctggtatcattccttctgaaactattccaaaagaattgaaaaggagggactccttcctaactcattttatgaggtcagcatcatcccgatacgaaaacctggcagagacacaacaacaacaaaaataaaacttcaggccaatatccctgatgaacatcaatgcaaaaatcctcaataaaatactggcaaaccgaatccaacagcacatcaaaaagcttacccaccacaatcaagtcggcttcatccctgaagtgtaaggctggttcagcatacacaaatcaataaacgtaattcatcacataaacagaaccagagacaaaagccacatgattctcaatagatgcagaaaaggcctttgataaaattcaacaactcttcatgttaaaagctttcaataaactaggtattgatggaacatatctcaaaataataagtgctatttgtgacaaacccacagccagtatcatactgaatgggaaaaagctggaagcattctttttgaaaactggcacaagacaaggatgccctctctcaccactcctattcaacatagtattggatgttctggccagagcaatcagtcaagagaaagaaataaagggtatttaaataggaagagaggaagtgaaattttctgtttccagatgtcgtgattctatagttagaaaaccccatcatctcagcccgaaaactccttaacctgataagcaacttcagcaaatctcaggatacaaaatggatgtgcaaaaatcacaagtattcctatacaccaaaaatacacaagcagagagccaaatcatgaatgaactcccattcacaattgctacaaagagaataaaatacttaggaatacaacttacaaaggacgtgaaggacctcttcaaggagaactacaaatcactgctcaaggaaataagagacgacacaaacaaatggaaaaacattccatcctcatggataggaagaatcaatatcatgaaaatggccatactgcccaaaataaattatagattcaatgctattcccatcaaactaccattgacattcttcacagaattagaaaaaaactaccctaaatttcatatggaaccaaaaaagagcctgtataaccaagacaatccttaggaaaaagaacaaagctggaggcatcatgctacctgacttcaaactatactacaaggctagagtaaccaaaacagcatggcactggtaccaaaacagccatatagaccaatggaacagaacagagacctcagaaatcacatcacgcatctacaaccatctgatctttgacaaacctgacaaaaacaagcagtggggaaaggattccctatttaataaatggtgctgagaaaacttgctagccatgtgcagaaaactaaaactggaccccttataccttagacaaaaattaaatcgagatggattaaagacttaaatgttaaacccataaccataaaaaccctagaagaaaacttaggcaatactattcaggacatagacatggacagtgatttcatgatgaaaatgctaaaagcaatggcaagaaaagccaaaacagacaaatgggatctaattaaactagaagtactaaagagcttatgcacagcaaaagaaactatcatcagagtgaacaggcaacctacagaatagaataggagaaaatttttgcaatctacccatctgacaaaggtctaatatccacaacctataagaaatgtaaacaaatttgcaagaaaaaaagaaacaaccccatcaaaaagtgaacaaaggatatgaacagactcttctcaaaagaagatatttatgcagccaaaaaacatgaaaaaaagctcaacaccactgatcactagggaaatgcaaaccaaaaccacaatgcagtaccatttcacaccagtcagaacggcgattattaaaaagtcaagaaacaataaatgctggcgaggatgtggagaaataggaacgcttttacactgttggtaggaatgtaaattagttcaaccactgtggaagacaatgtgatgattcatcaaggatctagaaccagaaataaaatttgacacagcaatcccattactgggtatacacccaaaagaatagacatcattctactataaagatacatgtacacgtatgtttcttgcaacactatttacaatagcaaagacacggaaccacccaaatacccatcaaggatagactggactaagaaaatgtgggacatatacaccatggaatactatgcagccataaaaagaaatgagatcatatcctttgcagggacatggatgaagctggaagccatcaccttcagcaaacgtaacacaggatcagaaaaccaaacagcgcatgttctcactcataagtgggagttgaacaatgagaacatacaacacatactggggtctgtcgcggggtgaggggcagggggagggagagcattaggacaaatagctaatgcatgcggggctgaaaacatagatgatgggttgacaggtgcagcaaaccaccatggcacatgtatacctaggtagcaaacctgcacattctgcccatgtatcccacaacttaaagtaaaaattttttaaaaagcaaacaagtgaataaatggatacaaagcaggaaaaaaagtagaaaatacttatttaacaggatggcatttattacccagaaagttctgaaaaaaattattaggagatgcttgctccctagggtgctaaagactacttaaaatcaacattacaaattacagaacatgaaagatacgtgtatcttgagcttcgcataaaactgatgtctctttatggttaaatttagactataatgtacttttgagggggcaatatcacagcagtgatgctgcgtccttctgtgtgcatcagcacatcataaaaatttgtcctagtgcagttaatgtttatgattcacttggttaaagagctctctgacagactgtcgcactacagagttaattatttttctcttaattattaggtatctttatgcagctgatgtgcataaaccatcacatttaatctggcagctgcccttctttcttaggttttctttgcatatatctgtctttggtaaatgaaaactctcatctttgtttacaagccagaaaaactagaaaaagaaacacaggctcttccacttactgaatttttgacaaaatattcttctttggccaaaaacattgacattactggtgagcttgttaaaaattcagaaactgaggctttcttccagatcttctgaaaaaataatctacattaacacgatctccagtttattgtacacattaagatttgagaggtaccttttaagtcaatatttcttttccatctgaaaaatatacagaactcattctgtatgatacaaatataggacccaaaaatgtaataaaagaaataagatacccagtctcagtttttctttttctctttctttctttttctttctttctttctctttctttcttttctttctctttctctttttctttcctttcttttttctttctttctctctttttttctttctttctttctctttcttcctctcttcctctcttcctctctctctctctctctctctctctctctctctctctctccttccttccttccttccttcgatggagtttcactctgtgacccaggctagaatgcagtggcatgatctcggctcactgcaacctccctcacctcccggctccaacgattcttgtgcctcagcctcccaagtagctgggatcacaggtgcacagtaccattcccagctatttcttgtattttcagtagagatggggttccaccatattgcccaggttggtcttgaactcctagtctcaagtcatctgcccgtcttgacctctcaaagtgctgggattacaggcatgagccaccgtgccctgccagtttcaggtatttctttatagcaatgaaagaatggatttacaaactccccaatgatgtgaacacgaaaagtaaagtcagtgagggattttaaaagtgccaatgcccctgacgactccaaccacactcaaccacaaagtacaccagcccaattcaatctctagaaataagaacatgtaagagtcactaaataaataaaattgagatggttgtccgtcccagaaaacaaagacatacctgcctctttgcaggaaagacaggaggctctaattacctctggtgctccttggacatttctggggaaatagtcttaagggaagaggacaggcatgctacccttgggcagggcagtaagcagctagctagaagactaacatttctttgaagactcaaggtctatttttttaaaaagccatgtaattttgtgttctactctataacatatcttttggagtttaattgcaaaactaaaattttaaacgattgatttctaacctggccaattctgagaatctcagccttgcctaaaaatacgaatcacaaatgtggcttggaatcagtattttttacaacttttgccaggtgattttctttaccaaagagatttcatcctaaaaattaattttcaaaatttactcttggtgctgctgtagttatgcatacttattatggtttctatcatggggaaaaccaagctggttgggtggaacctgagatacaaaagtgatagtaaatatcgattctgtggaggcggctacagtaaacactatttgtgagggacagaataggtagagctcctcattccacactcacagaggatgttcagaagttccagtgcatgcctttagaattcagtcttaaaataagcaatcgtaattaaccacttactcatgcgtcccactgagaacttgtcttttaagaataggctccttgtaactaaaggaaaactaaatattttattcaaacattttggacacacatgttgaaggaaggttatctcatacactgaacaagttacaactgaaagcatagaaagcagtgtgagggagaaatgggtctagtcttgcttctgatacaagctgtttcatctcagccactttatttaactttactcagcttcaatttccttggctgtaatatacagtgtaaaaatggaacataacttatcgggttgttataagtattaagtgagaaaataacatacagcaattgttcaataaaagttatttaccactaaaaataagaatcttataacctataatattacattatcttctttttgggaagtaaacatatgatcaaaagatggatcaaaataagttacatttcttttagacccccattcaaactgcatggttttcttttggtatactgaagactctcacaaacatttttgctattctggtaaaaatcatgctggtattaattttcatctgaaagttcaatttattctgaaatatattcttatatttactttattaatattattatcatatgaaaggctggtttctggcacctcaggtggttcacatcttggagatcaatgtgcagaacaattttaaaagagatatatagatagtactaaaaatatataatatatcactagtttatagatttagatgaagtcgaatcccatgaaacataacatatacatagggatagaaaccagacttaatgaaaactttaatgtagaaattatactacatatattataaacagtttatacatatggatgtggatctctatatgtctataggtttatgaatgtagaattaaaatacagaagtttctcaaatggtaaaacgtacataggcttggaagttagacttgagttaaaatcctggctttcttacttaccatctggacatattatttaacctcccagaaatgaaaggatggcttaacatatggaaatcaataaacatgatacattacataaataaaccaggaacaaaaaccatgttattatttcaatagatgcagaaaaagcatttggtaaaattcaacatgtctttattatcaaaacactaaaaaattgagtataaaaggggtatacctcaaaacaataaagaccatatttgacaaacccatggctaacatcataccaaaggcggaaaaattgaaagcctttctgctaagatctggaacaagatcaggacgcccattttcatcagatttattcaacatactactggaagttctagccagagcaatcagataagagaaagaaataaacgacatccaaattgggaaggaagaaataaaattatcctcatttgcagacgacatgatcttacacttagaaaatcctaaagactccaccaaaaactgttagaaatgataagcaaactcagtaaattgcaggatacaaaaccaacatacaaaaattaatagcatttatatacaccaacagtgaacaatctgaaaaataaatcaagaaagcaatgccatttacaatatttattaaaaaattaaaaatgcctaggaataattgtgactaaagaagtgaaagatctctacaatgaaaactataacactctgatgaaagaaattgaagtggacacaaaaaatggaaagatattcgatgctcatgaattggaagaatcaatattgttaaaatgtcaacactacccgaagcaatctacagtttcaatgcaatctctatcaaaataccaatgacattcttcacaggaatataaaaaactatcctaaaatttatattaaaacacaaaagattctgaatagccaaagcaatctcgtgcaaaaagaacaaagctggaggcatcacactaactgacttcaaaatatgctacaaagctatagcaaccaaaccagcatggtactggtaaaaaaacagaaaatatcccaatggaatggaatagaaaacccagaaataaatacatgcttttacagccaattcattcttgacaaaggtatcaagaacattaaggaaaggacagtctcttcaacaaatggtgctgggaaaaatggatatccatgtgcagaagaataaaattatgctcctacctctcatcatataaaaatcaaataataaaggattaaagacttaaatctaagaactgaatctatgaaactcctagaagaaaacattgggtaaatgctccaggacactggactgggcaaatttttggggggacaaaatctgaaaagcacaggcaactaaagcaaaaatagataaatggaattgcattaagctcaaaacttcggcacagcaaaggaaacaatcaacaaattgaagtgacagcccacagaataagggaaaatgtctgcaaatgattcaactgacaaaggattaataaccagaatatataaagaactcaaataactcaatgggaaaaatctaataatctgattaagaaatgggcaaaaaatctgaatagacatttctcaaaagaagacatacaaatggcaagtaggtatataaaaatggttaacatcactaatcatcagggaaatgcaaataaaagctacagtgaaatatcatgtcaccccaagttaaaatggcttttataaaaaagacagtgagtgctggtgagaatgtagagaaacaggaacactcatacactgttggtggtaatgcaaattctgacagccactgtgaaaaacagtacggactgaaaaaaactaaacatggaacaactctatgatccagcaatttcactattgggtatatatccaaaagggaggaaatctatatatttaagagatagcagcactcacatgttgactgcagcactattccaaatagccaaatacggaatcaacctaactgcccaccaatggataaatggataaagaaaatgtgatatgtatatatacacacacacagtgttaatactattcagccataaaaatgagtgaaatcctgacgtttgcagctgcatggacagaactggaggtcattatgttaaaagaaataagccaagcacagaaagacaaatatcacatgatctcactcatatttaggccttaagtaagtggatcttatgaagatagaaagtagattggttgttaccagagaaggggaagggtaaagcccagggttggatgaagaaaggttggtgaatgggtacaaaaatacagtcagataaaataaataagacctaagcatttgataaatcagtagggtgactatagtaaacagtaatttattacatatttcaaaatagctagtagagaataattcaaatgttcccagtattaagaaaaatgtttcaggtgatggatatgccaattgccctgatttgattattatgccttacatcaatgtatcgaaatatcatatgtactccaaaaatacttacatctattgtgtcaataaacatatgtaaataaataaatacataggaatcaagaagacgtcatagaccgttgcatgaatttggggcaattatgattttacatattctacaaaactgtctcttgataaagtccttagaaattaaaaattaatgctctaaattccagtatgtttccatttgtatttctttttcttttaacttttattttagattcagggatacatgtgcaggtttgttatataggtaaactgcgtgtcatgcgagcgtggcgtacagattgtttcgccactcagctaataagcatagcacccgataggtagtttttcagtcctcaccttcctctcatcctccaccctcaggtaggctccagtgtctgttgttgccttctttgtgtctgtatgtactcagtgtttagctctcattcataagtgagaacaagcggtatttggttttctcttcctgtgttagtttgcttaggataacggcctccagcttcattcatgttgctacaaaggacatagtctcattctttctcatggctgcatagcattccatgaaaaaacctctttattttgtcaacaaaatttataagacaatacttcacttatttgccaagtaccctaaagaatacgtgacaaataaattttaatttagttgataaattttaatgtatttattttaataaatgtaaaatgtatttggaccagcaagagcaaactgcaaaaaaatccaactttatattatctctaattcaactcttggtgatattttataaaataccaagttctataaacttcccctgggcaaggtgaccataaaatgcattgtctacattgagattccttaaaatcgaataacaggctgttagtgattactttgaaacagtagggataagccaagattgtcctgggcatctgtgatgtgtgatcaccctacctctgggcttaaagctagtggtccagccatcgcgaatatgttcctgagttcctgtttgaatcctgctctctctatattaaactttcatatatttaatggttacacttacttaccttaaagtttttctaattatctcactcttggaaataagatttcattatttgataccgagctatgaatatgtttcccttctttttcaggaatgataataaggtgtcaggtaagtcttcatcttttctatttaacctgccagctcatttttaaacattcctgttccagcttcggggagatttctgccatcacagttggtatttcacaacacctgtttctgctacaagccattgctctcctcaactttctttaggaaatgagctgctttgcttagtcaaatctcattactcttttcataattgccttaggtctccattcattaacagagaagaatctaaagctttactagtactgctactgaagacataactaagatttcctgctattgggccttacaggaactaagttccatttaaaagcaaaactgtatatattgtgttgcttctttatcttgtttgcctcacatattaaacacaatcagttctggaggtcaactatgaaacccaagatatgcaagtttctggtctgaaatctctgtcatgattaggctataatacatgcaaatcaattaggcagaacttggaacaattgttaacaatttctcttaatcgtttctcttaaatgattaagagaaatgaggtcacggcagtagctggtaacactgattgctgaaaacacagccatcataccttagcttaatatgtgactcggagatgtgtataatacattttttaaataatagtatttcaattgacaaatcataattgtattactttaatgcagcaccatgtgatgttttgatgtatgtatacaagacataatggttacatcgggccaattaatatatccatcatatcacttaacttttttgtgatgatacatttgaaatttactttcttagttatgttgacatatataacgcattattattgaccattgtcaccctgttgtgcatggatctcaaaacttactcttactgcctagctgaaactttgtaccctttgatcagcagctcctcattcccttgcagctccatctccttctcaccgcagcccctgataaccaccattgtcctctctacttcaatgaattaactggttaggattccacatatgcgtgagatcatgcagtattgatctttctgtgcctggcttatttcacttagcataatgtcctctagattcattcctgttattccaaatgacagaatttctttttttatttttttttatttttttaattttaatatataaagttgtatttattcaatggactctgcagttgtagaaagaaactcacaacttaaatctaccatcccagtttggggccagcattctattatacatcctagtactctattacattgtttcatctgaaaggtattatcctgccttaatttccaattcaaacactccattcctaattctagagtttgctcaaaggtcatattctttacaaagactataaaactcacattttctctcttttttgacatctgataacactttctaactaattattattattattactaatcaatgcctaaggtaattaatctttggctgcctcaagtgtgagctcctccaggacatgacctatttttttcttcctcttttatccctagtgcttaattccacgtcccatgcattctaggtcttaaagcttttatgcttaataaatattaaattaatgagctgggattctggaaatctaaatatggagtaaaaatcaactctaattgtgtaggattgaaacaaaactatataaattagtttatcttattttctgtgtatatgttgaaggttacatgtacattttcaaaagtagatactgatttaaaaggtgagatcataaatatagatgtgaaaaatcatctttatatgtaaaaacaataattttattttaggtttcagcttctttggcagttcattatggtcttcagaataaaatgccaacttgtaagcatggtggtgtcttgatgtggcgtctcctatttctctgctttcacggtttgtcttttccctatgatgctcctttcactttgaatgttcttacacagggaattctttttttgacttttttgaaatttattttattttattttattttattattattatactttaagttttagggtacatgtgcacaatgtgcaggttagttacatatgtatacatgtgccatgctggtgtgctgtacccattaactcatcatttagcattaggtatatctcctaaagctatccctcccccctccccccaccccacaacagtccccagagtgtgatgttctccttcctgtatccatgtgttctcattgttcaattcccacctatgagtgagaatatgcggtgtttggttttttgttcttgcgatagtttactgagaatgatgatttccaatttcatccacgtccctaccaaggacatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcaaaaaaagtcatagtttagaggctacaaaaggaaacagaaaagtttaaaaattttcaaatcaattaacattttctgttttattttgagtttggatatttcttgagtctctaagagtaaaactacatttatgtctgggctaatagtaacggtaaaatggtgctgacagtttttctgcttatgtgtggggctttaaaatgcagtaatattgaactgaaatttttttttaaaaataaggctggacatggtggctcaggcctttaatcccagcactttgggaggctgaggcaggcagatctcttgaggtcaggagttcgagaccagcctggccaacatgatgaagccctgtctctgctaaaaatacaaaaattacccgggtgtggtggcacacgcctgtagtcccagctacttggggggctgaagcaggagaatctcttgaacctgggagatggatgtttcagtaagctgagatcatgccactgcactccagcctgggtgtcagagtgagagtctgtctcaaaaaaacaacaacaaaaaagatattattgatagattcttgaaatgaattatcaaagctataacagttgtgattatgagcaacattactaccatgtggctagttaagcattttcttcttaaatagtaaacaaagagtcacataaaaagaagacaaaataaatgtgtgtgtgtgtgtgtgtgtgtgtgtgtgtgtatgctactaggcaggttttacacatatgggaaagagaaaaatgcagccatttcaccataatggctatgtctcaggtaactaagcattctgtcaacatttatgaaatttttcatggtgaacttcatttttaggataaagtaatgagctggagctaatatttagatcacaaggcatgttttcatgcattttttcagtatcattcttttcttggtaccaaatacagcgtggaactagcaaagaatacttactgaagcaactctagggtcatgagttcagaagacattcgtgtatctgttctcaatttctgcgatcatttatgtgccaatatgagctttcgtttgccagcataatgcctgatcttctagctgcatttacaagttttataactctcacattctgacttggttttaataaaacggtaatttgaagccagcctctgtacccactgcagtactacacagctgctttcttatccagaagatttccctgttcttcatctccatattgattgtctccaacccacacaatatctttttccattttcatattcactcatagaacaatctaggcatattctacagcctacatacactaaaaaaataaatccaactacctacagattttcttccatgcatttgtctcttccctcacccacacagtcaactcccttactcaccacttgcttcaattttcttactccgtatatgaactaattcactgcttctttctgcttaaactttgtttttctattttttagccatttctcctttcctgcttttagcaacttacttttctctgtttcttttttatttcatcttctttatcaatttgtcatcatgttaatattatctgtctaaatagaatatgttctcaaccatgccttcaataaatagttactaattatttattctgtgttaggatactaggtagtaaggataaaaagatgaatataacacaatatcctctttacctttctcatacgtgtcctcaaggaccttagacaaaaatagaaaaaaaaatagctatggatgtgagtcctggttgtggcaagatggactacaccaaattcaactccttccactacaaacaaatagatagcattaaaaactccgcatttaggctcacaatacaaaacctgcattccaaaatgtcaaaacataagaaggaaagcagtaaatgagtaggaacagaaggaacatgagttgacatagtgttatgaatgggagctaatgcctgggttttaatgcccatgtgaggcggaagaccaggtcttgagcccatgtaaagctgaaagctggaaatatgaccccatgtgtaaagccagattgtaatttgaaagactttcagagtgtgatattggcaaagaggtagtccaatagaccagtgaagcacaacagagccccacaggaacagacccacgtatagacagggaattagtgaatgagacaggtgaaactaaactcagtgggtaatagcacacaataaatagtgcaggcacaattgcttaaccatatgaaaaattagatttctacttcacactgagacattttaagcagtttcagtgggtgtaactgacataacataaactgcacatacgaaagtgtacagtttgataagttttggcacatgtacagaagcacagtcaagataatgaacatgtcaataaaccccaaaggtttcttgaggcccctttgtaatcccttaattcccaccacaacctttatcactaggcaactgctgatttcttttctatcattaaagataagtttgcattttctagaattttatgtaaatggaataatagaacatgtcctctttttaaatctggctttattcagtcatcataattattttgagatttatccaagatgctgtatacatcaatagttcattatttattattattaaacagtatttattatatggatataccatcattagtttatctatctgttgatggaaatttgggttgtcaccagtttggagtactatgaataaagttgctgtgggcattcatgtgtaaatctttctatggacatacatttttatttattttggttaaatacctggagtggaataaatgagatgtggcaggtgcctgtccaactttttttctttctttcatttttacttcttagagactgggtctcactctatcacccaggctggagtgcagtgacgcaatcatagctcactctagtctcaaactcctgggctcaagtgatcatcccacctcagtctcccaaagtgctgagattacaggtgtgtgccactgtacccagcttgatcaactcttttatttttatttttttaaaaactgccaaactgtgttttgaaggagttgtaatatttgctgtaaagttgtgatatttgtaccatcctctattcccccaaaatagcttataggagttagttgcttctcattgttaatgttgtatgccacgcactgatgcagaggacaaaataaatttggtaggcaccacttgattcacttcacctatttaaaaaacatacaaaatctccaaggttttgacagtggaatgagagttgctgattagagcatctgaccagttggtccacactctcttactactgagtttcttcttcatttacgctcttagtactgggcttaatttcatcaccaccaggctgggctcaggattgtgcagcccatgctctaaaactaagaatttgtcatgtgctcccttttactgtcaatccaggaatggtctaaagtacacgtaagtaattgtgggaacaaatcaattgattaataagataaaagatgattaaataaaataaattatttcagagttacacattactttagagttatgattactgaaaaatttgaaacgtcatgttcttgacccatcatataccctggcatcccgaagctaattaggaaaaaaattcaaaattcatgacgataaaaaggtcagcccatctgaaagatacaatgacacgttatgcgcctaattaaagttgaaaattatagaaagcaaaaactgacaaaaataagagagattgaaaatttctgtcatgtctagaaaattgaatagtactctctcagcaattgctagaacaaccctgattttaaaaaccaagaaggatagaaatacccagaacaaattatcagccaacttgactttggtgacatttatagatattatactcaaaaactgcagatttcacttttttcttttcaaattctcatggaattttcaccaattcagaccatatactggtccttaaaatgattcctaatgaatttcaaaaggctgaaatttcacagggactattgtctgaccacaacagaataaaattatgcacccaaataacatttttagaaaatctcatccttctaaaaatgcacttctaaataacctacaggtcaaaggagaaatcacatatattagaagatatttgaattgaataataataaaaatacaacatatcaacattttggaaatgcagctaaaacagtgcttagaggctaaaacagtgcttagaggaaaattatatttttaaattattgtattagaaaaatgttaaaagatgtctatataccttcattttatgaaagatgaaaaagaaaacaaaaactaaaaagcagaaataaggaaataatgaagataaaaaatcaacatgaaaaacagactaacaatagagaacattaaatagggcaaagattcttgtgtgtgtgtgaaaagaataatacaattgagaagacataaaaaaatggagagaaaggtacaaattatcaatgtcaggaaaaaatggcttattaccactattctacagatgttaaaaagataatcagacattcaaaagataatcagagggcatttgtataaacattatgcaatattgacaaattataaaaataggtaagctctttgaaaagcaaaatttaccaacttaacagaacaagaaagataacaactccatagctctgtaagttgaatacatttaatttgtaatgaaaaacgttctcacaaagaaaatttcaggccctgagttttactcatgaattctatcaaacatttaagaaagaaagaatatgaatcttatattaacccttggaaacatgttccacttgttttatgaggacagcattacccggatttcaagacccggtaaagatatttcaatttaaaaaacctaaaaataatgctccttgtgaacaaagatgcaataatttgtaacaaaaacattagcaaatcaaatcttccaatgtataaagaggaatacaatatgaccaaattagcaatataccagaaatgcaagattggtttctatttaaaaagtcaatcatgtaattcattacattaactgaacaaaacggaaaagcactggacaaaatttagcatacatcaatgatcaaaaactcttggcactataggaattaaaggtaacttcctcactttgaaaactctacagctcacatcccacttaacggaaatactgagagcttctcctaagataccgatgtccattccaaccactaagttaagactacatcttgacccgtacctcataagaaatacacaaattaatttgaggaggatcattattttcaggaagtacctcataagaaatatacaagttaatttgagaaggatcataattttcaggaagtagaataataaatgcaataacttactctctggatttaattctgacagaaaaaggaaatagttccctcaagacatatataataaatatgtaaagatttttatattcaccaaaatctcaataaagtggttaaagtagagacataatttcaataataggggaaaataataatatgtccagaaaatggttatcaaaaagttattttccaaggctattttgaacaataataatgaagattaggagtggggttagtagcaacagtatttttcttttaaaaataattttgaatagattattcactcacatcatgcaaaaataaaagttatattaaaaaacaagaaaaaatgagatctttacttcaacataatactatggataatcaaggaaggcatggtatctgtccacacttctgtgaacctaaggtaaatttctttctttttttttttttttttttttgagacggagtcttgctctgtggtccaggctggagtgcagtggcgcgatctcagctcactgcaacctccgccttctggattcaagcaattctcttgtctcagcctcccgatcacaggtgcctcctggcattacaggtgcctgtgccaccatgcccggctaattttcatatttttagtagagagggggtttcaccgtattggtcaggctggtctggaactcctgacctcaggttatctaccctcctcagcctcctaaagtgctgagattacaggtgtgagccactgtgcacagccccctctggtaaatttctaagtaggtatgagatgcatgccttctaaataaaaataaaattaattaaggccttgactaatagattatgctttactgtttaacatttaaccagtgaaattatactgatgttttgaagttactgaatacattcatattttcctagaaacttgcacatgcctcctggtctgaaaacacgtggaaacaaaatctctacctttttggagttgacattctttggggtggtgcaacagcaaacaactaaattcacttttagtttttagaacattatataattattaggagttgcataatatacatatactgtttgtgcatgaattagaaattcaattattaaatttatttctgtgagagactaataattaaatgaccattataaatgtgaaataaactcagaattaatttagttactttgtcagtaaaataacatagccatgagttactcatagatgttttcctttcacactcttacaagtttaaattttggtcttctttattgctctttccttttttttaaccatgttatctctattttggaggatacacttatgcctaccacctcagcatgtaagcgtgtttacgtatctctttatgacaacaaaataatgacagctggcatacagtgaatgcctttactatgtgctggttactttgcttgtctttacattcattccctcatttgctcttcctgatgcctctagaaagtatgtcctgttattaatctacttcattgaggagtaacctaaataatttatgcaaactcataaaataaagtgttggaattgagccaagcttatcatgatgtctatactcacagagatattcacttatttgtggtttatttactttgtatatatacaagtatatagactttatgaaaaagaaatcctccaactgcagaaaacacaacataaccctttcaatgtttttaaactcaatgatccttatatacccaattggtttgtaagtagatattgatatattaaaaatattttgaagatgaatggctgcttgtaatctctttttgaattttacaaagtgctttaaatctaatttctaagatttgaatcaagatttttcaatcggtaatttatggatgagttcttcatttataaatagacaaattcctatgtgaagatttgaatataaggtataaaatcaattgtattatccccaatccctgctgccctgaaatctggcatagtcatatctgttgcacttctgggttgtgcttggaaccccaaactctatatctagctaacacctaatgggacacttctggaccatccaggggccaacatcccactctgctctctcctgccatcacatccctggagttgtatattaacaatgatcagccaagtagaagaggcaggtgctctattgcataatacataataggtaattaaagtacatacattctatcttacccaccaaccctacaacagtcaaatgcaacagataatagtgtttagtctagaaatgatgttataatcatttaggaaactattttagggaatgatgacaaaagtaaataataataaaaatgagctttttttcccgaacatgtaactcattctaatatgaaaagcttccacagtgaagctctaggtttatgttattatgttagcacactccccattttgccacactaaggtttctaaatgtacactttgcatttgcttaatctacttttccaccaggttacattttccaatctgtcctgtcttgaatacttgtctttaaaaattggacaaaacaaaaattagtcgggcatggtggtgcacgcctgtagtcccagctacttggcaggctgaggaaggagaaacgcttgaacccgggatgcggaggttgcagtgaaccgagatcgcgccactgcaccccagcctcatgacagagcgagactccatctcaaaaataaaataaaataaaataaaataaaaactggacaaaaacaataccgaggaagcagagacacagaacaaagaggacataagcactgtttaaaaaatctgacatagaggttattcttatgaaaattacagagatatctttgttaatcaactagattaaaatgcagttaatagataaacttaccctggctttgtgtcatttacaacacagtgataagtaaatgttccaaacatctgaactcctaaaattccataaagaagtagaaagaaaagtagaaaaatggaaacactccatatttgttctcccgatcgcctagagaaacaaaagtaggtaaagtacataaaacttacaaaaaacttcataaacttttcctcttaacttattgtaaagcagcgctcactttaaaatatttgtaattctggtccttggcagttcaaatcggaaataaatccggaatgctcggatcataatcagtggccgtggaatccgcaacatgccccaaggtgacatctgatcaactatatcagcaatttcaaacacctacaaattaaaagatgggtaaatgaggttggattttcccttagcattgcttatagtcatggaacatacagatgttagcagcataagtaggtgcacctctactctgaatttagccatacattattttccaccaaaatccactttcttttgagtatattttgaagctatagctatcttaacagaaacaaatacataaactaataagaacaacattaatcttattcatttcctgtctcgttcgttaagacagtttttagttacaagaagtgccaacttagaatatatagtaagtatgctgtctttcttgttaataacgttctttagtggaggcttttgaatatctagaaaataaagtaatagagaaagggttaaaatattaaaaaagaattgcactatttactaacaggcaaaataataatttgaaatgtttgtcaatcacataatagttattaaatggaaaagaacacattaatgtgagaaacaattcaacctgacaaagctgattaaaaaaatatatgagtgatgaaattaaattgtgggagaggtgaactttataaaaatatgaaaggaaagcttatcaacaaacactatgatgagttggcagaatgggctgtgaagttttgaattctgaatttttaaataaagaatagatgattgaactctagagacctgtacaacattgtacctacagttaacaataatttattgtacaattaaaattcattaaaacagtagatttcatgttaggcattcttaccacaaccaaatcaaaacagatcaaatcaaatcaatagaatatagtaactttagttgaattaaaaggcaaaatcatgtctgaatgaatgcacagaaattaattctacttattttccaatcaaatctgtcctgtaagtctttttaatgtacgttccccatcacttataataaagcatttaatatttgcaatatagtattttatgttggctaatacctatccaaatatggggagactagactttaaatttttaagttcaattttttatttacaaatacagaaatattgctccacattgtttccttcatttcagggaatatattttatatctgattaacagctaataattttctatagtattgattttcgtttctgattgagaaataattcacaatcataactgacaataattaagatattacagctattgacttttctaacaataaaatgtttgaggtgatataaaattgctaattatgcagatttgatcattacaccttgtatacatcaaatatcactcagtcccccataaatacatacaagtattacgtatcaattaaaattaatttttcaaatttcaaatatgtcagagtaaacagactaatcacatctgttaaaataaaaataaaataaaatgttgtaggcaattacacaatcacatttgatatatattttgtaatatttctatttagacttttaatgcaaaataattcccattttggagaatacctgcttgtaatttaaaaaatatttaattacctgtagcaccaaagaaacccaaaggcaaaagaccataaatccatcaaaaacacaccagcgatctttcacataggaactatccccctaaaaataaattttacatggcattattaggcaaagcaaatattttaaagaacaatctgtggaggaaaatgtcaaatattatttcaataaaagctatctacaatttttgtatcataatagaacagactttcacaaggaataagtttagcattttaagtagcattacttataagaaaaataatttataaaagacaagcaactttgcaggtaaaatatttaattcatgcaaagggaaaatatcactattttttttttctcagccacacaaattctaacacttaaagaaccagaagccattgttccaaatatgctatgtaggtcctaagccagctccctgcctacaagaaccaagagtgcactgtggtcaacaggaaggtctttaaaactgctaggtttagcaccgttagtaggaaaactaacaaggcattcacttcaagctgattaaaaagtgaagaagaaaaaaagctcatcatcactggtcattagagaaatgcaaatcaaaaccacaatgagataccatctcacgccagtttaatggtgatcattaaaaagtcaggaaacaacagatgctggagaggatgtagagaactaggaacacttttacactgttggtgggagtgtaaattagttcaaccattgtgaaagacagtgtggcgattcctcaaggatctagaaccagaaataccatttgacctagcaatcccattactggatatatacccaaaggattacaaatcattctagtacaaggacacatgcacacgtatgtttattgcagcactattcacaatagcaaagacttggaatcaatccaaatgcccatcaatgataaactggttaaagaaaatgtggcccaatatactatggaatactatgcagccataaaaaaggatgagttcatgtttcttgaagggacatggatgaagctggaaaccatcactctcagccaaactaacacaggaacagaaaaccaaacactgcatgttctcactcataagtgggagtcgaacaatgagaacatatggacacagggaggggaacatcacacacgggcctgtcaagaggtggggggctaggagagggatagcattaggagaaacacctaacgtagatgacaggttgatggtgcagcaaaccaccatggcacgtgtatacctgtgtaacaaaactgcacattctgcaaattttttataataataaaaaaagacccaactatcctaactatatatgcactttacacaggaacacccaaatttataaagcaagttcttagagatgttcaaagagacttacagttctgcataataatattgggagatttcaacaccttgacagtattagatcattaaggcaaaaacccccaaagatcaaatgcacctgatagacatctacagaactttccactgtatatatgtggatgtatatatacacatatatacattttttctcattgtcacatagcacatattctaacatcaacacttaatcagacataaaacatctctcagaaaatgcaaaataactgaaatcaaaacaaccattctcttggaccacagtgtaataaaaatagaattcaagactaacaaaaaaaagtgaagaagaaacttgtcttaatttgcaaggaaaacacatattgactttaattttaattgggattgcatatgtaaaagaaagataaagatgtaccactttcattttttaatagggtatctattctgacattagaatgctttaataacatgggaatttaaaaaatgcctttggaataataaaacagaaaacttcatgaggttaaaaattagaaactttaaacagaaaagcctttgcttttttaggactatcccattaaatcatgaattctgtaatcatccatgtaagtcaattctgaattcagtcacatatatcattacctcctctgattaaacctgctagggaaatgaaaatagaaataaaatgtcaagatttcaaatcaaatgataaaacatgttgcaggatattgacataagcctctacctttagtaacaaataagtatccaaatatctccttgagaggtttctggaaatagtttatggtgtatgcaaaactaacactatgataaaacacttaatggaagttatttgacccaaaaatgaagtataaactcaacttaatgaacactgggtaagtgcctgttttacattagaggatatataatgcctagctaacacacacacacacacacacacacacacacacacaccaccatcaccaccaccaacaaccaaaagaacagtcttgtagaaaaacagatgtgaacacatccagctagtatataaagcaaaataacttaaagctataaacatggtgggaaagatggtaagattaattctatggggagtttagagaaaccaatgttaattcccaaatgaacggacaaataatgttttcaggggcaaggtaatcaaccaaacttggtgactcctgggtttgggaagactcacaaaagagatatgaaagcaaactctgaagcttggctctgggtgacaagaaggacaatggccttattaaattgtgtgattatcatcatatgaagatttatacccaaggaagagaaaagctgcatcttaggatgctaccgatgctactggtgtttatgtgctacacataaacgcatcacaaaggttacatatataacaaataacgtaaggattttttatagtcatcttcaactttttttatagttgcattttttaatagttgtgttaaagatctcacagaggatctttaactataagcatcatacttgcctcgtatattgcacagttgaaaatgtaaattaattataatctaaatacagataacatagcccatataaaattgactttttctgagcctaaatttgattaatacccaagaaggtaatagaagatgaattatttaaagttgtgcccttcattccttcctccctctctccctcccttacttccttctttccctcagctcataagcatccctttaacctaggcagtgttcaagaactagggatacgagggtgaacaaaacaaacgcttctgtctttaagcaatttacattctgaatgaaataaaatataaaatattcattatgttatatgttgacaagtgtcatgaagaaaaataaaagtgtatattttcaaatggacttttattaaatgaacaaatgttttttacttgtgtgttagggaaaaaaaaagaaaagtatcacttcatctttattttaagaactaggcagagttgtcacttgtttttaaaaaggcaaagaattccaaaaacgaaaactgaaattttatgggactcagcagagaactatgttaaaattggagcaatgaatgagtacatattaggcaggaaaagagtaattatagatcgttgagtacacgggcacccaaataggatgaatttatattgtactttttcaaaacagtattactattttatttcatttttgtcattaacaatgttatatgtagcagcactacaattaccctctttttaattgctcataatttgctttagaaatgaattaaactcggtggaacattgaatgagagttcaccattacaatgaggtacatttacaatgttaacaaatgaggataaacagtgatacttccctttgtgttatggggaggggggcgggcaagtgaatggccaggagccaaaggtggaggagagacatgcttttcacaatgtattctgatatgtttttggaccaatgcttacatgttaaatttttaaaaatagcttttcaattttttttttaagttggacattttagctttaacaaaatcacttctccagttggcaaaaataaatttaaatttaaaaattggggcctcaccaattcagaatgaaaagctatcaataacagatgtgactgaatttttgtttctgatttctttgctaaggaaattaatgttgtaaaactggcccacactacatttcaaactatataaaataatgaattattttaaatcattttagaagcaccagtggtgatcagaaattagaagcatacaaacatcttaatttcgaacgacctcagttataaaaactggcttagcaaaaattctaccatgtaatgtagaaaactttcttttccataggaagtaatttaattgttttgtttggaatgtcttctgccttggacttttcagaaacatatagtggcattcctgtgtcaccaacaagctcagcacatgctagatggtatgcagtggtcaatcagaattgacctctttttattttcccagtgaagtatggaaataatcctctgggcataagtttcatgtattactttttggctcatgtttccaagagtcattcaatattcataaacatcttttataagcagagttatgacccaagatacaaaggccagcaaccctcagcatttttccatttgtaaaaaatctttggctttttaatgttcattgtttttcatgctgtccatcttcccgaaaaattctgccaagtctgtgccaacctttccttccagagtgatctgactacagcctcctctgatcaccttaactcaggcgtcatgcaacaactgacaactcagctcatgtatataaataatgtgcatcttgtgttactcgcagaatatgcctttgtaatccatattggttatttcatgaatttatatttggtctctccaacttattggatctgatggtgaagtttgagtttcctacttaaatcttctctgaacgtattctctggagttacattagaaaaaaaaaaagaagtctatctctcatggtaaatgtttgagtgtattctgaagatgagtaacaccctgagactttaagtcggataatttaaggttgtgtttgcagcacccagtacagtgggtgacatatagcagatattaaatgaatgatgagataggtacatgaaccatgtcttagatacagtgtatacagcaagatgtcagttaatatacaatgtatacagcaagatgtcagttaatatttcttaatgaatgcatccatccatccatctattcactgaaattatttgtatgcttctaaaaagaaattattcctttctggctcctttgtaaccatgaaagatcacagacgagattatgagatgacttatggatacttcctggattagcatagtttgcataagcagaactaaacatgccatgcaaatacagttacggtttacatattttatacattaccatgattgtaaatacaattgaactggtaggaattaaaattactatcatattaatcattatcaataattgctaaggcacaataagtttataatacttttaaataagtagaatgcagaccttgaaatctgacactttgcaatacaatcttggattatgttttgtatctggcacatttatcaaattatcgtcagaagccctagccatagtagtcaaagttgctttgattccatttataagcatggccagatcctttaaaattctactgtattgaggctcaagttataatatttgcaacccaattctaaaatatgcaaccagaagctaacacatatgaatgcccagtggtactcaagatattttaacaccttaaatatgaaaaaatgttttaatttgtttgttccatcaacaagaaatggagggcagagagtgcttgagctatgcgcaaaaatcagcactttggtggctgaggagaggagtgcttcaagagctgtatatgtcaatttttataacggtaaacacttgaagactgccaatcaacgataaggtaagaaagtaacaacatatcatgcaagtatttaacaagcagaaaaaggaaacacatttatagggatatattttgcagtgacaaaatgatatgcactggtacagtttcatgagaacaggatttattgtcccaagtttccagggcccatctgtcactatgtcttagcatcattatatattacttcaacagtgcttaaaggatgcatgctacttttacttgtatctattgccagatgtgaaatagacaactgagaatggtctaaagaactcacagtctgcaatgcatgaagtgctctgcaacaacacagacatgtatcatccaaatagtttcttttcacctctagggatttggtgagtgaaaatgcttccagcaagaggaattagggaggcaattagaagaaagctgttgaggagtgggaattgatgggcaagcaccttcaagctttgggaatattataaaagatggaaaacacttaaaacaaatgcattcctccaacaaaaattgttaaagacatttcttgctggaaggactttctgcttcagtttctctccccagctgtgcatccagcatgtaacttccagagtgaactattcaaacacaaatcagattgtaccactctcagatgaaaatcctccatgcatctttactgaccacagaacaaagtcagaactccttgcagagcctgctgggccctccatgatgcagccaggtctagtttcacaaactcctctccagctgcctcctgtgcacagcccatctgccacttctgactactttgagctcggcatgtaccttgctgttccactcctttgtgcctcatattccttttctttctccgtgagatcccttacttctatcttacttccatcacccctgccacagaccacacttactcatccttcaaggcattgtttcacgttcctctttcttcaagacttctctgatatccccaagcagacagttttggtccttttcttttttatgcctgcctcccccatagcttttacagaccactattaaagccctttcataaaaaaaaagaaggtccctctctatgtagattctcattatactaatatttgctatttatatctgcaaaaaatgtttgccccagaatcactatgaacctagaagaaccaccataatgactttgcacgtgtgccaatggagacattaaagttgccagtggattctgccaaaggtatagtgtgcaatgcaggtgtatctctgttgttcaccttttgggcccaatcttgtaccagcattgtttacctacttaactatttaatactagtgcattgatatcttcctctgtcttacctttcccctgaaagttagcctttcaaaagatccaaaaattgagtttaccaacccaggcccattttatcatatttcaccaattctaaaacacaccctaccctgctccaacacagttgcacaattctggattcagcatgcatcttctaattgatgcttcaattaaaatcttacatcttacagtcaaagtataattagaagcctttattatttcttagagacccgtgaatctgtgaagtgatgccatttttttttacaattgatgatatcaacaattcaataaaatatggtggatggtactttaatgtattttttaaatttacttaataacagaaacttcctgttattgttgggcacatataaaacatccactgtggtttgattagtgcaaataattgggtaagggatgttttaaatgctttttattttgcagaaatatgcaggttgacttgtataggtattagatggtaatgcagtgatatttggagaaatcagtcgagctcccctaatacattattagttttcccatataaattagtgaaagagaagtgcctattttctgaaaatatgctatccaccatgttttcagaaatatattggatgttgaaaatgaagagtgcctgtatgtgctaagtctgtcccacagagtgaaccaggttttctctgaggacaggagctctgcttggttttgtctgtttcccttctccaaggacagagatgagctcattgtaagtgttcaataaatggttgctggatgactaaaggaaaacttggaaactgtacttgggtttaagaatataactcattcttatattacatttatatcttaaatatcttaaacattttcatatcttacatattttatatttatatttatacatattttaatatatttggcaaattactaggtcaataaacttagtaggcaatgctaggaagccacagctttgacacgtttgttttgaaaaaataaagtttctgggtttggtttgtcgtgcataattttataaactaggtatcattggataacactactttaacgattaggtatgactcttaggtacaccataacattgccaaaattggctaggtataattttaaagaactgtgcatgacagctgggcaaaaatacattggtttgcttctataaatattttcttatggactaacatacttttatgcatggaaaagactctttaaaaaataacaggttggccaggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaacaggttagcatttcgcaaatcactggcatatgtgtacatcaactcacacacacttttccacccagaacacatggctaacaggtactgctcactcaataactaaatttgactattccttagaaatattttagatggaaatcagtgaatattaaacatttcatatttgcacaactctgttccaaacaatgtgaaaacttactatgaaaagtgtaacctgaagattaaaatagaacatgtatattcataacgttcctatttatgtatgaaaaaatacaagcttaaatgttagtgagaaaatgcagcacatatttgcaaattattctgggtgaagggactaaagaattgagagataactgcagtgctattggcaaatgtattaaggtagaaaaagtatgaaaaatgatgaggttttcagcagacaagtgcttaacaaaagttttaaaaattatggtagagttgaagaaagcatagtaactcaaacttgagtaatatgagaggtcccctgaaaggtatagaacttcgatgtgacagtgtgtttttattatgatgtaacttaaacacctacaatatgtacaaatttctcatgtaagtataaaagcaaaacaaatttacaaatacaaaaatgcaaagctaataaaatataaattaggaacatacatttaatgtgacaaaggacattttgctaaaataaagtcttattaaaagtttaagttttgaatataagaaaataatatcaagcccaatatactctttgagctgtatctgttatgacatgcatgtttgaagaagtctgtagtataaaaataataaaactgtggcttagatttaatatcatgaaaatgacagtacttactgatataattattaccctctaacaataatagaggccatgatggtaaaaatttagtgagttgatacatttaaagcttggttcaggataaacagatttcatatttaactatatttaactaaaacgttagctagcatttaaacatagaataccagttttactgagctatgaagttgagctgactacttcaagataatgttaacagtgcaatattactaaaattgcattacagttgtatttgatccaattatttctgaatgaaaaccagaaaaccttatttgattttcattttaaatttcacctcttacagattgaaaataaaaaaaaaaattttggttgtagtaaatagctcatcacccaaatgttgatggaaatgtgaaaatactggaaatggctaatttacagcattttgaaaacgatttggtcctaagtcatttctttctcttttaactattgattcaacttctaacatttacattattaaaacttgtgttctctcactgctctgttcacttggaatgagtatataatttatatattaagtatgcctctgttctttttatcattagactgtgacaactagcagaatgcctactatcattttagtgatgtgaaatccaagtctttatttaatgacttaaaaaaacaaaagttttcttgtaggaacatgtcacttatttgtttcattcaaatggaacccttaagaagtcaacacatggcaatttcaatcataaaatgcttcacccagaatattcagatctttcaatgcatgggcaaaggttgccatggccccaataaccactacacacaagtgacagggccattcatggccctctagtgagctagggccgggcaactacacagaatgtgagctagggccgggcaacgtccaggggagtactgtgaataacagagatgttagcattctcccaagaccaactttctcccaagatggcctcctgagacaggttccagttttctgaacctatgcttatctaaacctagtgcttataaaaactagcctagccacattgtggaagatacagacaattttggaatcatcctgaaatctgttcattgaagctatggaggatgcccacctcttccataaaccagtagatttccaaaaccccaaaatcactaataaatacgtgtggaatgctgagcagatatctcagaaggtgaaccttaaaataaatggcaacatttgtagaaatgtaaactggtaggctgcaagttgcaggttaatgtaaaacaaaggaacaaaacaaaaacaaatgactaccaatgtccccaagaaactgcagaaagatcagaggcaatggaatattagaaactccaaaggacacccaacaaaaaccctttccagaccacagccccatgtttagaatggcaattcagtagggcagggacactggggccagtgggtaagaaatattcgataattgggccagcagtccagaggcagcagagctcagaacctgacggtcggtacacagaaaagctccatgtttacccatcaggataacaacagtggagggacccctcgtactgacaatatgcagaggctactctacccaatgtgtgggaaaaactcccatttcatgtgaacaacaagaagaacaaccaaacaaacggatcatgatgaagcccttgtaaaaacattacagaataagatgaatgaaataatacataggccgggcatggtggctcacgcctggaatcccagaaccttgggaggccaaggcaggcgaatcacctgaggtcaggagtctgagactggcctggccaacgtggtgaaaccccatctctactaaaaatacaaaaattagccgggtgtggtggtgcgtgcctgtaatctcagctactcaggaggctgaggcaggagaattgcttgaacccagaaggtggaggttgcagtgagccaagattgcaccactgtactccggcctgggtgacagagcgaggttctgtctcaaaaaataataaaagtaaaaataaaataatacataaacgtataaacagaaaataaacactcaaagcagatgaagactataatcgaatatgacaacatgaccaaaagaaatttaaacaaatagaagctccaaaagaatcacaaaactagaaataagaaaacacagaaatgatgtctaaatgataagagactaaaaaaagaaagaacaaaaactgttcaggaaatgatgaaaaagaaatgaaaaaagtatttgagaaagaggagtgaaatacaggggacagaggagtgaggggacagcatgaggagtgaagcaagggaaagagaatgtagaaaacataaaaacagagggaaatacatggaaagaaaacaaaggaaaggaaagaccaaaccatagatcctggtataattagaatacaaaaggaatcctgaaaacaatgcaataaaataaatatcacatgatgaaactaggaaaatatatccgtaactatcaacaaaaagataacatacattctcatagagctgctgacttgaacaataaagggaaagtctctttccgtattcaggagaaaagagcaagccacttcgagggaaaaaaaaacattctcagcagtaacattttatgctgctggttaacattatccttgtggttaacattttaaccacgaggcaaggaagcagcagatttaagagtctcaagaaatgaaaatgtgagacaaacaccttcgaaaagttagaaacagacccataaagtaaaccaaataaagcaaagaaagaaactaataaatgcacttggacacaggaaggggaacatcacaaaccggggcctgtcatggggtcgggggagggaggagggatagcattaggaaatatacctaatgtaaatgacaagttaatgggtgcagcacaccaacatggcacatgtatacatatgtaacaaacctgcatgttatgcacatgtaccctagaacttaaagtataataaaaatatttttaaaggaaaaaaattaaacaaaaattaataagttaattaagctgattctttttaaaaaaaatcaacaaaatgagcaaaccaattggctaacctaaaacaaaatggaacaaacaaaaaatactgctagccaacctgatgacaacaaaatgctaatcaaaataacaaaaaaatacaaaattaggagaaaatcaaacagaggaaagaaaagctatttacacaggtctatgttaccaaataattaaacaaaataaataggggataatttcctaagaaaatatacttcaccaaatagaccccaatagaccaagcaagtctgaaacagacagttttgactgaacactgtgactcacgcctgtaatcccagcactttgggaggccgaggtgggaggatcgcttgagtctgggagttggagaccagcctgggcaacatagcaagaccctgtctctaaaaaaagttttaagaatcagccacacatggtggcacacacctgtagtcccagctacatgggaggatgaggtgggagatctcttgatcccaagagctggaggttgcagtgagctatgatcacaccactacactccagcctgggcaacagagcaagatcttgtctctactaaaaaatgaagacataggtctgccacagtggctcacgcctgtaatcccagcactttgggaagccaagacaggtggatcacaaggtcaggagattgagaccatcctggccaacacagtgaaaccgcatctctactaaacacacaaaaagttagccaggcgtggtggcacacgcttgtagtcccagctactcgggaggctaaggcaggagaatcgcttgaacctgggggacagaggttgcagtgagccgaaaatgaaccactgcactccagcctgggtgacaagagtgagactccatctcgaaaaaacaaaaacaaaaacaaaaaaaaaacaaaaaataaaaaataaaaataaaaataaaacagacaatttccatagaagaaataggaaatactgcaaaggaacccccacaaaaacgcaacaggaccagatgatttcaccgggaactgataccaaacttttaaagtgaaaacaattctgagagtgctcagactattttatagtgtgcatacatgcccgccacccacacacatgaaaaatctaatatcaaaacctgacaaagattagaccaaatttaaaataaggaaaataataacatatataacaaaacaacacattaaaatagaataaaaatgtatgttgacccagtagggatttttctttatcggaatggaaggataactcaatatttaaaaatctcttctcttacaagcactaaggaaaaaataataatttgacaaattaaaaataaacatttgacaaattaaaaagctagttgtgctacaactctcaaaatgtgaaattaaagtttattcacttaatccaataatgtacacatacttcaaatcccaattttttgaactagttaatgaagaaacactagagatgttctagataaaccaaaaacaaaacaaaataaaaatgttcactacctctactagtatttaaaattttaccggcagtgttagtcaattcatttattttactttaagtaagtaaaagcaactagggcataaaaattacaaagaaaaagacaaatctttctttatttgaatatgatatgatcatatggaagcatcaaaagaattagcaggaaaactattatgactaatacaagaatctagaacatttagtaaagtagcagaatataatattaatgtatagaaaccaacagccttcatttaaaagaacaagttagaacatgtaatagaagacctcatacaaataacaaaatgattaaataaaataccaaagcataaatataaccaagaatgtgcaaaatctgtatgaggaaacctacaaaactctcctgtatgacataaaatgcagacaatagaaagtttgtccatgatttggataagaattgtgtatggtacaaataaccacaaacaaagccaatcacaatggcaaactgggaaaaacaattgcaacttatatcacaaacggctgatacttctaacacacacagagtggccaaaattgaatgaaaaaatagtaacttaaaaatggctcttgatacataaaatcccatctaacctcactctcaaaagggaaatgcaaattaaaactacagtggattaccgtttcccacccttcagactggcaaatatccagaagtctgacatattttgaggtgaccatgtgggaaagaagcacctgtgcgcattgctggtcaaaatacaaagcagttcagaggacaaggagtacacagaaactattcaagagcaccatctggaagcaatcagccaaatctcaaatgtagaatcttccacaagacaaaagacgcatgtcttccaatggatcaatgacataggaaaattttttgcaggatgtgaaaagctgaaacttagtggacttacagagacttaaaggagacttaagaaacataagtgggaggccgaggcgggcagatcacctgaggtcgggagttcaagaccaacatggagaagccccatctctactgaaaatacaaaattagcccggggtggtggcttatgcctgtaatcccagctacttgggaggctgaggcaggagaattgcttgaatgcaggaggcagaggttgcagtgagctgagatcgtgccattgcactccagcctgggcaacaaaagtgaacctccctcccaaaaacgaaaacaaaaacaatcaagtatactatgtaaaccttgtctgagtcttgagttgaagaaaccaaccataaaaaaaatttgtgacaatattaggaaatatgaacggtgggttaagtattagcctacattaaggaattattgctaagtcttgttacaaatattttatcatatgtaaaatattattatatttgataatggtatggtggttataaaaagagaaaattttatcagtcaccaatacaaaaggagttatttctgaaatgacttggtttctcagatttgctttaaaatgaaacagaattggctaaatattgataattgttgatgtgtagttacagggattcacattataactgtaatatactttggggtaaattttttaaagtccacaataaaaagttaaacaagaacctattaatgcattgtctgtgatctctgtctttcaaggatggcacacaattaattatgtataaaagggaagcaatgaaattgacaaataattatgtgttatatattgtctcagtagattctcaaaatccttgtacaaaataaaacactttctcaccaaaattagctaacttgagatgctgatacaaccagtaagtgaaagaactaagatctgagtcgtctgtcatttgtcaaactctaaaatctgcactcctattactgcttccccaaatagtacaatttaaatactctagggacagcatcatctacatatgtttaacctatgtaaagattagtgctatggaaggaaaagatatccagtgacagaaattttcttccttttctttccctttctttacccttttaaaacattttatatctattttgtttccaattggtactaatttcacatgacacataattttccttttggccccagacattttttccatctcatgtccttttttttttatccttttgtattttcaaaacacatcaagtaaatgacatcgtgctgcaataatatcatgctctaactctatcatgtgactctgattctgcactccctaagtcaacaaataataaggtgcttctctgggccagcccctgtgctgggttgtgggctcagccctaagtggcatgaataaccctactcgagacttcacacagtcattagtcaaaccatcttgttccttctcagatattccaagagtttgtgacttacaaaatttatttaacttttaaaatagtctcatgcaacaatttctcccagtctctggagttatgcctttttaaaaaggacttccatatgtataagataaaatgatgttttgttttactgaaatgaacaagaaaatatgattaaagggattaagactttcaacacatttaggttcttagtttaaatgacatggaagtgctcaccttgacaatgccccggatgtgcatttttgctatcatctctgccgtgtagagaaacatcaataatgtatccaaagtgaaggtcacatactgaagtggaggatagtgctcgaaggtcattggcgtattcatacaaacagaaatgacgctgatgatggcacagatgcgcagcaaagagtgaacccactgcaatgatggtccagagttactacacggcaccataactgatatctcaaacttgtattatgaaccacactaagtggaaaacataatactgaggttaaaatagtttactaatgtggaggtgaagaagaagaaatctaacactaagtgcatataatgtgctacaaatattttcacgtttttatatcatttaattctcaaggcacctattttccacataaacacactaagacagaaaggtggaggcatttctgtggccatgcgttacaaagacccaaagcatagacggaacctgatcaggctctcccaaacatctgataacctcctgggcatcagactacaatataggaagattctggttcaattaaaatatgtgtttgtaatttagtcacataggaacttgatgtgccattacttttttttcatttttgtactataagtacctagaattaggggcatactatatttaccataacttccctagcatctagcacaagggcctatcatagtagttaagaaatgctttttaaatgaattgatatataacacatcccatatttagaatttcctttctatttgtatctgatatataatgcctttgtataaaaatacaaagaaactttttaaaaatctggtctcatcctacatttgaaaaaaatgcatagattttttctctttattttggagaacacattttatacaaatttagcccagacatctttcaaaattccacaaaataactttctgtgcaacactacaggcatgtctgctgtctgaagattttctttaaccccaaaataagaagaaagaattaaagataagtgtgtgttaacatgaatatatatacaggacatacaatcactcatactcaatattttattatgaaaactagtatctaggattaaaaaaatacttaactgcatctccatgctaaacccaccacaattaatattaccagttaatcaattagtatacaattcttaaacataatccaaatacgtttttattgactatctgggacatatatgaaattatgataattctttaatataatactctgaaaaaaattttagtcttgtagtagatggattctgcagctatatatactagcaaatactcaagatgaaaaatagaaaagactgtcagaactttcaggagactcagacacttgcagctgaggagttataatatttatctgacagttataatatttacatgaagatattttgctgctaattccataccacataagccactgatgattcagtttactttaaaggttgatgtatttttcatgcaatttggaagcacttcaataaacattggtgtgtgaatttagccccatctggactttcaacataaagaatctaattatacaaaagagcttccaaatataagttcttcaacaacaaaagtgtttttagtttaaagacataattttaatgaagaattattaattttagtaagtgcctccaaggccacatcttttatactaccttcttcataagtttgtagaaagctctgtaataagatggacactaagaaaaagttaggggtgcttcattctctattccattcaattctctaagtatgaatgaaggcctactatgtgtcagaatgctgggaatggagaacaaaatatggaagcaacacacttctgactcctgctttgcagtccaagaagtaaaacacctatgaatgtattatatatatatatatatatatatatatatatatatatatatatacatacacatacatatatataatgtgtgcatatacacatagcatgttatatgtatgtatatattatgtttcatgtaaatacacatacatgtaaacacatgtagtctggaaggcagattagagaaagaaagacagactgggaaggacaacaaagagtccatgcagatcctgcatgtatcatggttaggggaaagacaagcactgcaagaggcaaaaacatgtcacattatataacattataaaacatgttctagataagacataatatacatatatcatgtatagtctcacgtatataacatatatacatattacatatacatgttatatgcatgcacatataaatatatgtacacattatacatacatataatatatatgtatatgcatatgcgacatgtatatatgttatatacacatgatatttatatgtgtgggtaatatgcatatatgttaacacatataacatatatgtgtatgtgtaatgtgtatatatgtgatatacatataacctgttatatgtttatatgtatgtgtatataacatgtatatatacctaagacaatagatccataaatatatgtatattatataaatatacacacgacctacaatgtatataatgtaaatatacacataatatatgatgcatataaaaatacagttatttatagataactttatatttacatacaaatataaaacaggctaagtggaaagagaagagaggtacattctgtctgtggtggaaataagcctttcagaggaggatgccagaggtgacatctcatccagtcctaatggatgaggaggatttgactcatcagaggagctgggaaagggtcactggggccagggagcagtacgagcagggaaagcaatgtgaacaatccagagagcctagaggagtaggaggctgctgatggggctcaagtggacagtgtgctgacacaggaaaggagcagttgctggacaggttaggtcctgaatgaaaagaagcaggaatgtcacactaacgtattttaatttgcaatgaaggtaatagggatgcttccatgattataaagcagaagcgtgatgtgaataaaaatagaaatatagaaagaaatgtgagcaggcagggaaagtaacctggagggcagattagaggaagagagactgggaaggacagcaaagagtccaagcagatcatgtgtgtatcatggttgggggaaggacaagcactgcaagagggaacaggccatttccttttgttacttcagcatcaaccatgagatgagtaagaagttgatcctgcttggttttgcagagctgagattccagcactcatggatatgcatgcctgtcaggcttagttctggttactatgctttctggcacacagtcgtgcctggcctagcagttcttctcaaatcctcatcaacttaattaggcggtgaaggtgacaaagttcttcagagataccatccattatctcattgaccttttactcaaattttgcaaatcagaaggagacctttaattccaaacatgtgcatattgtctcacggattcaggaacgttgacaacaagtaaaggaggttcattcagaacaggttgctcatcttggaccccagctttggatcagcctaagaagtggtatcatctctacaccatgtgactctgaggacagggtgcacagcgtggggaggggaggggatcagactacccagtgcatcttcctatgtgagtaactcatagcgacatctcactatttcattggattgttctctacttccagactctgaacctcatccatattctactgcagctcagatatttcgaagccaaaggtacatgatatttgaatttgtcaatcacatttatctcacatccacatatgcttctccatactcaaagaagaaacttactggtttgttaatccagaggatgtcagcattatccgacagagactcatcaggaccaaagtcagtgactggctgggcttccaccctggaactctgcttccttttgagcatgctgaggttagctttggtgagcaagcacaaaaccacagtctgggaaaaggaaaagttgtatttgtcatctaaaccatcttgccctcatcaaaaaattgagttccccacatatatctacttatttgtaaggcatatatgtgttctactccatagtgtataataaacatatgaaaatagaaactttaaaaggatgagataaattaataccaacagaagcttgatttttttctcccaaagcaatggattattttatgtacttcaaaagcagtttagaggctagctatttagaatagctagagtaaaatgggttgcttcttagggcagacatattcttgggaaaatctttttagatgtatgctcttatacctaaagctgtctccacatagaggtgctttgtgctagaacactgctgagtaatacagatgaaatgcacagatcttccccatggtttccccagtgttaatttaatacgacattcacagacgtctcttacttccaacagtagccccaagttgatctcccaacttgggaggggagggaggtcagaaagaatgggggaagaacctcccctaaatggagatgttgttttatgaatgcagtgattatctaaattcttccagctactctgaagtaaattgttcatgaaattacattgaggtgggagatgagatgcctgctaactgcttaaatttccacaattctgaaacatctacatcctgtgatagacgttacctccctatggccattgctactgccttccacaactcagcagtcacttgaaggggggctattatatgtcagccctcaggacacaaatagcaaataagtgcaatacaatgtgagaagaattgttataaaggcaggtggtacctgatgatccctgagtcgactgtgagacttcccatttgattagcacctggattgagtcttaaaggaaggtgaggaactaacagctatgggcatatactatgtttgggacacttagcaatgatattttatttgatctttacaacagccctaaccaaaaaaaaacaaaaaacaaaaaactcatcttcttacacatgcatgagaaaaatgagaaaagctagcctcaaggcaggtaataacttgaccaaggccatccaagcaaacttgaaatttaaaataagctctgtttgactacaatgtgtaaggggtttagagttgaccatgctgaagctgcagactattaggagaatttctcaaggcgggtaacagaaaaaaaagagcgcttcaggcaaaaaaaagaggctgagtcaggaaaacgtagcactgcagttttaacatcaggcgggttcactggctctcctatctggtgctccatgggtctagagaaagaaacctaaccaagcacaatgggtgccacttagtcctcactggagtacaagaacatgtttgcagtgtgtgtgtgtgtgtgtgtgtgtgtgtgtgtgtgtgcacgtgtgtgcgcgcgcacacagatgcagtttttactggaaaagagaataaaacacagaaactcagaacaaagcagctccgaatctgattgcctgtattgagcacctatccccatcgctatgtgctcctttatctacctgggcaggtatctctgcctaactctcctgatatgggttggctgtgtcctcccaccccccaaaatttcatcttgaattataatccccacaatccccacgtgtggagagaggggttgaattatggtggcggtttcccccatgctgttctcatgatagggagtgagttctcacaagatctgatggttttataagtgtttgacagttcctacttcacacactctttctcctgccgccttgtgaagaaggtgtcttcgaccatgattgtaagtttcctgaggcctccccagccatgcagaatggagtcaattaaacctctttcctttataaattagccagcgtcgtcaggtatttctttatagaagtgtgaaaacggacggattcacctcctattcccagaagaaaacaagctaactggcttgaagacatgctgggtatttccaggctgttattgctctgaatattgagtttgaatatgggctttgcagtaggctgcactaattaatttatgttatataattggagtttgggactctttgatatcccatgttaatgtatacagagtatttaaagtgttttttttttctctgatgtactggtagtggggaaggaaatctggtggcctcaatttgagatgcctcttcaatgacagtctcctatccacccaaatactgagtgtagatacaatcttttagaaatccttcaagatgacacatacaaaggagcaagtaaaagagtggtttcacttcaaagattatataaggaattttagagatctgtccacaattcctctttcactgagcagtggagacaatgggcatatgaattccatgcacctttattatcaatacgccacctaaagcaaaaatcatttttgattatggatttgtttatctagaaaaatacatgtccagaatttattgttttttaaaaaattcccactttggttatatctgaccaaccaaaatagtgcaattataactgaatgacattagctgtcactcacatttaccttcactttacctgctcccaggtgccactaaatctcacagtgcccaagaaatgatctaagctccaaagatacctggctaatccacacatacataaaaactcaacaactagctcctggatctctagatttaatttaatactattaaatattatataaagcattcaagtagtaaaataaatttaagttacaaacacatgaggaattcaaaattaatttgaggtggttgattgtaataattttcctttgcaaacagaaatattgttttatgccttcattcatgttgaatcaataaaactgcatacagcagacctattatttctctgataaaaaccagtagggatatttaagtatcctaggtaagtttattattttgataggaaattgctcctgtgtatctgagccttatcattattatgtttttataagccaatatctcttttttctgtttaccaaagtgtccttcataagacagtacacaaagtttgaaaaacatggctttcaaaaggtttccgacatttattaaaagtagttggtatttaaatagttcaatatcgggagagaggctacacagtcacaatgtatccattaataaatcttttactcagaaacagcttatagcaactcaggaaactcattcatcccatgttcattgctgttttaaatggttaagacccagtttttgtattctgtgatagcaatttcatttctattggtatatactttccctacttcattccagccccgtcttcacagtattaaaattaaaatattccattttctttaactgcagcgcccttgcaacactatgggtcatttctttcccttgcagctctcttgggttcagtattaaagtcttttgaatcttctcctgtcttccaaattatggttcacagcatgcccttcttgcctgtcttctctacttaaccccttaagtgatcacctgttgttacagtttccattaccatctgtgtccagctactaatttagagaggtatcggtgctgcttcccccgcagatgtaggaagacggtgccaacaccatcatgaatgaagattcagcctgagagagcgacatgagccaggcatcctgcttttctccttcctctcatgtcccagaccctactgctctgaactcttcaggttccccatgtgcagcgggaaggcccagcaggttctctttgcacccactctcagcagtggattgttttcttgctcattcattccatatatgtacaacggcctttttcacctatccccatttctagactcctttctaggtaggccatgggccctcaggtctgggatgcctttcaaaatgttccctcttttatataaaaaaaaatcagcttccaaacacactgtaggtctcctttgtagcccagaaaacctcagtgtatcttcttatttctcattcactcactcatttgttcattcattcattcacacagcaaatattatgcatccactgtggtatcaggcactgcggtatgtgctgggtatacagcactgaatatgaaggcattcttgaagcttacgaactgcctactttatttaaccttatgtttccaggaccctgagtcccactgatttgtacctgcacttcctttcacactcataccacatgctgcactcaggttggctaaacataccattattcaccatcctgcaacctttactcaactaattcaaaccctttatccaagccatgtcctctttgttatccaatgccaatcccacatcagtctttcctaattccctcacttaactcatgaagactttgtctatgtgtgtgatttgttataactgaaaaacttaatatttgggaataaagatgtgagaagataaacatacaacttgtataaaatgaaagcatctatttcattctaaaaagccccaaagaagacagaagtcattgactcatttttaatcattaggtgttattaaggttgtcaatacatcaataccaacaaccactcttctgataacttttgtgcataaactgtggggtctttaggagtgcaagtgaaattgtttatcaaccgccctattgcagacacagacacacacatacacacttaatggtgggtttttatctctttgcttagtatccctggcacagtttgagaaggaaattaagaaaagaaaatgttcaataacatctccgggactcttcacctcaaactctgactttcatgtctttgggaaaccaaccagcattgctagcagaagtttctcattcattcatgtttgcataattgttttgttttttgactatcctgaccattttgttaagtgacgtggatttaacattgaacaaaacatactaggtcttttccctccatgttcctgacatggaagacaacatactgtatttaaaggcagagtagctgattaattaaaagagagcctctagtgtggcgcactttctcttcaacgtccatctagtggttttcttattccttcagtaccttactgctggctccatactacctccctaggcaaggaatattgagcagtggattcccaacacgtttctgtgctatcgggcataatgagattcatgcaaaaatccaggagagctgactggtctttctttgcctagatctcaaatacttaaaccttaaattaagttagaagaaaataattctattcttattttattttcattaacacaagtaatacaggtttgttgtagaaaaattagaaaaactatataaacaaaataagaaacaaaaatgaaagccatcagggattccacttctagagactcaatcatttttgcaaagaatttgttgagcacatacattgtgtctgccaccgaacaaggggctgcagatgaagtagtaattagttatggtctcttgtggaattttctttagggtgcttactctccaagaggatatgaattgtatctcttttaggactttctttgccacatatatttttccatgcatacatttatttttaaatggctgcttacacatggttttgtaaccagattttttaaatctagccatattctgtgaacatcatcctctgtcaataaatacacatgtgcagaaaatcctaactgtaagtaaacactaccttcaaacatctgtgccccttccttgtctttcttgtcccatagctcattcacatgcttatacgtgcaaggccttacaaggtgagctgatataagcacagctttccagattaggttcccagtgttaaatttgtatctgagaaaggcattaccccatattttgaagacacatgtatttgatgttaccaatttgttaatgtaggcattacaatattaattcttatttcaaatgtttttatttcttcctctttttagttccaatagccacagaactcaaaacaacaaaccactaaaatctacatttgaacaagagcttcctgtcctttccctatatgcacatttacatcttcagttttacctcaatacaccacagtgaaaacttgacgacaaaaggcgatgcttaacagcaagatggccttgtttctgtaaagtttgactgtcaattttgcttgctaagttccttctcagacagaagacatgtccattcagagcaaatgaatgtagcatcatacattttatgctatggtttcaactaggaaaaaataccccatatttttgtcttattatctgttatccaacatccatccacctgcctcatgtgtcaccatccctgcccactctgccgtcctccaattcccagggcccatttgagcctcagagctactgatacctgcacctccctctgcccagctgagtgtcctctctgtgcatcttgagtgtatgaacttcccctctttctctgagcccagatcatctgtgtcctgcatgctcacgctcttcctctccctccatgaggtcacctctcacggcctccacagcctctcacacgcactgggcactttccagaccagaatccagcaactctgctgtctcccatttaggggctgctcaatgactgccttgagatttcaatcatcacgacaatttaagggaaagtgttaaaaacagaagttgctgtaaaaatgaatgttatctcctactcagaatgctttctccaaaggaaaatagccttcagtagctcacacacacttgcacacacacatataccccatgaaaaagtgctttgggatacatgagagtttccatgttaaaatagtgagctcactggttgatttcaacccaaattacgtttactgtcatgcaaaaacagagtccttctaacaaaaatgttggttgaggggttattatgtgccagtctgtttaataatatcatacattttcaggccatgtgtggtggctcccacttgtaatcctagcatttagggaagctgaggcagtggatcgcttgagtccaggagttcgagaccagcctgggcaacatggagaaaacccatctctacaaaaaaaaaaaaaaaatacaaaaaattagctgggagtactggcatgcacctgtagtcccagctactcaggagtctgaggtgggaggctcacttgagcctgggaagtagaggctgcaatgagccaagatcatactactgcccctcagcctgggtgacagagtgagactctgtctcaaaaagaaaaaaagaaaaaagaatatgcactatgtcattccattttcacaagaaccattttacagatgaggaaacttaggcacagagacaagacgggacaatgtgcctgacagaactattgaatcaaaaattaagtatattacagaatggacaggaaatgagaaaatgactttttcaatatatttaaatcatatagcctggtgtttacaaactcttggcatcaattattttttgtgcaaatagtacagacatttctcatctcctgaaattgaatccatttttattatctgactcactttatgatttttctcaccacacacttataaaaatgtcaatttttttctggtagaaatcatcaaacctctcattaaatctatctaaataaccctttcaagtttctgaaggtattatccatttattattcctttttccttgaggatgaatcctagaaatattctattataccttcattatttttttctctaaatttggtaaagaatgagaaaaacatatttactaactcccatttgataatctcaccccatgtagtgaagagacagatctctccatttcctaaaatgacagatttcttcacttcctagagttagttttagtctcgtaatttcttgactgactaggctaagaatatgaaaactaaaaaatagattccacctatgatacatggctaaaagaatgtatgtaattttttacagagattgtgcaagagcaattaaaaggtatgtattgagaaagtttttctgtcatacccaaaatccaaagcccagaacacagttgttatgatttgttttgtagtgctctctgttcttctagcaaggaaaatgcagacaaaatagaaattctctaacaaaagtttatcaagaggtgactgtttatttgataaaaagaacatctactctataagtttccaatcataatatgttggaatatcccaaaaggtggtaaactcctttatggatactctcagagggaatgactacacattttagagtttgcagaaaagatttctcctctgtctgggactttgcaatagatgatatccaaagtgacttccaatgataaaagtgattaatactcttgacactgctcagatttttatgcatttgatcatttctcagggtagaatgaaagtccataaactactgtgcataattatagaatagaagcaagcttagacattatgtactcatttttttaacttgaaagatgagaacaaatattattgaaagcttactccatgccaggcactattctaagcatttgacacctctctgaagtagtttttagtattattcccactacagagattaaaaattggaggcaaacatgcccagacccacatgaattggaagcaagtttagaatccaagtagtctatttgtcgggagaacagagggagggagagaaatggtgaagcatttgactttcactttttaaccttaagaacttttgtacatttcacaaacacgaacttctgtacatgttcacaaagatgatgtgttttatttataatttctttgaaacaagtaaaacattaaaaaaattttcagtttaaacaagttacacctaacatttgctgagggtttattaagtgtgaggctaattgttacctatttctcaccatgcctcaatgaggtaagtgtctctctctctgttattctgattttacaggtgaaactgagttttggagaagataagtgccttgtctgaggtcacatggttagctgtgataaaccacgagggagccaggtctttctgattgccaccccaggaatactttgctgtccatgtcttctttcagtctgaccctttcaagtctttgtaaatagaacagtcttctttcccagagaacagagacgggaatctccaagttcctgcctattccacgtctaagtaataaaaccaaattagagcatgcctgccactagacttacaatgccagtccttccgggccctctcaagcaagcctctcctccgcgtatccttagcttgtgaacttcaatgagctggatgcatcattccctgtaatctggcctctgctcagaggaaaggcagcagctctatgttttctctcttaaacttagcctggagtcctgcgtctcccccagcaacacagcagagaacatgttagcaggagaactaagacagcatcaaaaaactgacaccctgggcatcacagcggcaatgcgtgtctccacaacagaacagcggcccactcccctgcccctgcaggtagtggattgttgtggttgattttcaatctaattttgtacaaaagtcaagaccctgatttggctgcctggttttctttgttcttccttctctttttctttctgcctctctccttctctctctctcctccaaatgccacctgccacttttcttttggggtactcattcatctgtgtcttggccctcactaaataatgtagctctgcaaaaaacagaattttgcatgcatggtccagtcccagcagacttcaagggctacccaaggtggtgaccacataggggaaggcaaatgtttcaaagaaccatctccaaaaacagactcttctgttttccttttgtcaaggtactgattagaaataaaaaatggttccccactttttatgagtctatttcttaaatcccaaagtaaaacagcaggttatttttctctggttatttctagaaaaactccaaaactgtcattacttctccaaggattctgttttgttttattttttaattgtgaaaattgaattttctctggcctttaaagtgattgggtttgctaaagggattcagtacacaccacaatgccccaatgcccttttgtcattgcaccctgcacgcccaaactaaaactgtcattgcacctacatgcccaaactaaaactgtcaagcagtatgagagggaactgggtcgtatttttgtcacctacatcacagtaatttttatttttgtttcattgtagtaggagcatttaacacgagaactgtcttaacagatttttacattcactataaaatgttaactacaggcacaatgtcataacacagatctctcgagctcactcatcttgcataactgaaacgttctacccagtaattaacaactccccattttcccctcctcccagcccctggccaccaccgtcctaccctgtgctgagtatatatcctactctatattaattatccagtgttggatattttattttgatgagctgctactatcatttatatattatgaaaaaccagaaaggggatacttattttgattgtggttgtttaatcttataatatgaatctgtaaaggttagataaagaaggtggatggtttaaaacagtggttttcaaaatttgctactatatttaaacataacagaagatcaaagggagattatgtttttgtgtttgttaaattttgcaatatgaatccacaaatttgctcaaaaggggatggtttaaaatagtaattcctaaagactgcttaacatatgaattatcaagggaggttcagaaacattctcaacactataaaccgaatggttctgccttcctcaagtcatatgttgaagctcttatctctaatgtatttggaggtggggcctttgggaggtcatgaggccatgaaggtggagaccccatgaatgggactagcgaatctataagaagaacggaggcagctgaatggtctgtggaccaggaagacagccctcacaggaatcagccagcaccttgatcttggacttcttagtctccagactgtataaaaccaaagtctggagtttaagccacctagtctgtgctatttgttacagcagcccaagctaactaagacactcaagctgaggcctccttcacctcagacatactaaatcagaatctttaagggtggaaaacaggacattgtatttttttaaaaacatcttcaggtgatccctgcacacctctcccatcactgtttccaaattaatgaggcatcactagcctagatgctcagaagagaacacttagagagttcacattgcatagtcatggctctgtgtggaaaagaataagagagtctaattataagcaacacaggcaaaatatgtctgagacaaaaattttgatttataattgtatgtatatacagtatattctattctttcctcagaaatcttcagaatttacttttaaaataactaacttgcattgtatacaggaattaaatttttgttttataaaaggataactaagatatttgagtttttgttggggtttctgttatgattttctagtctagactacacctttaaattgccattcaatgccttcaaagaaaggaagcaaaacgatattgcctctggaagtaatctcatgtgaatttcaaaataacaataaaacaactagaaaagggaatgaagcaaaggatttaccctgtagatactattaactgaaagataaagccgtaacaatttcttttaactagacttaatagaatacaatagcacaatcacccaagctcgatgatcggaaattatttttaacctaggactccctttcattctcttccttccatcactaagacgtggtagcattagtttttgtggatatatctttaccatccacctcttcatttccattactgcaatctgattccagttcttcaatcttggaattgtatatccaatttctccagtgcatttcttcactaacctccttgtcatcattccaatttgttggcattctaatttaccttaaatatacctgtagatcaatattcctcccagattggaatgctgtagctctcagtttttgctatcagatttagagtttatctatgtcatagtgaattcattcatgttttcattcttaaaactttatcctctttcttttttttcctttttttttgtacttcttaagatgaaatgctgactcccaataccattttaggtcacaaaactctttaaaaagatattgagtctgtgggcatgcttccgcttccatttcccctaaaataagcatcagacttttttttttttttttgagacggagtcttgccctgtcgcccaggctggagtgtaatgcgtgatctcggctcgctgcaacctctgcctcctgggttcaaatgattcgcctgcctcagcctcccctcccgagtagctgagattacaggtgcccaccatcacacctagctaatttttttgtatttttagcagggacggggtttcaccatgttggccacgctggtctcaaactcctgacctcgtgatccacccatctcggcctcccaaagtgctgggattacaggcgtgagccaccgcgcccggccagcattatgcttttgactgtgcatactataatgctctgatcgttggtatatatgggaagcctgtagttataaatgtattaaagatagcaacttttatgactttacggtcttttttctcatttaatcaaacaattttttgaactgttttctgatatttacacacttctacctcatttttttttactgatatcacttgcctagtatgtatttcttcacctatttatttttcacttttgactcatttacaacgtaagagaattgtctactgatatttttcaggactacagattttcaggacgttattttatgtttgctgataattttagagaggaagtataacattaatctaaattttctctttgtggataagtaatttctgaagcatttgatcacaatgatggtgaaatatttttctttttattggttttcaaatccaaagtttttatcaggctatatgtagatgttggctaagttttattaattgttttggtacatgataacttattttcatctgaagatttggattgtttttaatctaaaagaaaaaaagaatcttatctcactttaaaacatggctgtgttccatgcactgtgatcccctctgtcaggaaaaacatttattggtgtgtctctgttggctgtcttccatctatatcattctctctccaaacaacatcctcttttcatctcttttctttgcataattggaaataattctcactcttgatctcttcataaatgattctcttggcttcagtgttctggtctatcctacttctaattcttccactcctgctgcggaggcctacccctgcccccaccctggacctgtggggtcagtccctgtcttcagaacatattccggtatggctgccttgccctgggatctcatggagaaacaagcaattctgttttacaaaagcctgcttccaactttcaacttcgctccttcatactaaggggctcttccagggtctctcttccgtattttttgtacactgatcttagaaaggaaattgtgaactgaactttagcttttcctatcagtcctgttccatctatactgaatctaccagaaaagccttggattctgcagcctaggaaagaaagatcctcttcttcctttacctgtgggggtacagatttctcactatgtaagcccttttgatcatttacttgaagtctgagtaggaaagcaaaaagcagaattagactcctgaatacaacagccaattttctaaaggaacttgcattgatttttttctttttccagctttgaacttttatagtattcctattttggctttactctaagaggtatattttagcatctggttttcaggtgatttttgtaaaggtcaagtttttatatagcacaaaggtcaaacatccaaattattatgttaccttcttttatttctgtaaaagagggaatgtgatccaccaacactttttgtaaaagggtagatttacctcaaaagcagattaagcaatttattcaaaattataatctgaattctttaggaaatcaatttaaagacatacaatatatctctataataattcagatacttcttttttcaaagacataattactggaaatttatcataaataaattataatctgaatttttcaggaaaccaatttgaagatatggaaaaataggtgacagatatggacatatttggatatttatactgaaaaacataaaatagaaataaatctctacattataactatcaggacactgtttataatgatgaaaaactggaaacagcaaatgtccaatgatagaggtatggttaaatatatgaggctgtatttactgggtatggtgttatacagccatttacaatttttaagtaagaaaattatatagaaatattttaaatatttataataaatattcagtggtaaaaacagtataaaagttgtccaatgccacgatgacaactacctgaagtcaagcccttaaaaagactacaaaaaacacacagatattgtggtcatctgtcttcggttattaaaactagctgtttactcttttttctctatcattctatcatctctatcaactttggttactttaaaattcaaaaaatcaattaaaaaaatttaagcatttgcatagagtttgaaggtatgaaaatctgtgctggtccttgagacaggcgagaattgtataacatgagtgaagctctaaaatgttgataacattttgggacaggggcattctttttttatttttaaacagagtctcactctgtgcccagtcgcccattctagagtacagtggtgccatcatagcctgctgcagccttgacatctctgggctcacgcgatccttccacctcagcctcccaagtaactggggctacaggtgtacaccactacacttggtgaattttttttttttttgtagagacggggtttcaccatgttgcccaggctggtctggactcttgggttcaagcaataggcctgccttggcctcccaaagtgctgggattataggcatgagccaccgtgtgtggccttggggaccattcttaatatgtttaagctcactatcatagtttccacagcaaaactagaaaataagacatctcactgtatatccacctgcttacatatttgtctttcctgaaggattcttaggctctcagtttatctctttttctcactcaccacccagcttctggcccagtgcttagcttatcttaggatatagaggtgtagatgtgaattttcattcacaaacttgaaatccacatgtgactctgacctgggataaatttatacagctatggaaattctgaaattatctgaacatcatcgataaatgataaaacaaatgtgtacatttgtgtatacacatacatgcacacacaaagcatgccggaatgataaaatcacctggaaaccatttcaaagaaatgccatacccaagaagaagaaaatgctactcaaatcttcagttcactaaattgcaactaaatgacactattttgagtagactttttttaagtacattttttaagtacatttctcctttgaatatcttgcaagtcctatccaaagttataagtgtacaaccactattttataagacatgctttctcctagagttctgtagagattttagcatagtccttatcagtgacggcacatttattctgcaaacagattatgtcttctatgaacacagaagaggatccaactgaaccttttcactttttaagtttttctccaaagctggattttgtcttcacactgtctggttttagcagtggctaggtcaaagtatactacagaagaacgaaaaatcgactctagaaaagcacgcagaatgacagccaaccagttagggagtaaatgtttctcgttgcagatgtttgggaagccatgatttttatttagaactgtggaaaccttatctttgaatttaaaaagccagtcctgagatgcatctgcctcaggggtaactaccatagtgaaaccgctcctctcccaggccatatcaaatcacagttgtagttatgaacatacaaatcacacacatatatatatatatatacatacatatatatttcaaaatcgccacctgttaatttttgatcccctattagaggtgttatccaccaactactaacacgaaggtcactggtcctcaacccacatttcaccaccagggcagtcgggcctagctgatgaccacacgaacaccagattaagagtaaaaccttctgaggcctgaaagtgagcgtgtattcacacatccttaataatacagtgtctgaaaaattgtacctgaaactgaaagatttattctaaggtatttcaagcactaagggtctgagttcagcattctcacaccatcctgaaagaggaacattaagtcagcaaaatgactgcgatctgggcccccagagggatcccagccaggccatccttgctggtgtcttaaagattcagtgacaaaatggtgttgcttggcaggacactgttttgcgttcggtgtagccaccctaatgacggctgcttaacaaggccaatgaatatcataagggacatttagcaaggagcaatccacaggagcatgggggtggggcaaggccgcggagcccccgcggagacctgctggagccaggctgcccacccccacctccccacccgcgcgttggcccagaggtttacccaggcagcggccctggtgccgagggggcaggtgcagcgctgtagtgatgcccagtggcctcgtcctcagccacctgccccccaacacctgctagatgcccaggcggggcaggcccgaggtgtcgccggccctgggcttcccaagccagcccaggggcatcccgcggcaggcgcccccgacacccacgcgcaggaatagggagggcgcatcgcggctcccgcgccccggccaggccggcaaggaccccaccgccccgctctcgggtggaggcgcccctccccacccctcccccgcgcggggcccccgcccgcagcccctctagcagcccctctcgcagccccagcgcccctgagccgtcctggcccggaccggccaaggaactaacgagcgcgcatcgcgggcctcgggcgcagggcacggagccggccgcgccgcagcctcccgggcaccggcggcggtgaccaacctgtaaccccagcgctcagagctgtcatggtgcccgcgggcggcggcggcggcgacagtgggcgaccggcaggatcagtgccaggcgcggcgcccagggcgggcggggacgcgggcccctcacctacggcggctcagctcaggcagcgcg

SEQ ID NO: 1397 - DNA, 22849 bp, Homo sapiens
ttacaaaaatcattttcatttatttaagcctttaaaataaaatattcatttaatatgatactcagaggcaataaaatacataatttaatcgacttttcaaattcatttaaaaatagagagctatcattttagaaagctcagctatttttcttcccactagcaaattagggaaaaagactcaagtcacaagttaccgcatcatgtaagaaagccaagtcctatcttgctcacctgtcttgctcaacagggaggaaaaacctgcttgctgcagctgctggcatccaggcccttgattttgggtgtgttgaaattacaagaggagttctcagggtccctttagtgtacctgtctattttctgattgatgggaaatgtgtaggaggtacttagccgctagactgtaaatcttcctttccaccattgggagcatattctctgacactctctaagaaggaagtctgtaccccctctcctccactatctcttaaaattatttagtccattttgtatttgtctaatgatggaaaaatatgaagtacttattcaactgtaaatggaaatcttgcataaaaagatcaatgttatgaatttgaaaagcagaatccctcacccctctactggaagagctaagttgagttcctgttcccataatgcttgggtgcaccagcagaatctgaactcagaacatgcaaatgcaaaaagccctttcagccaaaacacttgaaatagactctatgaggcagtgaaaatacccaatgcaaaatggaacaaaaccactaaggaccgagtggttaagattgtgtattctgattgctgcagaatgagggaaaggaaattaaattcgatcttataattgaaagtccaacacttgatgagttattttcccctggcagccgtaaacccctgctaccgtatatcagatagtcctggcttcccttggctacacctacttacagcattgaaacaactttcctggctggtggggcccttctgacttttgggccctgggacacgttctctgtttcaaatactgtttaatactcatttcctgatcactctcggacttgattcttcttatactacttactcctgcacatctaattgactctagttaagcatttcaaccaggtttctgttacttgtgttttctatgtattttatactatctcccattgaattaattcctccactagagtcttggtgtttctctcaatacttctgtctttgcacctcctgccacctccctgaccatggtgcttactgtgggtggtccctgtcaactgactagctgtcatattagctatgtggatccactgcacacaggaaaaccttgaggaagtccctctcccagatttgaagagctctttgccaaatacacaccgtttgaaagaattatgtttttccttggaagatctagtgggtatcactggacccctgaggtagagcaatagatgtacgatatccctgctgagttaagagcctgcatccaatatggttattgaattctattttgtaataatttcctctcatttctgcttttggactgccactggagaaggcaactttttaaaaatacagaagtcagatatttgcccatgttatattacaaagttatataaatatataggttgcaaagcttttaaaataatgattaaaatgtcagtgaaagatgttcatgtcaatttttataatcataaacactgaagaaaatcgtgaccactgtaataataataattcattacatctactttaacatacagaaagtcaggttgtcatctatgggctaggaaattctgcataagaattcagttttggtgttaaagatgttttcattctcggtgttccctatgtcaggtttagtctgagaatattttgggggaatatttcaatgacaatatatctatatgagtatacatacatatataaaacatatacatatatataggaaacaatatttgtcccattaaagaattgggccaccagtcacttggtactgaaaccaatacatgaattccaatgaaattccaattttcactttaactcttttctgccaactgtcctaccaaaacaaataattaaatatagttacggtttaagaacgtaatttggaactcgtctgttttgtccacttgatgtctacttttcgtcaggttgaaatcctccatttgccttataaaacgatgactctggctccgttccattttctttgctctctggaatttctgccttgttttttccatgacatttcttgtatgccacataaactagaaaacaatacacagacagttaagtaaattttataataataaactgcaaaattactttgcatagagattataacctatgattcacatggcagatcacattttctgtagactggaggctgcttagagaaagaaatcaccattcttagttctatggctactcatggcgagagggatgactgcacttcaggaagacctagcataaatctttaggagacatttgctcagggcagccacaagcttcttcaggcattcagccctgcacgtggtactcaacaatgataagaacaatagggaggatttattctgtaccgccatatcccagttaatgtgctagttcttaataaatatacacatggtgcagtgcaacctccaggacatgggtttgatggtcctctgtagaaggacttgaactagaacaacgttcccattccctccctgccttcattcaatctttcccccggagagaagagactcggctgatgggtgatcagcattcctcttttctgtggagctgctggtctctgatagcaagcatttctcagcttatttttaatgtcagctcatcagggtaggctctgccctgcgaggcaagacctgcagtgtctatgcatgtgtgagtacatgtctgcacatgtgtgaggcagtggaggaaagggtggtttcaacaagcccatttggttgcagattcaagtcatgttttccaattaagttttatccatagttaaagtgctattctgttatctgaatatctgatttttcttctacttctcaattggtcacaaaggcaagaggaggacagaaaatactccttataggacccctcgaattctaatacctcacatataaaatggccataataatattagctacctcatagggcaattgtgaacattaaatgagataaaattaaatgcctaacatggtctgtgaagaatagtaaatgctcaataaatgttaacgttcattatgatacacagctgagagagataatgacttgcttcaaagatcttattaactcaagatcaatatttcctttagattggtccctgaacttctagtcatatattattttcaaagccactgaaccacactattgaatttaattgagcttgtggtcaatttgaagatccgccacttattataaactgttttgagctgagagtccctcagcttaaacttatgccaatgatttcatttaaccaaactatacctcttgtttatccctttttctttccctcccttctctccctgccttcctccctccctccctccctctctccctcccccatccttccttttttccctttttctttcttcccctcctctcctttttccaaaaaaaaatttagaatcctagccttaccaccaaaatatgtttccaggtattgtatacacttaacaaagattcctcccttatttttatacatactgatgtaactgggaaatttcaagaccgagttgagtgctcccttttcctcattccttcaacttaattttttattaatcaacctctttggggttagtgttcaactagtgcattacttaattgttctatcaaccagtccactttctctggcttatctagtagacatcattaagtaattatttggaaaaatcccactgtgtgccaaattgggcagatcaaacaacgttattatacagaaaacaaggtaattaggcctggactcctgcttcctggagcagtgataaatccatggaatgttttcagtggattcagagtattctgttctggaaaggaagcctctgctttgagaatgacattcaagacagtagtgcagaggagatcagcatcacagggcaagttgaagagctgatgaagctaagcagaaaagtaaagcaaaaccatatttttagtagagatggggtttcaccgtgttagccaggatggtctcgatctcctgacctcatgatctgcccgcctcggaaccccgtctctactaaaaatacaaaaacaaaattagcctgtcatggtggcgggcacctgtagtcccagctacttgggaggctgaggtgggagaatggcgtgaacccaggaggcagagcttgcagtgagcagagatcacaccactgcaatcctgcctggacgacagagtgaggggctgtctcaaaaaaaaaagaaaaaaaaagaaaagaaaagaaaaaaagaaaagagagagagagagaaaagcaaaaccaaacaaaaccaaactatatctctggacattttgtgacctaacatttacattagttttgttgcgtgccttcactttatattcctcattacaatgtcatgaggctttaaaaactagcttttttattaaaaaaaatagaatgtaaaaatagaggttaaatattatcagcccttggaaaggaaaatgtagaaagaattttcaactaggtgaaggccagtgggcggtggggcctgatgggaaacgctgggagcttcatgccacaggacaggagaagtaagaattacttaaactacacctagtactttacataaggaacatttttgcttcaaccacttcaattatatgggtatttaaaatatatatatacatgcatatacacatatgcacacacacatcttccttgtaagttagcctggtaaattttctttgtataccagttttctgataaatatcctatatttataaagcatatcaagacaatgttttgaaaaagatcaccaaatcctgagttcctgggcgaatgccagaaggcgcacaataaaatggtcccaacaggttcctctgccttccttattactgaggaaaagaaagtcattggagagaatcggcctccattacttttcactcaaaaataatctttgctagaatcttttggtaaaactaccatcttttcatcagcaattggaaagtcatgataatatgacggtggctttttcctctcatatatttgtacaattcaccaccaggaacggggagttttaaaaaaatgttgttttagcaactccaggatttttcaaagattatcatgaaatgggattggcatgattccttacatcctaagaatattgcggcaaaggcgagctggaaaatgctgtagatgagcgggaaggtgaatacgacattgagctcctcaggagtgaaggagagctgaacgatggtggaacatagctgcgtgttctgcatccccgtttcaaaagcaaccgttcggcacctaaagaagatgttaagagagcacatgttttagtagttttgttattgtgaaacatgaaaagcagatataataataagtacatatatatgcattatgtctctgcttttaatgcatgtatttaagataggcttattcaatatataactttctatggaataagtgtaatacttattaatgtatattatacatcatctcacctattgtatataatataaataaatatatttaatatgtgcatatgaagagttggctcatttaccacagtgttaggtaagtggccaagagggttcatttcacccttttcaattatgattttggtaacagtgtagagcacagggcagcagctcagaaaatgctcaagatatggtatttgttgtcgctgttttattgtttaatttgttttgtttaggctgggctaaacaggtggctcacaccagtaatctcagcactttgggaggctgaagtgggaggatttcttgagcccaggtgtccaggagttcaagaccagactgggccacataatgagaccctgtttctaaaacaacaaaacaaaacaaaaaaattagccaggcaaggtggtgtgggcttgtagtcccagctcctcgggaggctaaggcaggaggatcacttgagccaaggcttcagtgagctatgattgtgccactggactccagcctgggcgacagaatgagaccctgtctcataaaaataaaaaattgttgtgtttaaatcttgacagaaagtctataaggtagaaattattgtccccattctacagatgataaaactcagagaaagagtgaatgctgggcctgaggtcccccgggcagtgtgtggtcggattggaaggcaagcccaggtctgcctgactcaaacactgcgctcttcttgctgcccatacccactcctctctttcccaacttcatacatgcatctgtccctacacctgtgttctctctgcctgtggattcgatggattagtcaaaaagaattgtttttgcccggtaccaaatccagaagtgtgaaacccattttaatattcggcgcctttggaggatgagctcaccctgctgccagctggaggaacgcttgtctattccaaggcagcccaactgctttcattaatgtcattccactcagagaataagaatacttagcaatggaagagccccatctgccttgtaagccgaatggtccagaagactttgagcaaaaaagaggcagtcagtattttctttctggggacttgcatgacttcagaatgaatgggcctatttagaatgacatattcagaaataggatgaatgtgattgatgaagggctaaggattttgatcctgtcttcagtgtttgcagctgttatggattgattatgtctccctttcccccaaattcatatgttgaagtcctaacactccgcacctcaggatgtgacattatgtgggaacagggtcattgcagatataattagttaagatgagttcattagaggaggcccttatccaatgactggtgtccttatcaaaaggggagccaggccacagagaggtgcactgaggaaagacacaggaagaagatggatgtctgcaagccacgaggaaggccagtaagggatccctccatcatagcccttagaaagaatcaattcagtgacaccttcattttcacttctagtctctgaaaccatgagacaataagtgtctgttgtttaagccactcagtttgtggttctgtcttatggcacctctagcaaaggaatacaacagatattacagattaaaattcccaatgtgatttactaaatgccatacctgtaccagggtagaccagcaattctagccagaagaaaccccagggagtaacccgccacaggaaatattgttcctataatccacagtttgggagcaatgatccaggcgctttggtacaatattcctccaaccacagctatgagcacaatgaggatggcgcccgcgatggacccaatctgaaaaaaaaaggaataagtgaacccagcaatcatgagtcaaagcaaatccaagtatgtttgtcagagacaaaacctcagcagtctccttgtccctgggggaagtgatgataaagttgtctttctatgtactccaagccaggaggctgcaatcagcccactggaaatactgacgcttgtcccatgctttaagctttaagaacacaataggacatgtagcaaccatttgcaattagtctgaagattttctgacttgaaaattatccttgtcagaacaaaaagacaacccatttcgatgacagcctggaagatttggcttccagattcaactactcctattctgtttccttcagtaaatcaggaactttctgaactgtagtttctttatttgtaattggggataaaatgtcgccccagcttccctttatgattgttacgataatgagaaaatgggtatagaactctatacaactttaaaaaaggtataagcaaatgaaaaccactgttgttattttttttctccttttcacatttaaaacaaaatttggagattataaacattttttgtcaagagaagcaaggaatacaatggacttactttgccccgagcagcagaatctatctatattatctacatacatatccagatcatctagctagaatatagttagtgaatgggattgccaggcaatgaaatggccatatgcatacagacataagaaagatatgttctattttctaagaaagccatttagatatattgtataacacaaactcacataacagagataacagtaatatgccctgaggacagaatagagtaaacccaagaggtgatagttcagtggagtgtcttaaagaatgggtagaaatttttcctgtgactgcaataaagaagggcatgctaggctgggcgcagtgtctcatacctgtaatcccagcactttggaaggatcacttgagcacaggagttcaagaacagcattagcaacatagtgagatcccacctctctctctacacacatataaagaaggacattctaaaggagaagactgcatggctaatgacttcaggcccccactcaacagtaatcatataatgagaatgaaaccatttcatggatggaaaaccctatggttttgattgtcacagtggaatatttaatggtgtgaactgggatacttactttaagtatgatctttgctttttggggccatttgtgattaacaaacattccaatggaaacaggaacaacgagagaaaccagagatgtacctaaagatgacagaagggcaatgtgatcagcagaacaggtgacacaggaaagagaaaaacagaagaacaagcagcctgaagaaagattaggtggtatttcagtcttccttcttgaatacacaaaacagaatacagaattacacacacacacatgcacacacacactcactcaacttcttcacccactccagtaaataatttaatattattggtagataattgataatatcaatgctgtaaattctttcactaaattctgcattaattttttagagtttcttattttgccagcatacattagttttaatttgtcagaatcttggcttctttagtctttggatctttatatctctaggaaaaatagctcaccaaggtgtgtgtgtgtgtgtgtgtgtgtgtgtgtgtgtgtgtgtgtgtgtatggcatacaaagatgacattttacatttgtctgctagttcatggtagtagaaataaaaaataattttaaaatattttaaaatgaaagaaaatgtccaaaattagctcaagatcaccaggtattctgacatctgacttttggttaaaactagctttagctattcaaatttacagcagagaggtgagaacaaaagttgagaaagcgtgctttaaattttccatgagataatatatttgacgaactctcatgtaattatagttctttgcagtaacatgctcacctggccagataaaagagtcatacttcaatttcaccatgttaaatttactgctgtttttgcgacatgtggtttgtttctccatgttatttaacactcatttgtccaatagctgatttcatataatttagcaccaacaacttctaacttttcataggttgtttctttttcaaacatccttttaaagcagtataagaaagtgatattgaacggtgaaattctgagagtggatgttgcttagtattgattaactaggtagattgaactaggactagaaaacagattctggaatccaaggctatagatattaatttaaagtgaatgcaataatgatgaaaacataatttccttgtagtcttctagccctcctggcaatataagggtcagtgatgacttttgcccagaaattacttagcagaattaaataatgactaagggtactaagagtaggaaaaaaaaagataaatgagggggagtaaggagggaataatggaaaaaaagatgtgaaagagtggcgttgacacacgtactgctgagatgccccagaaaaaccccccttgggtatccttgcatcctgctgttttgggagtgatatggtttggctctctgtccccacccatatctcatgttgaattataatccccagttggaggattacaactaaaggacgggtctgttggaggaggggcctggtgggaggtgattgaattgtggggggcagacttcccccttgttgttcttgtgatagtgagttctcatgtgatctggttgtctataagtgtgcacacctccttctttgctctcttcctctgctccagccatgtagaagctgcctgcttccccttccccttctgccatgattgtacgtttcctgaggcctcccctgccatgcttcctgtacagtctgtggaactgtgagccaactaaacttcttttctttataaattatccagtctcaggtaattctttatagcaatgagagaacagatgaatacaagaaggaaactccctctcctgggtctttagaccattgcctaagtttttgaagtttgtaggtcttaaaaccatctggatatatgacttgtttgtgatgtggtagcttaaatctagctgcaagtcctgtgcttggaatgttagtgtggttaggttttggtcctatattttaatgtgctgaatctgtttggcccctcctgctaagagtattcatctttttgaggcagcccaagccaacgggataacacataagcagcaccacctgctgaaatccatggcagaattgcttttctttcctgaccagatgaggccagatgaagtttttcagggacctggggttgactgggaaagggactctgtctttctttacacccacagtgtgtggcttctgcttgtagaggtggatgttgtaactttggtctccagtgggctggtgatcttgctcttttctttccccatgctctgtttgttttacgtatgcctcatatgcccatgttctctctgtaaagtgcctgtctatgtagatgaaaaagcatccactcatggttacacattgaatccataacttggtctttaatcaagtttacacagtagatatcagaggaaagaaaggtagaaagaagaatgagaatgaaagagagtggtggtgaatggattcatgtggtgggactgggagccagatagatttggaactgaacctttctgtattcccaaactgtgggaactgtgcaaatcattgaacccctctgagcttttgtttcctcatttgtaaaatgggtggagttatgtctgccttacagtgctgttgtgagaattaaatgatgaaatggctataaacttcttggcacaagacacttaaaaatgtggggtagagaggagtaagtacaacaatttgcagcagtggttttattttagtggtaccagctgcatggtctgcctcctctcgatccagatgtcagcatctgagggggctcacaggtgtttactgaatcactggagcatgaagttgtaccaaacacgtctgcccatagagctgtgtagagaatagactgtgggctattccagcttcctggtgaccttgggcaaataatcaccctgagccacaatttagaaagcagtgataacatcttgtgaagcagtcagttcatttattttctatgttaaagaactagaaaaaccaacagcaaaaaggtgagcttggaggcctgggcaaacatggtgagcagggttaatatctgtagaaagtaaaaagtttcctcttcaaagtgtcccttgttgttaaaggaaaataataataataataaacattagaaataataatttcttttaaagactaactttcttcaagcccccttactttgtgctagtaactctttgttaagccctattctatgtagctgttagatataaaggaataagtacattctatgtccttgtactttaaccaagatatttatgctgaacatgctcacaggtacattccagcttgcagcctatgccccttccttatttggaaatattattacttttctaagtcctttcacaagcaacgtcctcttttcctttgttgtctattgcctatacctatttagaaaagttttaaattattagccagtcaggttttagcttagattgtgatgtctggctccagccaatggagacaggacacagtagcagggacaagctgcataagggatacgaattacttccctccattgttcaggtgtgctgtcaccattgtgccatctgtgaggagcactctttctgcagaaagtaaaattgccttgctgagaaaactttttgtctgaatgctcatttttccttgtggtactgaggaacaagtattctgtttctgaataaatattttacatataacaatatctttgtttttcaaacttctctctttttccgttttcttttctcttttcctatttttcttttcttttcactcttgacctcttatgatgaccttttcctccattgaagtgctaattgatttttcattttctccttatttcaaaatttattcacatcacagaatatggtataagtcattcacactgcagttagaattattcagtatttccatgagtcatttctcagaagggaatgtatatcaaaaggagaatattttatggcttaaattattaaattattacagtgagtattgtggaatcaaaattcctcactcagcagacaggttctttgagagggatataatggtcaccactcacgtaaactatggtttttagctctatggaaggcgtccgctgacagagcagccagagagtcaagcagcatgaaggcaaaagcaggtggtagtggagggtcaccctaaagtctcttgtcaggaggttatatatgatattaaggttctctcctggagtctgaagaatcttgtatatcaaaagcccatactgaatagggcatgtcaaggaggacaattttttttttggtctaatggtaatggtaagagtaggagagagagaagaggctacaaacattgtaatacagatcatccccaattagtattcacaaagtttattctaattcagttgtatattccctcaatcaccctaaatcacagaagcagtctttctcagaaatggaaggcatttcagcccagcttcctatcccaataggagtcccttttacaagcatccaggtggcttatcatttagcctttgcttggatgctttcttcaatgggaaacccacacctttctgaggcagctcattgggatttttttccaaggtcagtggggaaaaaaacccaggtatttggggcatatagtgtacctggtgattgttactgatttactattttgcccacatcttgtcttttgttcgtgatagttctgtgggaaatgcctattcctggtataccaggaactctcttgttcttcctttgaccctcatccctaagttacaacaataacttaatctcccactataatttgtttccccagaaacagaaaataaggtttttgggatgagggtgaaatgagacagagtcattactagtaaatttgactcctggagcatgactttgccattaaatcaacttttgggtcaaggtgtggctcacagtcgagtgttagaaacagtgtgtttcgtctagcagttttctgttgtaacactctggattgcttactcagtgctctattttgaaaccattatgtgattttaaaaaatttcttcaggctgggcgtggtggctcatgcatgttatcccactttgggaggctgaggccggcagatcacttgaggtcaggagtttgagaccagcctgaccaacatggagaaaccccgtccctattaaaaatacaaaaattagccaggcgtggtagtgcatgcttgtaattccagctactagggaggctgaggcaggagaattgcttgaacccagggggtgaaatttgcagtgagccgagatcacgcccctgcactccaggctgggtggcagagtgagactccatctcaaaaaaaaaaaaaatttcttcaattcaagtgtctggatgcaaaatcctatgaccattaactagtgacactctgggttaaggaataggtgcaagctcccatgtccccaaagcttaagcctcctcagtccagactgagggctggggagggggctcctttccctggtgattcaaattgaagaaaagacaggttctcccataaggtcaaggtttggaatttacattctgccatcactctccaaacgcaggggtgactttataatgaaatcaggcaaaaactcctactagggcaataacggtcaggtgtgagcctggtctgagagcctagcagggggtaagcagagagtttgagggtaacagtcaacagtcttacagatggatgacttacctatgttatcatagggaattacgatgctcccagagtcgacccacattttggtatagataaggaggcacagcggcatcattccgagggcaagcagtgtggagcatgtggtcatgctgacgctgaaaggcaatgggcagattgatacatccacctgtggtgttctagggaagatgctgttttatttttattttttaatttaacttttattttaagtttaggggtatatgtgcatgtttgttatataggtcaacttgtgtcatgggggtttgttgtacagattatttcattgcctaggtattaagcctagtacccattagttatgtttcctgatcctctctttcctcccaccctccaccctctaataggccccagtgtctgtgttcccctctatgtgtccatgcgttctcatcatttagctcccacttataagtgagaacatgcagtatttggttttctgtccttgtgttactttgctaaggataatggcctccagctccatccatgttcctgcaaaagacttgatctagtccatttttatggctgcatagtattccatggtgtgtatgtaccacattttctttatccagtctatcattgatgggcaattaggttgattccatatgtatgccattgtaaatagtgctgcggtggacatatgtgtgcatgtgtctttataatagaacgatttgtattcttttgggtatatacccagtaatgggattgatgggttgagtgtatttctgtttttaggtctttgaggaattgccacactgctttccgcaatggatgaactaatttacactcccaccaacagaagataagtattcctttttctctgtaacctcgccagcatctgttaatttttgcctttttaataatagccattctgactgatgtgatatggcatttcattgtggttttgatttgcatttctctaatgatcagtgatgttgaactttttttcatatgattgttggctgcatgtgtgacttcttttgagaagcatccgttcatgtcatttgcccactttttaatgggtttgttcattgttttcttggaatctaattaaactaaagagcttctgcacagcaaaggaaactataagcagagtagacaaacaacctcccgaatgggagaaaatttttattttcgattcatgataagaaagtcctgcaagaatctgtctcaacctgtagcatcgtctggtgtgatgaacagtaatatacatgtgcctatgtgcctgagtgtattcagggcctggccttgagcaaaatgggccatatttggtgtctttccactttgccttgtgccgtccttccctccccttttattcttaagggtcagaaacagtattaaacgatgggttaaagtcatcattaaataatgtataaggttcgctgggtgtgccatccttcaaacattcaatcaaagaacagcaaacacatttaaagcagctgacaccaccaaggctgcatgtgtctgaccatgctgagatggaatgggcctccctgggcccctggaatagaatgcatgtccgagggaggaggcctcgctgtgttgccataaagcagaaaaattactgcccaagtgaccctagcttgggacaagaagcggaagctgacttaaaaatcaaaagaaagcatgcaagcggcagggtagacataaattcttagcactgagtaagttattggcaatttggcaaatgtgtgttcagaagaactagtgtctggtatcatccctgctcagagtgtttgcattttaataagagggtctggctgagtaggctatctacatggagacattaatgccaaatgatgctatctctagtactaggacagtgggtcaaagaaagatttttggggagtgagtcttccgggtcctcttcaaagggatctgtacacagcgtacattctctgcctttaaagcctgagctctaaagccacacactgtctgggctgaaagcaggcggtgccacttagtgtgttaatttgagtaatttagttgacttctctttaccagtttccttatctaaaatggctgtaaggatagaatgagccaatggtgtccggcacttagaccaatgcaaagcactctattaagagctggttgctactaccattttttttttttttttttttttaaatagggtctctctctgtcacccaggccagagtacagggtcaccaacttggctcactgaagcctgggctcaagtgatctttgcacctcagcctcccgagtagctgggaatacaggcatgagccaccatgccaggctaatttttaaattttttgtagagatggggtttcaccatgttgtccaggctggtctcaaactcctgggctcaggtgatccgctcgcctaggccttccaaagtgctgggattacaggcgggagccaccgcaccctgcatctctctgctgtgatcatttatgttaccatgtttttgtatcttgtgttccaccaaatagaatcgggaaacttagagaaatgagaaatttctctgaaaggcccttctctcaacaggtcgtcattgaggttgtcaagagtagtaatttcttaagggtattatgggtgtacttgaaagaaaatgttaaatatttatattacctgccccccaaaacaacaacaacaacaacacactatactaagaaaggagctaacaatgagaaattttgtttcaaggcacagttaaatttgcacagtttggcaaaatacagggtgggacaaagttcatcagagagcttaacttctctaataatatatttatttttaaccagaatgacctcatttaaaataggcttaaataatttagataaaaatacttgttttagtagagctaaaatattacaacagtaacaaataatgtggatgtatttaaaactttaagcagttcaatctattctggttataggtaaatttaggcatgaaatagatgctaaggcagaattgtacaccagacaaacaagttaatttgttattaatagtactttgtcctacttataatgaaagtactggagtttgaaggtaatttttttctctgttccttcctctcttctttcagtgttctctttttttttattttattttaaaaaatatattagaatggatttaaagttgtccctataataaaatcacttttttttctgtgcatccaatatttttttctagagtgtggtgggaatctggtggggaagtgaggaggatttattaactgggttccagtgaagagaagtctgagaatttttgttttaaaatgtgagaaaatgtttaagaaggaagtctttttctgtctttgtttttttttcaaagatccttgcaaaacctttaattctgaatattgctaagacaatctatgacgttgtatcataattttgagtttggtgagagcagtttcttaaggatcgtgatgagggacaaaagagggtttggagaaggaaaggtttagacttgtgagcagcactgacgaagagaccttgcagatgaacagacgaataggtagctggaagttgatgctatttgaatgaatataagaacaaaatcaaaccactcaaaatgagatttaaaacaattcacagataacgaattttaagaaataatatagaagcctaaattagcaaaagaaaatattatcttacacgaaaaaatctgaagttctataaaaggcatgtatataaaaaatacatacactgccttgaatttatattagactgacagaaaagagtcaagtataagaaaaataaaaaaaaaatcttggtcttaattttgacttcagctctattaactgccagggagattttcttttgtgtgtatggaaataaaagaaagaataaatgtaaatttagtgaatgttgaggaattcagtgaaatcagtgttaagcaatgtaaaagattgtaatcatattagaagtaaaataccaagtttgaaggctctaacgtagcgtatataggcagtgctagaaactggagaagtgaaaagtgatagaagcagtgtagagaaagcttatgagcctgcaaagtggtagtgggtagacctgggtgattccaattctgactcaggcatacattgactcaatgaccttggtcaaggttatgaatcttaacttcattatctgccaaatgcagaaaataatagtactaactttagaggattcttgggaggatgaaatataccaacttattttgagtacttagcactgtgcatggcatatactagtgtttaataaatattagctagtaaaatcagtgctactggagagaaacaatgtttggttacttttagggagaataaaggaaaaagccgaatggttttgggttaggtctcccagagtagagaagagaaggacatttatggggttgacataggaaggattgattgctgtgaatttgtggtaagctacagggtgagatttcttgaatatctaaaatatcaatgaatgctgcactggaagctgaaaaatctaacagcatttgcccaaagaacaaaggatgtggtaggaaagtctgtaaaataataaaaaggaatgtagaaagtaggtggcagggaaggaactgggggcaactgggagaaggatgcataagaatggattccccaaagaggaagccaaagaaaggaaatgagaagtccttgcatggtgtcgctgaggccattaagaaggatgaagacaccggatatttgcctgtgtctggggagagagcagacaaaaaggagataggatgtttctgtgtcctctcaactatgggttttggccacaagcagattcacctgaaaagtcaccatctcttctccctgatgctttttgtgcatgtgatgtccatggcacagctgcaacttaggtgaaaatatatgtgcaccaatcagattcacaaactccaggctgggagtggtcagagaaggagctgaaatagtacttgctggattccaatgatcaaggactattgtctattttttttttgtttttcaaagtcactagagattgcaaaatgcggtggctttccaggttcataagagatgacagagtgagagagaaatgttttggtttcttctcccaagaaccataaccaagagagttaaaaccaggtggaatggttttgctggcattgtgtggcattagctcaattagtgtagctgcctgttaacataaacagtcatgtcttcatgccattgctggagttcaagtggagatggagaaggtaaaattctaagtgtacacaactggaaatataaatgttagataggattgtatctaagtaaattatcaggagactttagttatccagttcttaatccagaagaataaaaagttttggaaaactgttacgcaatagctcaggttttacccttttaattaatttgtattaaagaaatattggaatattgttttcctaacacacaatgcataatgtcatcatcttacatagcagtataatttaacctcttctcaatgattaagaccgatcatgataaacatgattatcggttgttctaaaataccgtgacatcttcttgtgtttgtagaagagtaagtgatacagagaccagagactggaataagtgctacagaaaccagagagaataattgataattaagagagaatatgtgatagagagaataagtgatagaggataaatgatagagagatggctgtgtgttgtcagtgtctgctttgctttgcaggcatttgatcttctcttttgcccttcctaacactctgcttccttccccgcttcttatttctgggaaatagcacaacagaactttaaaataaaaatagttaagtcggtcccgcatgaggagcatttatgagattaagtgaaatttattttgggtgtgcagtgtcttttattgggtcttgttgagctctggataggtgaggttgctccatgttgcgttacagggcttattttgacttgctggaaggattcatttgcacggatttagctggaggtttctaccaaagcttcatattctacttttagttcttattaaaaaaaataatttataggaattgttatgctaggtggacaggattacataatcatctcctgtttcaagagaaataagatttccttaaaaccacagaaaaatgtaacttggagcttttaggttagatcttactgtttttagctcacagaagagaattcatttcaacaacctaatagtccagtaccacacacgttttttttctgtcttataaaagggttccatatgtggtattacattgaggtacaaaactcctctgcactaaaagttacaaatattatgagaaagctgtttattgggggtcaaggcccaatgttccaagtagttcacttttctcagtgtaacaggtgctggcatttagaattctcacttctgtgtacctgtgtccaggtcaaactaaattgaggtctaaaaagaccttattgctatatcgtggttcacagattaactaaacctgaatagcacttgccatcctatgttgttttatagggctttccttaaaaaaaaaaaagcaattgcaaggtggatatcatgtgttttcttatgtgaaagactaaaccatatgaaggtatagggtttgtatgacttttctaaagcttctggagaaaccagcaccagttgaaatgagacagcaggttcctaattgatcactgggtactctatcaatccagtgtttacaattctacactttgtgcttctctcctctgccaatagtagctggggatgaacagagctaattgcctactgtacagtatttaataagcacacgttgcattagcacctggatggtttgcagaaggaaatgcatacctttcaagggaaatgaggaattgtgagctaaggaaaaagacatttgtctattcaacttttagcattaaatttctcaatctagtcacattaatgcttcatcttatttctattagtttttttttccagtgctagttcagactggcacgggatgaaatgggcaaacattgcaatttagattactctgtaggaagtggagaaaacgttttctgtttattttgtagtaaggtaagcataattttaaaaaagctgctataggctttttcccccacttttaatgccagtagaggtgaagcaaatttacaaattcttccttaggttttataccaggaaaatgtttgcccaaagaactggctatatttgatggagttgaccactgtctcactacaggttctaatgtttgacaaacagttttattttatgattgcacccagagctcctcatcattacaaagaaagtgtattttgctttttttttcctgctaccaacaggataaacctcctcagctgcagcttgtggtttggaaaagattacttttttaaaaaagctttgaatcttttcctagagatcaacagcaattatgcaactccctgttaactgagttagatttaaaaacacaaacacaaaatataaatcccccaattccaatagctaagcagctgtgctagaaggcacgggaatgcatttattctctcctgtttgattccttagtcatactttagatgcgtggcaaatcagttggacattcagaatgccataggcttctggaaggattactccaaggtgattgcagtagttagaggtatagataatcttacctcaggtccatgtcgccatcgacccaataggccaagatattggaggcagttcctccagggcagcatcctataatgagcaccactacggcctggagcgggaggatgtcaaaggccaccgacaggatgaatcctgtgaggggcatgattccaaactgacagaggaagccaacacaaatgccccacggccgctttatgtgccctagaaatttcttgatttccacgttgcatcccatggagaacatcaccaaggccaacaggatggtcagcaccgtacttaggaccacacttaggatgttattgaaattgctctcaggtaccacacaggatgcaccagagcaaactgttgcattgtccacacagctgttcggatcattcattgctgggtctgctgctggaaaggccaagtccacagaagcgctggtccctgggccctggctctgctgctggttgagttaagcaacgtttacttctaccccatcaaacttttaaacccctcctaaaaatatgtcacttggtgtctcttttgaaagccaccttagggaagtaataaaaaacaataaagctaggatgtcagtttcaagaggtagcattacaacacagagcacgttgtgaatcacaaaagtccagcaaaattattggtcaagacagagagttacgattaatcatttattggcatgataatgaaccatgccatataaaaagagccacgttaatgtttaatgtcctcgagggtttgttggataatttcagttaagtgacttttaaaatcaactctgaatagtacagaatcttatagggattgagccataggaaccatgccatataaaaagagctgtgttaatgtttcatgccatgaaggtttgttggataatttcagttaagtgacacttaaaatcaactctgaatagtacagaatcttatagggactgagccataggaacacatattgttctcccatttccctttcaatagaa

SEQ ID NO: 1398 - DNA, 77 bp, Homo sapiens
ctgccctcagacaaaccttttgttcgtcttatattcggatcagaaacataattcgagcaaaaagcttccctgagagg

SEQ ID NO: 1399 - DNA, 26288 bp, Homo sapiens
ggcactcatatttattacaggttggcaagagtgaggttcccgaggcagtgtcactcctcatcgtgcattttttgctgcaaaaagaataagaggtgtgagggggcagctggcaagagggagaagtgtgtggggacaaatccctggggctttcagaggcctaagggagatgcccttggagggagaggcagggccccagggatcctgtggtcccacgttagaggcacttgtggtttagggggatggaactggggatctctgcagaagttccagtcagtggggggctgttttgagcaggagagtggattctcaggttatgtaagctatgggaccctcagaactgcctacatatagggcaagcagtgcccactctgaagggcacccatatcagggggcatgctaatgtggaagtgactagtgaagcccaggggagggacccaccttggcaccaatgtcacggctcttggctcgaagcttgttgacctgggactcagcgatgtccgcccgctcctctgcctcatccagctcatgctgcaccttgcggaacttggacaggttggtgttggcttgctcctcctgtggtgggacagtggggatgggtgaatgagctggagatgggctatgggattctcagcctctcaacctgaggttccagctccctgtccctgaggcacccatacctcatgcatattcctgcaacagccttcccaagggtatcctgcaactgccttgcactcttctcaaacatgtccagcactcagagtccttcacggccatccactgccccagacaaatcccatgctgcccgatctgggccccttcagaatcctgttttgctgcacctgtcccggaccccagcttcctgtgcaggcatgctaatcagcaactcacatccacccagatgtcttccccactgccctgtggctagctgggtccccttctaggcccaattccaccgccaccttcctgccttcagcttcggctgccccacgtcctgcactagcatctacactgccttctgttgggttatggtatctgaattgtaagcagcttgtaggtggtgcctttgttaattcagaacacctgacagctctgagcataccagatgtgtcaaacaaatgtttgagagttaaagtttatagcaaactctttgtccaggcccctctgtaggagatattcattggttctcacaaatagtaggtgtgttgatgagaaagggaagaaagctctgaactcaccgcctcctcggcctggcgcttgtaggccttgaccttcagttgcagcttgtccaccaggtcctgtagccgcagcaggttctttttgtcttcctctgtctgggggtgggagggtgggagaagctggtttggagggggagcaaatgcaatcacctttccctcctccatcattttactcttctccccttgcctttgctgcccctccctgcaatgatccaggtcaaagaggtggtggggaagattctctgactctatcgtaggtcaaaggggcaatgcaaggttgtcagtcagggatccacagagcaatgaaggctgaagtcataaagctagaagtagggggaggggctcagaacctaatggaattccctaatgtggtaatataaaagcaccaggtctgttccagctccagtatggtggataaagctccaacctggacttacataggttctcttggccagtagttcttgaccagaaaaagaatgcagaaagaagggggtattatcataatccagattattctacattctaatatattgtactgggccagaattcaggcatcgggatcactggctccaacgtcactcgatcattcctatctctttatcattgtatgtgccaggatgccatttctacttctgtccacaaatcactctgtggttctgtatctgtaacctctttcttgtgcctctggtatccatctatcaaatggactgacaccctcgtctccttggccttttcttcccaggtacactgaaaataacgggccaagggcacagctctcagctatgcaagtggaggttttagagcattctagggtcctctttctctgtggccttctctttgtgtgccagaagttctatggaagatttccgggtcttttcccctcccctgactcttatccccacagtcgaaggtggaaggattctttgaactgttctgaagtcttcatggtagcacttagagttattaaaaaaaaaaaaaaagaaagaaagaaacctggggaaagactagttagaagagttttcaggaagtagaagtagattcttcatttgctggaaaaactcatagactcaagtcaaactgactgcagagcgtgagaagaacgttaaatctaccaacagcatctcaaggaggaggtgagaggagccctgtgagggcggggcagtggggccagagaagaaacttccacatctactcctggtgtctggcgtccgccgcacctggtaggtgagctccttgatgcgccgctcgctcttcctcatgcccttcaccgactctgcgttgcgcttctgctcggcctccagctcaccctccagctcccgcacccgcgcttccagcttctgcagctgcttcttgcctcccttgagggcgatctgctcggcctcgtccagccggtgctgcaggtccttaatggtctgctccatgttcttcttcatgcgctccaggtgggcgctggtgtcctgctccttcttcagctcctctgccatcatggcggcctgtgtgcaggagagaggtggcaaggaacatgggccaggggccggggccttttgccccccaaggatctcctttctcccatcaggccctcaaatccacagaactgcagagttggcttggtgttacagcacagtggcctggcctggacccaaggccttgtttctgtctttaggggaggcggaaggtgggcggtcacttacatccgtgatggccttcttggccttctcctcggcgtttctgcactcctgcactgcctcctccacttccgactggagctgggtcagatccgactccatcttcttcttctggttgatgaggctggtgttctagacatggagagagaaaaatgatcaaatatatactacactttgttacctgatttcataccctttctccagaaagaattaaaggtggtcattttttttttaaaacaacaagcccacttttagactattgatcgttttgtacctgctttcccttttcctatgaaagtgcatacattctagacattgtatctaagattactaaactctgaaaaaagacttcaaatagcaaaaggtctgcagtattaccctggagctctttagcaacatgtttacgtaggagcatgacaatattccaaggaagatggaaacaactttttaccaggacaatattccagagatgtttatagctataccaagaatgtagtggggtaaggaagaggggatgaggtaagtggatgatgtcattctcacacatactagattaaagaacaaaactccacagggcactgcaaaaggtgagcacaaagtctcattgcagagtataactgaaaacagtgtgggtgggattgcagaaaatggtgttctagccagcttggtttgcaagagatgcagttatgcttctttaaactcccaaactctcatctttacagagcaagccggaggctgtctttcagatcaagaatatcaaataacaggatacattccactactcccagatttgtggctttggcaggtatcagcaatcaatcatgaccctcttagcttctaagtagagaccgctttcttaatataatggttctgcagccaccacagatgagagttggcctaagagaggaaatgatttgtgaccctggctagatgtgctcacttagaacatctggcttttctagatgtcctgggctctgcactcagtaggtttccacaaggtggctcctgaccccctcacctgggaatgcagcagctgcacccgctcgctggtctcaatcagctcctgctccgccagcttccgggaccgctctgtctgctccaccacggcacgcagctcctccagctcagcctgcagcaggttgttgcgccgctccacgatggcgatgttctccttcaggtcgtcgttggcacggaccgcatcgtccagctggatctgggtgtcctgagcatcaggagagtgggtgtgagcagaagccagcctcggtgcccttcactgagggcacctgtcagaggtccctgcagtaacccaggggcaggaggaatctggtgcctgtatccagacaccactgcttctccaggccacatggaggccagtcccctgaggggacctcccgcccccatgtaccttcagcaagctctggaggctcttgacttgcttctgggcctcggcagccatgcggttggcgtggctgagctggatctccatctcattgaggtctccttccatcttcttcttcaccctcaggacctcgttgcggctgcgtgtctctgcatccagggaggtctgcagcgagtccaccacccgctggtggttgcgcttggcctgttccatctcctcgtccttctctgccagcttccgctcgatctctgccttgatctggttgaactctagctgggcccggaggatcttgccctcctcgtgctccagggaggcctgggaaggggtggggcgagggcgggcagacagggcacagggcagggttgagagggaggatgagaagatacacggtgtcagccaggactatcgcccagagaagaagagctgagaagagatggggaggtgggatctgcaccccatgcccaccacggtgctattggggagaaagtgctggactctctgggcttcccctgtcaagaaaagggtttggacctcacaattgccagaccctccagcactaacactgcataaattcctgacctgtctaaagtattatagaaaatggaggaatttttataaccacaaatacaaaattttatcttgttttccaggtccctcaccctttcctgagaaaagttagaagcccagaaaactcagggctattcccaggtgcttagaaatgaagagtaacaatagctaatatatattaagtgcttaaatgtgttacctcatttaatctttataataatcatgtgtaaaatcatatgaggtatgtacagttaattccattttacagatgagaaaactgaggcagagagagattaaagattttgcccaacgctgcagtgaaagtcctcaagctgtgttccaactcaggcctgtttgactctggaaccccacactcctacccactgtctaagtggttattattatggccagattccaacttttaaaacctggtgggaaacaaaacctttggcctctaatcagactgacattttcctttgtgcagaccttggctttggaggcagtcatgggtagtgaatagtgggtagataatgttgaacaaagaatatggaatgaatagattttgtcctggggtcagggtcacccccaggtgagggagaagtgggagacagcggcagaacagggatggggtgcagggagttctcggccctcacctctgcctcctccagggctgactgcagctccagcttctccacctccagctgtttgcggaccttctccagctcatgcacattctttcctccttctcctagctgctcagtaaggtccgagatttcctctggggaccagagggccagaaagctcaaagcctatgttccccctgcccctgcatggccctccctcccaccaactcatctctggcctcttggacccccagcacaccctgaaggttcttgttctcccgcttgaaggtctctaggtgctccagggactcctcgtaggcgttcttgagcttgaagagctctgtgctgagggagcgagcctccttctgtgaggactccagctcagactgcgactcctcatacttctgcttccactcggccaggatctgcccggggacaaggctcactcttcagccccccagccttagctccccagccctcctgcttcccagtgccccagcccccagcctcagccgcatgtccaagatctgtccctggtcccgagcctgggcttagccctcctcctccacctccaaggaggttgcctttggcctctcactgaacccctcatgcccccttgccctgcatgctggctgcggcccccgcccatggtccaccttgtcaaagtttctctgcttcttgtccagggctgcagcagcagcattggagcgctctacgtccaccatcaagtcctctatctcattctgtagccggtgcttggtcttctccagtgaggagcacttggcattaacagcctccacggcctcctcggcatcctgcagccgctgggccagcttctttctgcccaggtgagggtggagggtgtgtgtgtgactctactgggcaacactggagccttgggtggacctccttccaccccctccctatatctccttgagacaccgtaagtccagcctagcaggagctgagcctgctcatgcctggaacagagtccgccagcacgggctgcccaggcgtcctccctacctgcagtggcatctgggtgtcagtgccccctgccctcaccccccacacaggctgatcgacggtagctcctctgaccaacaagctttttgctcgtcttatacgtgagcatcaggtataacccgggccaaaagctcgcccgtcacaggaagtgggtcagggccagccagagttcacagagcaaagagttcaggctttcttccaagcacttctgttgccctccgagttcctcctgtctcttccacttccgtctcatgaccactttgcctgtccccaccccaggtcctctcgccccttcctctctgagagtcaggttaagggggtatctggagctcacttggcctcttcgagctcctcagtccgctgaatggcgtccgtctcatacttggtcctccactgggccacctccgagttggccttggacaggacgcgctgcagctcggccttggcctctgtctcctcctcgtactgctcccgcagcaggtcgcagtcatgccgggccgactgcagtgcatgggccagggcgttcttcgcctggggaggggggggggcaccaggaggtgggagggactccctgtgccccattctctagattctcttcttatgtagtacttcaaccaagcccagccttattcaccatgtgggctgatgtggcacctcactgtttgaggagtttcccagtctgctcaccccatccccttacgaataagaaaagaggcattaaatgacgcttagctgcagggcagaacctagactggagggtctttcccttgcagaggactctttccagctccaggctccatttctggcactgagatgaattgccccagggctgccatcaagcctgcccaccctccccactgggcctcaccttgccctcctcctccagctgccttttgaggtcctccatttgctgggtataagagagcttcccccgggtcagctgcgagattagcgcctccttttcctctagctgccgggccaactctcctggaggtgaaatgaggggcttgtgggccatttcacaagtcatgtcctgccctaggcagggggttggttaggggcacccaccattctcggtctgcagcttggctcgctgggtggtgaaatcattgagggagcgttgggcctcttctagcttcacgcggtactcattggcctggtcctccagcgtccgagacactttctccaggtttgccttcaggaagcaagacaggaagggtgagtgtgggaggggctgagtcgaccagaggaaggaagagagggtcagagatggggaatgccagagggcaggagggggacacagaaggtgtgggagggcgcagtctgaagagagacttgaattaaagaaaggaggaacatgaagagatagagagggtgaggagagccagagaggggcaggggagacaggaagagagaccaaagggtgatgaagagaatgagaatgacaagggagatggcagacagagagagaaggcatgggggaggctccgctgtgcaggggagagggcgaggggaggccgagcagagcctgccttggccttgatgatctgctccatgttggaggtgacgtcatccagctccagcttgaactcgctcttctccttctccagcttctgcttcacccgctgcaggttgtcgatctgctcgcccagctcggccacgctgtcggcgtgcttcttgcgcagggccgcggcagtggcctcgtgctgcagcgtggcctcctccaggtcccgccgcatcttctggaactcggcctcgcgcttcttgttcatctcgatctgcacggacgtggccccgccggcctcttccagccgctcgctgatctcctccagctcccgagacaggtctgagcgcagcttctccaccttagccctggcggtgcgctcggcctccagctcctcctccagctcctcgatgcgtgcctgggtcagacacaaagggctcagacccaccgcctggacccctccactggaatccccccggctctgaaaagctaccaggaacttaggttcctctcaagcagtggttctcaactaggggcaattttgtgccccagggaacagttggcaatgtctgattgtcatgtcttggtggggcttgctactggcatctagagggtaggggccagggatgctactaaacatcctataatgcataggccatcaataggaatttggctgaagctcccaagggcatctcagacccagtgtgagcatctgcagccccaaatcctgagaacctgtggttgaagggggatcctggtatcctgtgagatcaagaagttcagagtccccagattcactaggctctgttgcgctattcataagacgggaaaatgagtgcttgtattttacaaatatttgtgacaacatgcctcgaaacaatcagatacctttgcaattctccaagttaaccacaaagtccaatcaaccatattccttgctctcccaggcttgctgtgtttatgcccagggctgggtttcaacatgattgctcccttccaggccaggaaagtgctagcaggctactctcctcttcacctcatctccttatcctctttaagtgcccttacctcattttttgggccttagccttggtcttgactaaattgggagaatatcgtatctaccattttgatctgttgtctggctagccaggagcaaaacgggggttcagtggaaatcccttcacctcgggttatggacagctttaatggactgttcatggatgggtcctacaagcagcagagaggaccaccatgcctctgctcccaggatggagaaggtgggacttctgagcaagatcttggggatgaaggaggagccatagcctattgccgagagctgatgagactaacaggactgttattctgtgtccaagaggccaaacaagttgcccagacctagggtagaagaacctgaggatggcccgatattctagctaaaacccagaaggggcatccaagaagatgggagggcaaattactaatgaaggcgggccagtccctgtgcagccccagaggagtggaattgtgttcatacattacttgcagcctgggccatgggcctcaagtgcagaggggagactacctctttctaccagccacagtctgccccaaagtgagaggacaaggtcccgccccagtagccgagttcctgttgcccttggggtcactatgtccagacctggccatgtagcttctgtagctctataatggggatggcagtggacttccaggtctcttctgacaaacccgatactaaaagcacattagggtttgaggttcattaaagctaagggagactatggctgttcactaaatcttgagctgcagaggaatgagaaggccattgagaagacaaaacaataccttcttaggctagtggctggctgacttctctaaattgggctatattaatatgatacttgtatagaatttcctagttgacaaaatggtttcaaatacattatcccctctggtcctgtgtggtaggtattgtcagtctcattttacaggtgagaagagaatctgaggatcagggagggtaagtgacttgctcacagttgttggaattggctcttatcatgagtgccctatggggactcagcctgggttagtggctggggttagtaccgggaagaatatgaacagagcagctcacaggaaggtgctccttgaagccttttttttttttcaccctgcgttcagagggctgaactaccagaggaagggttagaggagaatagagctctatcatttgtcttagagtagaaagtccctgaggcagagcagatctcagaaggagaagccctttagtaggtatgagtcccccttctcaaacagttttgctaacgtaatgtattcttgctctatgggggaaggctagtgttcctgagcgcctgtaagtcagggatggttgggtctatgaggctgcctggagttccagatattgtgtagaaccctaagcagctgctgcagcctcagttacctcagggctattgagctcccactttcatgcactgggaaaaaaagtcacctggttttccttcagtttcttctgtagttgaagggccagcacctgctcatcctcaatcttactgttctgctgattaatgtcaaactccttcctgcaggagaagggtgggggtgggggagtgacaggtagccttccttcctctggggctcattctcttcttggccttagtatgccagaatcggcacctccccctcccctcgccagcccagaaagtggcggaagagggctgtgattgaccttattcccagcatacccaaggcaactgtggccagtggaggcgcagcaccctgcactctatctaccaggccagacacctccattagcccctcctggccaccacagtctcctacttcttaagcttttcttccagctgcagtttatcattttccaggtccatgatgctctcctgggtcagcttcaggtcgccctccagtttccgctttgctcgctccaggtccatgcgcaccttcttctcttgctctagggatccctccagctgttggagggaagaaaataagcaaagtgtggaaaacatgaaatccatagtgtatgctcttttgcctccttctaaacttgaagtccagtgggattggaagtcaaaccaacagagaaatcctgcaagcacaaaggattcagagacctactgtagtgaggaactacagagagcaaaaaagcttcaggggccatagaagttaattctagggatcaggactttctgggccattggtgttgcctgcaaaatcttgctctgagagcaggagcatggttcttactactcacatcatccacctgctgctccagcttgaccttagacttggacaggctgttgaccttgtcttcctcaacctgaaggtcatccagggcctgctgatgggcctcttgtagagctttcttctccttggtcagcttagcgatgatttcatccagcccagccatctcctctgttaggttcttcacctgccgaccaaaaacccatcccctttagggtcaaagatcaccagcctggagacatctatggggacctccatgccaaggaccaggacaacactctagtctgggagtcttgaggagacctgggctgaagccagagggagctgccctcaccttgttctctgttgcatgcttctccttctccaccttggccagtgtcagctccaggtcatcaatgtccttcttgagctctgagcactcgtcttccagcttgcgcttcttggcagtgagctccgcgttcatctcctcctcatcctccagcctctcattcatctcctttactttggcctccagctgaatcttgtttttgatcagctggtcgcagcgctcctcagcatcattgaggttgtcttgttcctgggagaagagaacagggaggaagctgatggttaaagagaggagacctagggtcttaaaaagagctggcactcctagactcccagtccctggttgtgagatgggctataatctaggggaggggaggagagggctgaagagataatcacgtggcctcaccgcctgcacttggagctgcaggtcattcttctcctgcagcagggacaccatcttctcctccagctccttgcggcgagcctcggacttctccagcgtctctttgatgcgcccgaactcttccttcatggtggccatctccttctccgtctctgcgctcttcagcagcggcttgatcttgaagtagagcttcatccagggccaattcttgacccccatgaaggcccgaatgttccactggattaccagcagggcatccctggcaaggaaacgtggaggcagggtggggcactataaaagagagcttcccaatcatgggccctactaagcaagttcgtaggcacgtagacttccttcttgtgcacacccacctccaacatcactacactgaacatggagttgcttgataaatatttattaatcaatttgatgaaagggcagtttatatcctcccagctgggatattagtggtaatggaaactaccacttatagaatgtctactctgtttggtttttctattctcataagaacttcaaatatgttaaaaattatgtaggggtttacatataagaatgtctataataagtatgtaagttatgcagcatgaaagcaaaatgactatccatgaacctaccactgaaacaggagctgaaatgttaccagccattgatctacctgtgcgttccttcctacacccctgtcaccccgccaggagcagccgccactctgaatcttatttttcctttccttgctttttcaaaaattactttaaccacatatgaatgtatctttatttttattttactttatttattttgagatggagtttcactcttgttgcccaggctggagtgcaatggcacaatctcggctcactgcaacctctgccacccggattcaagcgattctcctgcctcagctcctgagtagctggaattacaggtgcctgccaccatgcccagctaatttttgtagttttagtagagacggggtttcaccatgttggccaggctggtctccatctcctgacctcaggtgatccgcctgccttagcctcccaaagtgctggggttacaggcataagccactgtgcccagccatatgtatgtatctttaaacaatgaatggctggttttgattatttatgagctttataaaaattgcatcatactgtatgtatccttccaagatttgcctttgtttactaacaatatgctttaatgttcaaacatattgtatcatgtagttggagttcacatcttttcactgttttataatattccactgaatgactgtaatactatttacccattcccctgtggatggaaattcaagttgttttaagatctttgctattatgaccaatgctgctaaaagattatttttcatgtcatggtgtacatgtataagagtttctctgtaggaatgtactcaggagtggaatggagaagtatgcagctgttcaacttttttttttttgagatggagtctcgctctgtcgcccaggctagagtgcagtggctcgatcttggctcactgcaagctctgcctcccgggctcatgccattctcctgcctcagcctccagagtagctgggactacaggcatctgccaccacacccggctaattttttgtatttttttagtagagatggggtttcaccatgttagccaggatggttttgatctcctgacctcgtgatccacccgcctcggcctcccaaagtgctgggatttcaggcatgagccaccgcgcctggcctgcagctgttcaactttaaaagatagtgataaactgttttcctaggaagttgcactaatttacacatctgtaagcagtgggtcaggcttcttaatttttgtcagtctagtgatttttaaaacttttaaaaattatttttcctttcattttatttttatctacttgtttctttcattttttaaaatttgtagaccatctgagcaagcaaagtctagtgttttaaaatggtatttcattggtgtcttaatttgcattttcctatagagaagtttctttaaaaaaaaaaaaagaagaagaagaagaagaagaagaatttgcaatgagattcgaagtggtaaagtaacttgcccaggccagctggtaggtctgaacccaggtcttctgacccacactagttgacattgcggatctgcctctacatctctagtgcatgcctcccttttcctcctgtctcacctgcgttccactatcttcttgaactcaatgcgcatgagctggccccgggcttgggcctgcatgcgcgtgatgatgcggctcagcctctcatcccgcatctcctccagcagcccaagcagccctgccttgaagaacacctgcaggcaaggggtagatgcaacaggccgcagcctcagaggggagtatccagggtggaagaccctggatgagctcccaggtgacccatcaccccatgccttctagaagtaagagtaaaaatttgacaaacaagaccggaatgaagcctgggtttcagcccttgataaggttgataaggaagccagaattaggcttctgcctcctaaactcctctctgctccactcaacatggccacctgccctgcaaccacccagtggggctctagactcaccttggtgtggccaaacttgtactggttgtgatcaatgtccagagagctgagcagcttctctgtccccttcctgctatcaatgaactgtccctcagggatggccactgggttcaggatgcgatacctgaggagggaagtgtccagagtcacccatgctctgcagtgatctgctctgcccacagaattccagggtcacctgcagatcccattcccatcagggcagcctggctccccctgttctatgagctctggggcaccctcatacccacctctgccggaagtccccgtagaggatgcggttggggaagcccttcctgcagatgcggatgccctccagcacgccattgcagcgcagctggtgcatgaccagggggttgtccatcacccctgtgtcaggagggaaggggaaagggtcagccttagggtaaagtggatgccagctgtcctccccagactaaggtcttctcctggctcacctggagccttccgctcattggggatgatgcaacgcacaaagtgaggatgggtggtcctcaggttggtcattagcttgttgagattttcctggaggcagatgaaggtggggagttaggagccacaaggaccatcccttaggcccttaaaccctggtccccagacactctccaccagaatcatcaaagggacaggggctgccacataatttgtgacgtgagttcaggcttttgtggaatctacacactaaaaaacgactacgtagccctagcttctttcctcatcaaactcaagcatcagaataggtggtgcagccagaagtctctgggctgggccattccaccaggtgtcctggcacccctgggcccttcttacccggtggagagccgacaccgtctggaaggatgagccctttttcttgcctcctttgcttttaccactgtcccctaaacagcgagaggagaaataatcaacaggagctggaaaataaaggagcccttgggcagaggcagagctctgctgctcgcttggtagctctgagactttgggcaaggaattctccaagattcagtttaccatgaggatgacagtaacaacttcccaaagttgtaaagaggattagataagaccacgcctgtagggcagctcactggtgcttgcccatagtaggcactgacatacatcagtgcccttagctctccctctacttgcccttccttcttatatctttccacattctagttctcctcctcctcctcctcctcctcttcttcttcttcttcttcttcttcttcttcttcttcttcttcttcttcttcttcttcttcttcttcttcttcttcttcttcttcttcttccttctatttttgagatggaatctcactctgtcacccatgctggagtgcagtggtgcaatcttggctcactgcaacctccgtcgcccggattcaagcaactttcctgcctcagcctcccaagtggctgggactacaggcaggtgccaccacgccaggctaatttttgtatttttagtagagacggggtttcaccatgttgaccagactggtctcgaactcctgaccttgtgatccacccgcctcggcctcccaaagtgctgggattacaggcgtgagccaccgtgcccaacctctacttttcttcttacactttatcctcttcatttcaagccacatcctttctcttccttttctgaactggaggctcttttgttcagtgtcctctcaacatttgttgagaactcccacatgcatcgttccctgctgggcatggtacagggatgcatgtgccaccctcactgacctccagttactccccatcttgaggaaacatgagacagctatatcaacactcataacacaaagtggagaacggcaggtgctacagaagcccagctggactgtggtgaggtgagccaggaggtggcttgactcatgggctcccctgtgcctgcctatggagtcatgtgctttgaagcagcaggaccctggccctttgtgtcttcagaagtcccctggcccagtgcaggggctgcctgcttaccagtatcggcagttgcgtaggaggagaagagagtggccatgagcttgagggaggacttctggtacagggccacaacagtctcgttgagaggatccttgtttttttccagccagcccaggatgttgtagtccacagtgccggcgtagtggatcagggagaagtgggcttcctgcttccccttgatgttgcgtggcttctggaaattgttggacttgcccaggtggttgtcgtacagcttggccttgaaggtcatgtcagtggccttggggaacatgcactcctcctccaggatggacatgatgcccatgggctgagggcagggtgaagaggcaaagagagaatcactgagcacactcccaggcttccacagtcccataccctgacaggaaaaggaatctggagccagtagcgctggcctgctgaaggggcgctgtgctggtacctcttaccctaaaacaggaagccaatattcctggaatttaaaaagccccttcctcctcctttctgcccagtgggtccaacaaagagtcatgcactcctaatcaccccccacaaggcccacagtgcctcacagcacagccccttctctctgatggctcactgccccaggggcaggagggcagggacagatgtgtgtcagaggcaccgggccaggctctgtctgtatgacaccagtagcaattcttcaagggttagatagaaggatccaggttctttaccacactctgcacttccaaaaacctggtggttcttgatttttcttggggcaggaatccttttaagaatttgttgaagctaaagactgtctctccagaaaaacgcatgtacacacacacacgtacacacacacacatgcacaagcacacacatgtatgtatgaatgtacacatgcttttttccacacacagttttatggcattctgagggctctgaaacatgagaactctggttaagaatctggataatgacccaaagcatgtggggaagctcccatttcatgaaggccgtggctgggctgggtgtgggtcagacaatccgggctctggcctatgctgacaaagagcagaggttcactgagagcaagtcagccccagcctatggggcctcccgcctgcggccttgtctcttctgaggaatgcccataagcaagagggctggagactggcttatttctcaaccaacaggaaggtggtgggaggccaaacatctctaatttcagcctaggatctttccatgaatgacgcttctcatgggcggtcagaggggccaggggcctctccttcactacatctcactcttaagacactgaggggaccaccacaaaggggcataaagtgcaaggtcctgggaaaggaagagtggggggatcatcctgttcatgcccatgacttcacagtggggagaagctgggcctggagaaaggcctgggattcttgggactctagtttcttgggtgtagaagggactcagccaccactttgtctggatggcagaggagggggcataggtggtgaggccaaggaggcaccttctcgatgaggtcaatgcaggcctgcaggtccatgccaaagtcaatgaatgtccactcaatgccctccttcttgtactcctcctgctccagcacgaacatgtggtggttgaagaactgctgcagcttctcgttggtgaagttgatgcagagctgctcaaagctgttgaactgcagggggcatgaggggtgggagcagtcagaaagtgggtgtgagtggccattggggctgtgcccgtgcactgtgccgagcccagcagggtatggctgtcccctccatgtcagggcagtggaggagggcttcccctgaagacagggacaatgactgcctctgtcaccacacagtccccactgccttcccatgtctggtccacagctggctctcagcaaatggctgttgaatgtaggagcaagcgagtgattgttctcccactcccaggggtcccaactcacgtcgaagatctcgaagccagcgatgtccaggactcctatgaagtactggcgtggctgcttggtctccagggtggcgttgatgcgcgtcaccatccagttgaacatcttctcatacactgccttggccagagccccgatggagtagtacacctgctgcacgctctgccccttggtgacatactcgttgcccactttcacccgagggtggcacagccccttgagcaggtcagctgagttcagccccatgaggtaggccgacttgtcagcatctggttgagagggaaaggataagtgagcacttcctttttttttttttaagatagaggcttgctctgtcacccaggcttgagtgcagtggcacgatcttggctcactacagcctccacctcctgggttcaagtgattttcctgcctcagcctcccaagtagctgggactacagacatgagccaccatgccaggctaatttttgtatctgtagtagagacagggtttcaccatgttgcccaggctggtctcaaactccttacctcaagtgatccacctgccttggcctcccaaagtgctgggattacaggcatgagccactgcacctggcctgagtgaacactttcagggagtgagcctccttccctgtcctggggccaagactttaggaagcatcaggtccaatttcttttccttaaagaggaagaaatcaaggcctggaagagcacagggcttgccttggttactcaaccaacgtgtgcctgagtcaggctggagcacagcccccttatccggcccatggcctcttgccacaactggctcttctcagctctgtctctacatctgtggcatctctgggtcaggtctttcacaagcactgctgtgggcatatccccaccttcaccatatccctcgcctctccagggcaagggtgtggctgaggggctagatgtcctctgctccctgtctccttcgttctctaccccagtgtctagccctggactggccatgctgtcttctccatccacatgttacccaatctgactggctgagagtatatcagacagtaccacgctcctacccccagccatccaaatgtgccacccaacatgggtatttctctgtttagaggaggagttatttggtgtaatttcaagaatgttgtaataactgttggtgtgttatcatgaaccccagcttgacactttgatctgggcagacttggagaagggtccctgaaggtagggaggaatgttcttgggcacctgtctagcactgtttgcaccttcacattttctcaaaggacctcacagtagccaccagaggagtgaggaaagattgttgatccatttcactgaggaggaaactgacacaccaatgccctgggctatgtcctgacccctggcccactgcctcccaaacaacatggtatgagcccacgaggggcttacccaagggctgggcaggcaaaggccctgcattagtgatggtgatgtgcagagctcaggggctgtgcttcctggggctgggggagtcttgggcacaggaggaaaattccccacctcagttctggtgagtgcagctggggttgaggagttgggattgtggtggactctctgtctgcccacgtctcccacgtccctgtccctcaccatcccacaacacaccccactgccccacaagcctcagagtctctgggatctgagtcccgcagagagcctggtcagcacctcaggccttcccagggctgcctgcctgcccctcccaccttcggtgccgtctggctccgcctgctcctcccgctgcttctgcttgaacttcatgttcccgtagtgcatgatggctcccgtcagcttgtagacgccagctttctcctctgaagtgaagcccagcacgtcaaaggcactctgggacagagcgagagacaaagaggggggttggagcggtggccccaggagctcctggggtccctcgaacggccgcagcagccccctcactcacatcggtggccatgagctcctcggagtcatcaatggaggccacggacacctctccctgagacacgaaggcgtagtcgtagggattgttggtgaccagcagcatgtctgcaccaggcaaggggtgaggcaggggcaagggggcaggcggagggcagggaaggggcaggtagagttgggaaagggagggaggggcagggaggggtaagggacggggtgaatggaggaagggaggacagggagcagggagagaagagaagtcagcaaggaccaaggagtgaacccagaggaagtgaaagggtagaagaggggccctggcaggggctccagtaacaaggaggagggagggtggcaggggagtgacacatgggagatggggaggcaaataaagaggagaaggcaaagacaagccgagggaggagtggagagaagggtggagaaggagtgaggtgtgtgactgcacagggaggcgagaggagacgcaggtggtcttgggagggaagcgagagggagctggcggagtgagtggagggagaagggaagtgagcagcaaggtggggcacagtggggagcaggagggccctgccctgcatgcaggagtcgttggggtgtgcagcagggacagcagtgggtggggggtggcaggcaggttcacccagcaactccggcttcttgttggacagaatctggtagaagatgtggtagtttctctcagctttcagctggaagatcacccgggacttctccagcaggtctgaggtgggtggaggggaggaaggcaggtgaggaaggaaagagagtagagccagaaaaaggtggccatgggggcagagggcagggggcacccacagcttgatgaagagggccaggcgagaagatgtggcttaaataaaaaggatcctaaagcccagaggcaaatgcagacaaaacaggagatggcaggaatgatgagactggccgccaggcagggagagaaggcagagggggacctagagggtggcagcctccctgctggtactcacaggtctctatgtctgcagaagccagctttccagtggccccaaagtggatcctaatgaatttcccctggggacgaatgggacagagtgagggaactggcgggaaggacagagtgaaatcctggccctctgttcagcccagaagccctggatggttctggaaatgtaaacgacctctttggtgtctcagttgagtataagtgaagccgggcagaggatgccaccctcacacactgtgcagggacctcctagtggaacctcggcccagaggggaacacatacagaatgcctcctgctcatacctctcatatgatctcacctaatcctcccagtaatctgcagggtggatattagtccccctgtttcacaggtgaaggaactagggctcagagaggtgtaaggacttgctgagcaagtggaaagtcagacctttggctccaaagcctatgctctcttcccaccaacgtgtgcatgttgatatcccaaagccagatacagtacaatcaactgggtgtggcaaaacagcaccccctttttcttgtcaaggctggatgaggccactgggagtggtcaaaggcactcacaaagcgggaggagttgtcgttccggacagtcttggcattgccgaaggcctccagagcggggttggcctggatgatctggtcctccagggtgccctatgaaaggagcagaactgcatgggttcatcctccatccacctccaggcagtggtgagagggcagggaggctgccctggccctgaggaatgggggtgcggggctgggtgaaccgctagtgggtctgcgactccacaggatcctacccagacctcagggtgagtgtctcctgtcaggaaggtcttccatactgggctgaccatcgggagcccagctcagtgtggctgtccccaccacgtcacagggaggggagggttaggggtaactcgggtcagcctgccccccaacccctgttctgccgagcctgtgtcccccatggcaccttgttcgcattggcattgtccttcttgccacggtcacctatggctgcaatgctggcaaagtactggatgacacgcttggtgttcacagtcttccccgccccggattctcccctgggggccacagagaccaatcaaaactcaggattcctactgttctccatacagggctcagcatcacatgctccccttcccagcctggccatcagagcccagcacccagcaggatttgcctgacatggttcattgctctggcacccctctaatgagagctcagtgccccatgctccctgcaatcccagccttaaacctctcctcccaactacaccctaggcatcagcgtgtatgcccccagcccagtcccttctgtgggaggatggcactcgctcacgtgatgaggatggactggttctcccgatctggaagaaaaaagaggagaagcaatggggtcagggctgaggatctgggtgggtgtctgggaggaggagcagagaccaggggccaccaggctcacctgtcagcatgtactgataggcgttgtcggagatggagaagatgtggggcggggcctcactcctcttcttgccccggtaggcggccaccacctcggcattgtacaccggcagccacttgtaggggttgacagtgacacagaagaggcccgagtaggtctggagcaggagacaaggctgggcatgaggttggtggggagagcctgggacaggcagtggtggcagccaggcatgtccctgttcactccagctggctctactcctcctgcagctgactaggggtggaggggggaaggggacttgggtcccttgggagtctctccccctcttcttgggagagcccccctggcttatttaggcctccacgcagcacaggaagcctctgcagtgtgcaggagccactcacatatatcatccaggccgcgtagcgctccttgaggttgaaaagcaccgcgggctcgtgcaggaaggtcagcatggccatgtcctcaatcttgtcgaacttgggtgggttctgctgcaacacctggtcctccttcacagtcaccgtctggagggggcgcataagcaggaggatgagtgaccacaatccctccgggacccttgccagcactgcccactgacctcctcccaggacacagggacttggccttgctccccttgctctgaccagtgccccggcccctaccccgatgtcccctgggacactttccccaggtaatttcccttcccattgtatctcccatcctagagactgtcctagggtacctttctcttgccagatccccagaccatcctggggacaccctgtgcccatgaccatcactcttcagtccctatgttccaagggtcttggggcagacctggagattggcagctctcagatctgtgcacaccttatgctgaccccgaggctgtctcccgcgggcagcgctttagggtatctgttgctcagggcaaaccttcacccctgctggaaaagtagttcacccatctactccacactccccatccatcactgttggtgtggtttgattggcagcagtcagtttgccatgccctgatgtcattagatcctgccagtaggtattccagtgttttttatagtggagaaatccgtggctctaaatgactaaatgatttgcctgcacagtgactagcgggtggcagagctgggatcagagtcaaaagccccaggggattgtggcctgttattctacacttcaatgggttgtaacattcagtcaacgagttcatgaggcacacagccctgagccgcagctggtaaccaggggtgattctcttggctggtgtgagcaaaccagggaccagagcttctgagtgccagtcaaggagagtgctcagctcaaaagtttctgatctttgtgttcatctgggtctaagaattactcttgatttgggtgaacggaatttgagaaagtggactcatggaggaaactgaggcacagggaagagggatacaagtgcaagaagggggcatcatttaatgctgtgtctgtgccctctttatctacaagacccctcttaggcgaacactgaggttcttcttcctcagcatcctctctggcagggggaacatggccctgggtggcacctgttgcaccagctcaggtcaatttgagagggatcagattctgggctcctcaaaggagcatgtcctggcatccccactggccttggcttttctccagccctctcagctccccctgcaagtggctccacctctgcatcttctttcccagacctccttcccttctgccccggcgccatgccctactcaccttcccattctcggtttcagcaatgaccttgcctccctcccgggacaaaatcttggctttgacaaactcttccttgtcatcgggcacgaagcactcagtgcgaatgtcaaagggccgggtctgggcctctagacgctccttctctgacttgcggaggtactgggccgctgccccaaagtcagccatctgggcatcggtcatcttggtgcttcccctgggtcagagacaggagggctatgttactcctgagggagcccaggctccagcgagtggctttgtcctctgcagcccccctccctacccccgctcctctcctccaccctgggagaggcacctgctgttgcaccctcccctactcagggctctgcttctcctgccctctgaggtgatgctgaaggacaatctctgtaaggggtttccctggggtggcattggctggagtatgctaagggttggcgctgagtgcttgggacagcagacccctggtccagcaatccggctcccaggagaagcatgccccagtctctgcagagaaaatgggggcagttctcacctggttatcccttcacggagaatcctgaagaatctggaccgtgggtggagcaaggaacaacagaggtagagccgggcagagagaagaacagatgaggagagtgaagaacaacagaggcaggccacccggggatggaggcagccccagagcgcagacaggcaggacagaccagggagtcagaaagggaaagacgcagaggcagaaaagaaagggcaccgagtcaatatgagtgcgagggacggggtgtggaaacagggttagaagcagagaggcagggaggtgagaacacgtgccaagaaggaaggacaagggagagagacaaagaagcatgattgtgacaagtgtcgatgaagaccaagaggcaagataaaaccaggatcaagggaaggaagccatccaaaggaggaaggaagatggaaagatggagacaacatgtaggagactcagaatgatgcagagaaagaaatggagagtcagagaaggagaaaagaggtttctgggtttcctgtggaacctccttgtgtcagggggaacttccctgggcctggagataggcagttttaatagagcccttaggcctccaactgacctgcaccccactcctggtgaaggaggtccctcacggtgggggctctgtggacgggctgcagggcatcccaccccaaacctcctcttacctgggccgcaggagtctctctatct

SEQ ID NO: 1400 - DNA, 22924 bp, Homo sapiens
tctcggcttcaaggaaaattgctttattctgcttcctcccaaggagctgttacacaggctccagcatggggctttgctggcacctccagggctgagcagatcaagatgtggcaaagctactcctcattcaagcccttttgaaaggaaacaaagtccaatcagtccttggagagatggtattgggcagggacagggcatgggaacaaaggtgagaggggtctgatggtggggggcctgctttgtgggcaggtggaagcccctgtggcagcagcacatgtgtttccagggatcgatgttcggggggcaagttctggagggtagggttctggggttggtcagagggaagttgcctgggcgagaacaaagccaggcccgggttctctgggatgtccattttaggtttgagttacaagattgcaggacaaaattaggtggaagggaactggaaactagcagttggggggaaactgggatatactggttgtatataaattagggtcttctagggtggcacccctccctaaggctgaaattcccagaaccactgaaacttagagctgagctgggagtggtggctcacgcctgtaatcccgtactttgggaggctgaggcgagtggatcacaaggtcaggagttcaagaccagcctggccaacatggtgaaaccgcatctctactaaaatataaaaattagctagacatggtagcacatgcctataatcccagctacttgggaggctgaggcaggagaacccaggaggcagaggttgcagtgagctgagattgtgccactgcactccagcctgggcggcagagtgagacaccgtctcaaaaaaaaaaaaaaaaaaagttagagctggaagaatccttgaaatcacagagaactgcattaccttggcctctggggccatgtggctcaagtgtgtggaataaatgaaaaggaagcatcccgggtttgagggtgctctgtctgggtatgcctgctgtgggggtgactagcaaagcccaaaagagggacccaccttcgtgccaatgtcacggctcttggcccgcagcttgttgacctgggactcggcgatgtccgcccgctcctctgcctcatccagctcgtgctgcaccttgcggaacttggacaggttggtgttggcttgctcctcctgcgggaggtgggagcatgaggtgagagggggcctgggttctcagactcctggcttgggggacgagctctcctatgcctcccctgggcctagtccccagcagggtcactcaccgcctcctcggcctggcgcttgtaggccttgacctttagctgcagcttgtctaccaggtcctgcagccgcagcaggtttttcctgtcctcctccgtctgggggccagagggtaggcagggggtgaagatggcacagtcatagaaggtagcatcccctccgccctgccctgcttcatctgatatcctgacccaattctactttctgatcctcactaaacacttgaattctccttataatttcttaccaaatatgtgtaaatattttaaatgatctgtaccaggaaagagtccaaagaactagtgggactcctgaaattatgcacaaaattgtgtgtgtgcagtgctccagggagcaggtttttcagggtccggggaccccatgcgggatgaagtcccctgctctggacctcggcacatgctgggagtgactttggggctatgagtgtgatggaatttcctgggctgcaatgcaggccaggaaaacactgacttaatctaagttaaggacaaagtgtgcttagagagatagtgacatcctggattggaaaagaaacaaattctaattcagagtctgattctagaaaacacctcagaaagctagagtccacactgccctgggcaatgaaaaagtttttatgcttgtttgaatgggatgggtgtgtttttggtgtcttttgggggtgaccctggctacatatttgctttctggtgagctgtactgggtgagctttgtctggaattctgtgtgtgtcccctggcgatgggctaagagtgggtgttgagatggagctcccaggccaggaggctcagagactgacctctgagctaggggacattcagagtggggcagggctaggcaaagtgaaacgggggctgcattcccatcctcgccctggaagaggctaagagcaaactcttcattctcctcagctggttgtcactgtggctatggtgccagggctctgcctggagtcaccgcccgtcgcacctggtaggtgagctccttgatgcgccgctcgctcttcctcatgcccttcaccgactctgcgttgcgcttctgctcggcctccagctcattctccagctcccgcacccgcgcttccagcttctgcagctgcttcttgccgcccttgagggcgatctgctcggcttcgtccagccggtgctgcaggtccttaatggtctgttccatgttcttcttcatgcgctccaggtgggcgctggtgtcctgctccttcttcagctcctctgccatcatggcggcctgtgtgcaggagagaggtggcacatggtctggtcaagtcctcacacacttgctgcccagcccacggagagacactggtctggatcgggtcggtggagtgggggacttacatccgtgatggccttcttggccttctcctcagcattcctgcactcctgcactgcctcctccacttcagtctggagctgggacaggtcagcatccatcttcttcttctggttgatgaggctggtgttctgggttgggggagggttgggcagagcaggaaaagcattgagcatctatgcatagctctcaagccttgcttgctgagccccagcctgtgctcccttcaggaatgagcaggggagctgctcacctgggaatgcagcagctgcacccgctcactagtctcaatcagctcctgctccgccagcttccgggaccgctctgtctgctccaccacggcacgcaactcctccagctcagcctgcagcaggttgttgcgccgctccacgatggcgatgttctccttcaggtcgtcgttggcacggactgcatcgtccagctgaatctgggtgtcctgaggatcaggagagtgggcatgagcagggagccagcctcggttcccttcactaaaggcacctgtcagaggtccctgcagtaacctaggggcaggaggaatctggtgcctgtatcaagacactactgcttcgccaggccacgtggaggccagtcccctctgggtgagtaccttcaacaagctctggaggctcttgacttgcttctgggcctcggcggccatgcggttggcgtggctgagctggatctccatctcattgaggtctccttccatcttcttcttcaccctcagggcctcgttgcggctgcgtgtctctgcgtccagggaggtctgcagcgagtccaccacccgcaggtggttgcgcttggcctgttccatctcctcgtccttctctgccagcttccgctcgatctctgccttgatctggttgaactccagctgggcccggaggatcttgccctcctcgtgctccagggaggcctgggaaggggttgggggaggggatgcaggcagacagtcagggcacagggcagggtgggggcctgctcactaatcatggatacgaagtgacttcaagagtggtgtaagtggttcaaagaagcagaaggtggaggaaaagagaatctaagagaaaataaaaataagcctaagagaaagtgattcaggccctcacaggggagagccagctatgaagacaaggaggaaaatgaagagaaaagtgttgccaaggaaacagaggcaatcaggtatagagtataaaagaaaacagagggaggcagaggtgggaaccgggaggtatgtggaaatgggaagctcagctaagatgcaatgggtaaaatgtttatgtgaagagagttcagtgactggtcattcattcactccacaaatcttcactgaatgcctactatgtgccaggctctgtcctaggctctggggatgggacagtgaacaaaacggacaaagcgggggatgagaacagggaccaaaagcctggagctcagctccctgcaccccgtgccctgcacacacacacacctcggcctcctccagggctgactgcagctccatcttctcggcctccagctgctttcggaccttctccagctcatggatagtctttccgctggaacccaactgctcagtcaagtcggagatctcctctgtgtggggaacacggtaactcggttgagggctgctgaggtccagtggagttggagggacacgcctctttgcccagacgcctcttggagcccttgggtggcaccatatgggaacactgccagtgcagcccctccccagcctcttgggcccccagcacaccctgcaggtttttgttctcccgcttgaaggtctccagatgttccagggactcctcataggcgttcttgagtttgaagagctctgtgctgagggagcgagcctccttctgcgaggactccagctccgactgcgactcctcatacttctgcttccactcggccaggatctgcccggggacaaggctcactcttcagccccccagcctcagccccatgtccagggtctgtctcaggacctgcctgggctcagccctcctcccccacctccaaggaggatggctctggcctctcactgaacccctcatgcccccttgccctgcatgctggctgcggcccccacccagggcccaccttgtcgaagttcctctgcttcttgtccagggctgcagcagcagcattggagcgctctacgtccaccatcaagtcctcgatctcattctgtagccggtgcttggtcttctccagcgaggagcacttggcattaacagcctccacggcctcctcagcttcctgcagccgctgggccagcttcttcctgcccaggggagggtggcagagggtggggaggatggagggtgtggatggggacaagaggaaacaacatgaaccttctcaaagacaatccttgaaacctcagaagtgtagctggagaagcctgaggacaggtcccaggggccgagaacatcaggcagaggatcccagcagggcgtggagacccaggcaccctctgaccctggcccagcctctgcgctatggacattgaggaggtatgggcttctgcagccctccccactgcctttccctgccacagtgccctgccccagacggaagcactctgccctcagacaaaccttttgttcgtcttatattcggatcagaaacataattcgagcaaaaagcttccctgagaggagaaggaggtggggccggggcagagtcctcctgtgttgtcaaacactagctaagcatcgcctgtgtgggatctgctgaggctggggctgggctgagtcctgcctgcaaaggggcctcagccagaagtcaggctgctcagaactcacttggcctcctcgagctcctcagtccgctgaatggcgtccgtctcatacttggtcctccactgggccacctccgagttggccttggaaaggacgcgctgcagctcggccttggcctccgtctcctcctcgtactgctcccgcagcaggtcgcagtcatgccgggccgactgcagtgcgtgggccagggcgttcttcgcctggggaggggtgggcaccaggaggtgggttcagctttctccataaagcaaccccacccttgcccttctcctcaccccaatctcaacatcatcccttggcctcatctatgtccaaacccccagtggacctgtcatggtttactgtttgctgataacaaagaatgccaatacagcagtgaactatttaagaaaagcttcatggccattggccctgagctcctccccacaccagacatggtcatcatcaccgccattttacctggctggggagagggaaacaggctcagaaaggttaggggacttccctaacctaagatcactgagctataagaggcaggttagtatgaaccctggagttttttaaaaatcatgttctttctcctttttcatgagtccagcaaagtgctaggaataggctccagttgaatttctttctccagttttcaggtggccctgcaaatcccaggacccatttgtgcagtccctacatcccctagccgtgcccgggcaaggccatctcgtgcctccctagttcattttctctcctccttctcacaccctgcctcccgtccagggatgcagcagaagcagagggcctcagcctggggagtagatggcatgtggcagggtttgggctgtgatttctttttagaattcttggagaactgttggtccacagccagccttattgctgggaagggaagtgatttgatgcaaggctagtcagtgtgctccttgcttgggccaggtggcccgagtctagcccttaccttaacctcctcctccagctgcctcttgaggtcctccagctgctgggtgtaggtgagcttgcctcgggtcagctgggagatcagtgcctccttctcatccagctgccgggacagctcacctggggaagcaccattctagatcagcactcctctctatccccacctcctcctctagccctcaggccccattttctggagagactctgtgtctgtgtgtgcgtgtattggcttgtgcccgaggctggagtggctcaggaggttggggagactgtggtgggaaccatggagcccctgctctaggctcaccattctcggtttgcaacttggcccgctggctggtgaggtcgttgacagaacgctgggtctcctccgccttgctccggtgctcattcatctggtcttccaaggtccggcacatcttctccaggttagcctgagaagggaaggagagttatatgatggatgttgggggcggggggaatgaaggggtgtaagaggtgcaactgaaggagaaaagaagagggaaggtgtgaaaagaaggaggggatctgagaaccaggcagaggaagggaagtgggaaaatgaaccatgaaggaagagacactacatggacagaaaggggaggtgggaggaggaagttggaggaggggaggccgagcagagcctgccttggccttgatgatctgctccatgttggaggtgacgtcatccagctccagcttgaactcgctcttctccttctccagcttctgcttcacccgctgcaggttgtcgatctgctcgcccagctcggccacgctgtcggcgtgcttcttgcgcagggccgcggcagtggcctcgtgctgcagcgtggcctcctccaggtcccgccgcatcttctggaactcggcctcgcgcttcttgttcatctcgatctgcacggacgtggccccgccggcctcttccagccgctcgctgatctcctccagctcccgagacaggtctgagcgcagcttctccaccttagccctggcggtgcgctcggcctccagctcctcctccagctcctcgatgcgtgcctggtcagacacaaagggctcagacccaccgcctggacccctccactggaatccccccggctctaaaaggctctcggcttctctggaacagcaagtcagtttagctcttccagtggagaggtgggaattaaaggatttggggaagatagtttgaagagccttcctttaggcgagggcctgacagtctacatgctctttattggaaggaaagtggttgaaacttgctcttaaagatggacaaagagacctgtgttctggggatattttaagcagtttagtcataaaaaaataacaaaagttgaaaatgagagagccgtatttgtctgaccagacaactaaagacctaacacagcttctgctctagagtaaggaggaaagtcatgccatcagagtcgaaggactcttaaaaacctccatgtaacaggggagggcatggagacccagagatctggagtgggctcccagaggtcacccaactaaggcagagctgagacaggaagccaggaattctgccctccaggcctgtgaccttttcagggtctctgtggatcacctgaccccttttggatgtatccatgggcacactgtgatagctgcgtgcctgcctccatggacacataatcagttcctgtaatgctgtgaacaggacaccctagaggagggggcaggggaaacagaaccagcccagggactcagcatcccgcgtgggtgtccagacctcacctgaagctccttgagcttcttctgcagctggctgccgagggcctgttcatcctcaatccttgcgttgagagcattcagctcaaagtcttttctgtggggaaggagggatggtgaggtaagggagactcgtggggcctcaggagggtccaccagtggttgaaaatggtaatgatacaggtaaagagtaggatttcattagaaaaacagcttctgggggtgatgtaggatccctggaagtgtaacacctgcggtgagattgaaatccaacaagaatgtaatgggaggagtgctgtagacagggtgatggggcctgggctctacaggacattcccatctttggtccttgttttctcataatgtaaaatgagggggtcggactagattgtttcaaaggtcctttttagctctgatggtctttaattttgtcactattgctttgggtaactcagctaacctttctgaaacttattttcctctttggtaaagtgaaattaaagataccatccttaaaaggtgttttgagaatcaaataggatcgtgtatttattcatttattcaacacattctgtgcctgggaaggtatgaagattcctgtgcaaacacaaacttgatgaggatgtagattatgatgattctcaaagcctttcaaagtcctgagcctgaaacaccataagaccttcaattatcaaaatatgttctgcaagctcactgtttaccaagtctggaaagtctatacattttggaagaacttacactaagaattggaaccacaagttaagcaaaacaaagaaatggccctgatcccctgacttctttaatgtgagggcatttcttggtgccctgtgggctctctgtgaaaagccacaaagggactttcctaagaggctctcatgtggagccttcctccatgtcaaggaactggtctccaaagagagatgtgtatgaagggggaaggctgttattttcattcccactgagtgcctaacaagaagaaaggactcatgggatacaatggactttttgccagggaggaccatctaactaaccctgatatctgggactaggggaggaaagcccttgcctgggaggccttttcccatggtttgcgcctccacttgtggaggctgcgtgaggttgttgcctcagaggatggctgtcttgggtctgcttgtactgttatgggctggggaggaggaagggcagcagggaggggacacagtactttttcagccgctcatccagctgctgcttgtcattctccaggtccatgatgctctcctgggtcagcttcaggtcgccctccagcttccgcttcgctcgctccaggtccatgcgcaccttcttctcttgctccagggatccttccagctggtagagagaaggagccaggcccagtgaggcaaagcatcctgacttggtgattttgttgttcagttacctcaggacttggtaaatctttgtgttcaggacttgggaaaccttccccagagtgggccaaatgttattaggggactgtgagattgcctagatataggggatgctgaatcaatattttatagataaaggaataaatgactgtgggatgaaaccccaaagccgtattctttctttctttccctttctttctttctttctttctctcctttctttctctccttccttccttccttcctccttttttttttttttttttttatggagtctcactctgtcgccaggctggagtgcagtggcgcgatctcggctcactgcaacctccgcctccctggttcaagggattattctgcctcagcctcctgagtagctgggactacaggcgcacgccaccacatccagctaatttttgtatttttagtagagatggggtttcaccatattggccaggatggtctcgatctcttgacctcgtgatccacccgccttggcctcccaaagtgctgggattacaggtgtgagccaccgcggctggccgccgtattcattctttcagcatcctataaacacctactgggcatcaggctctgtgctaagcactgcagtccccaaattgaatagatctaagttcctatctaaaggaagcttgtagtcttatggctgagatagaagcttaaataattaaaatacagagtgataagtgagtcaacagacatatgtgcatcagagggaacaatgatcagattctgccttaaatattggaatttcaaaaattctacttggggagcctcacaaaatttccaaagaaatttatcatgttcttatgagatgaccctctaaatcttgtgtcaaaggcagagatatatgggattgcacttaaattaaataagaaaactcatctctattattgatcataccagtgagattagatacataattcagaattgatcaccacctctgacttttcattccccagctcctttctagaaagatatcagaaaagttaacatcctctaaccctacccccctctaaacataaacacaaacacacacacacacacacacacacacacacacacacacacacacacacacagagctctgggcacagatagacatggcatatctaggccccacaactctcaatctactcacatcatccacttgctgctccagcttgactttggccttagtcagggtgttgaccttgtcctcctcggcctgaaggtcatccagagcctgttggtgggcctcttgcagagctttcttctccttggtcagcttggcaatgatctcatccagcccagccatctcctctgtcaggtttttcacctgccgaccaagaatcccatctcctttagggtcaaaggtcaccagcttggtgccatctgtggggagctccatgtcaaggtccatgctgctctctggatgccgagtggctagcctgggtcaaggtcagtatggtctgagagtcctgatgagacccgggctggagccaaagggagctgcccttaccttgttctctgttgcgtgtttctccttctccactttggccagtgtcagctccagatcatcgatgtcccttttgagctctgagcactcatcttccagcttgcgcttcttggcagtgagctcagcattcatctcctcctcatcctccagcctctcgttcatctccttcaccttggcctccagctgaatcttgtttttgatcagctgatcacagcgctcctcagcatctgccaggttgtcttgttcctgaaggtgaggaacagaggggaggctgttcagggggtaaggtcctcattcttgcaggtagagggaaggagaggcacatcactcaaataggagggtaactctaggatatccccacttggcaagagcttcagaagtatggggaggggaagagtttcaggatagtataacttgggaacactggggaggggagcagagaggaaaggaaccagaaatcttcatctggacctcttcctctggtctcctccatcgaagggtgggaattgcatttgctgatgccaagcacttatgtatgatggcttaatgaaatggacagctttattccctgtctagaggaaattgaggctcaaagatgatgcatggtctgcccaaggtcacaaaataattaagctgtgtatctaggttgaacccaagtagaaagcctgtgcttttaaaagtcagctcttttccctctgccctttcctcctcctgagggacctctttggaggtctttagaagtgttgatcccagagtcctctgactgaaggaacaagacagtgagcccctgtgcagggaggtgcagggttgtgggaagtgaaggcagagcagggtggaagagccaacagtagcccaggagcctcaccgcctgcacttggagctgcaggtcattcttctcctgcagcagggacaccatcttctcctccagctccttgcggcgagcctcggacttctctagcgcctctttgaggcgtgtgaactcctccttcatggaggccatctccttctctctttctgcactcttcagcagcggcttgatcttgaagtagagcttcatccagggccaattcttgacccccatgaaggcccgaatgttccactggattaccagcagggagtctctgcaggggcccattgaaaggagtgctgagcctcctgcctccttcctacctgaggtcctgaaaccttgggaatatcccatttccttcatccctcccacccttcctgaggcctctgaccctgtgactgcagtgtgttcatatgagcccctcctgcaggtctctgtgtttgaagatctgctgagctttttttcctgacactgcccctgaaccagcctgggcctcagagaagcgggaaacctcctcttgagatctctcacctacgttccagcagctttttgtactccattctggcgagcacacctcgggactgggcctggatacgcgtgatgatgcggctcagcctctcgtccctcatttcctccagcagccccagcagcccggccttgaagaacacctgcaggcaaggtgtgtgttggccatgactagggaggggtacgagggaaagagatggtggggattaccttaggaagggtaacagcctagaaaaggattgcagggaggaggtcaatggcagctggagctgggatgaggggagtggtgctagatgttccactgggaggggtagcatacaggtaagagattttgctaagatgattacaacaggaaaagcatcagaggagtcaatggaaaagagatgtcttcctttaattaattagtctcctttcctcaccttggtgtggccaaacttgtactggttgtgatcaatgtccagggagctgagcagcttctctgcccccttcctgctatcaatgaactgtccctcagggatggccgctgggttcaggatgcgatacctgaggagggaagtgtccagagtcacccatgctctgcagtgatctgctctgcccatagaattccagggtcacctgcagatcccattcccatcagggcagcctggctccccctgttctatgagctctggtgcaccctcatacccacctctgccggaagtccccgtagaggatgcggttggggaagcctttcctgcagatgcggatgccctccagcacaccattgcagcgcagctggtgcatgaccagggggttgtccatcacccctgtggcaagaaggaagtaggaggagtctgtgagaacactggactgaagttctgggttctgatcctggctttgtcactgattagcttgtaatcttagcaagtcagttagtaataatcatttgtttcattttcttctagccacatttttaactaaaaggctttcacattccttttttatatgattcacacctattatcataggtggtagccagaacagatatatccaatgttctagatgagtaaattaagcccagaggggttatgggactggcccaagttcactaagctgatcaagaacagagccaggtcttgaacccaggtccctgagcctctgtctcctaattagccaaaaatggattaacaatttgaatatgtctcattgggggattaagtggttctgcaggtaaatttaaagttgaactaagattctgtcttggacaaccagctatccaaggggttgtagggccactgatgaggtaatgtccatcagagtgccttacacatcaccctcattacacactgcaagtgcaaggtagcgctgagagggaggtaccctgggaggcctcatgcgggatgggaggagaagaatgtggtttggaaaccactgtggtggtaggtagggagatgtcctaggaggtcctgttcccagggcggtgtatgcccagcagtgggttggcctgagtttgtggcctcacctggagactttgtctcattagggatgatacaacgtacaaagtggggatgggtggagcgcaagttggtcatcagcttgttcagattttcctgtggccaaaaatgcaatagagaaaagtaaagaaaatgccagaaagagatgcaggaagaagagaggagaagaaggaaggaaaagagagatggagagaattcgagaagtcacagagatgaaggggccctgggggcagacagggataaggagagagggtgggagacagaagggaaagaggagagaagggagatgggaagtaaataagtgaagaggccaggagatgacgggaagagaagacagagtgaaaatggtcccgaatgcaccaaggagacagggaacgggaggagtaggggatgaacaaggcagggaagggtggggctgggtggggttgggcagatggggagccaagttggctggggctgtgtcccactcaccctgtgcagagctgacacagtctgaaaggacgagcctttcttggccttgcctttgcccttctcaatagctgcaggaaggagagtcaacaaaagaagcatcagtgtggggaggtagggtgtgagtaaagaatcacagcccctctttacatccttgctggcatttggcccctgggtgagggccttcaatgtggctgcctcagtttcttcacccagttccatcccactgagtctgtaaaccttggggtacaacctgacattgaagtggtggggtgtagcaattgacctggctcagaaccttggcagaatccctgctcctctgtaccgggagcctcagtccctacttacgcgcatcagccccagcatagttggcaaacagggtgctgagcagcttgagggaagacttctgatacaagcccacgacagtctcattgagaggatccttgttcttctgcagccagccaatgatgttgtagtccacgatgccggcatagtggatcagggagaagtgggcttcaggcttccccttgatattgcgtggcttctggaagttggcggatttgcccaggtggttgtcaaacagcttggccttgaaggtcatgtcggtggccttggggaacatgcactcctcttccaggatggacatgatgcccatgggctgaggaagcaggagagagcatcactgagtgtccttcacacaggtggacatggattctgctctatggtcaatatacttgctcgtggaggtgccatgttgggtgttaaggtagtaggctcagctctgagtacagttatctactgactggaaccggttcaaggtggaggattttgtctgatgacagaaggacctttgtgaaagtctgggaatatggattctatcgatgctgtacacaccactccacgacccagatgcctgagatgctagggttgaaaataggtgcactcttatgatcccctacaccaccctcacacttcctgatccttggatgcataaaccaggcccaataaacatgcaggtgtgggaggtcatcatgcaggtgcccatcctccatgtgtccactttcaagcccctgggaaatcagctgtccctggtgccaccctgtcctgggtgctcagcacaacataggctctggaaccaagggctcggatccttcagccccttctatttttatattccccagaagggagaggggctgctattttgtctatggtgttcttgttgggtgtgcagggagaattcaggtggtaaggccaaagaggcaccttctcgatgaggtcaatgcaggcctgcaggtccatgccaaagtcaatgaatgtccactcgatgccctccttcttgtactcctcctgctccagcacaaacatgtggtggttgaagaactgctgcagcttctcgttggtgaagttgatgcagagctgctcaaagctgttgaactgcagggggcatgaggggtgggagcagtcagaaagtgggtgtgagtggccattggggctgtgcccgtccactgtgcctgagcccagcagggcgtggctggtcccctccatgtcaaggcagtgaaggagggcttcccctgaagacagagaaaatgactgcctctgtcaccacacagtccccactgccttcccatgtctggtccacagctggctctaagcaaatagctgttgaatgtgggagcgagtgagtgattgttctcccactcccaggggtcccaactcacatcgaagatctcgaagccagcgatgtccaggactcctatgaagtactggcgtggctgcttggtctccagggtggcattgatgcgcgtcaccatccagttgaacatcctctcatacactgccttggccagtgccccagtggcatatatcacctgcaaggtggaggagagacccatattgagcagggttgttgggaagagtgaacttgaaaactctcatcccaccatgccagtctccctaccctgcccacccattatcatctgaagatggacccacctgctggacattctgccccttggtgacgtactcattgcccactttcacccgagggtggcacagccccttgagcaggtcggctgagttcagccccatgaggtaggcagacttgtcagcctctggaaggaaaaggcaagtagcaaagttggtaaagagatgactgctggccaggtgtggtggttcatgcctgtaatcccagcactttgggaggccaaggcaggcggatcacttgaggtcaggagtttgagaccaacctggccaacatgatgaaaccccatctctactaaaaatacaaaaattagccaggcatggtggtgcatgcctgtaattccagctactcgggaggctgaggcaggagaatcacttgaacccaggatgtggaggtggcagtgagccaagatcgtgccactgcgctccagcctgggcaacagagcaagactccatctcaaaaaaaaaaaaaaaagaaaaaagagaagagagatgactgctgagcagacatggccctccatgacttgacagctgcccccaagaatccctgcctcccaccttcagtgccgtctggctccgcctgctcctcccgctgcttcagcttgaacttcatgtttccaaagtgcatgatggcgcctgtcagcttatacatggagtttttctcctctgaagtgaagcccagcacatcaaaagcgttctgtagggaggccccatattggcggaccccagaaaaagaagtatgatgggtaagtgagatcccttgtaagttggagagaaaacttgtctccttaatccctgtgggttctgagactcccatacccagtggggagctccaaaacaaaggatgtaagatgcagggaactccaaaacaaaggatgtaagatgcaagagcagagcagacgtcagttggccgcagccccagtgtcagtggccacagcttttctgagttacccacttatgcttcctggccctacacttgcttcctgcctggccttccatacctgtctgcatctgttcacctaacagcccctccagccccatgccgtctgcatggccttccctcctcgtcctgctccctcggtgatgcttgtttcttggcttgtgtgtctctctgtctcatggctttcagctcttcctggtttgatagaacaccagatactggccagtcctgtctcacctcatccattccccagtacaccctgatcacagggcacattctggctctcaggaggtccataccactttaaacaaccaatggccagcgtcttagctctgcttttggacccctgtttgcccctcactgccaatcctcccaccccctggctgggtcctcacacactcacatcagtggccatgagctcctcagcgtcatcaatggaggccacggtggtctctccttgggagatgaatgcataatcgtaggggttgttggtgatcagcagcatgtctaggggaaaaaacatggttagggtgggacacaagcccccggctctcatggaggctgctcgccacagcacatggcctgaggaagagcacaggacagggcttggcttggccccacatcccactgaattgaatccagcagtgccatgaaacccagggcatgccagctgagtccagccacaagcagaggggaccaggttgccatggagatagttggtctcagtcggtggctctgactcacccagcagctcaggctttttgttagacaggatttggtagaaaatgtgataatctctctctgctttcagctggaaaataactctggatttttccagaagatctgtgaacaggtggggagaagaaggagagaaagaaaagttagggtttgggcacaaggaaaattaatgataaatgtagcaagcaaaaggcagagggaagggaagagccagagagactagttggacagacacaaagagatcacacagagagatggaaacagagacccagaaggagagaaatagtctcagagagaaatcccagagaaagacacctagccatgcagagacagaaatggagaaagatgcagaggaagtctcagagagagacagatatgtagacctgaagacagagacacctacagacagagacttaaagaggagaaaaacagagggagggaggggagagagagagaggtcaagaccagatggtctagagcaagggtgagcttaggctgagcctagcagattcatggcactcacaggtctctatgtctgcagatgccaactttcctgttgccccaaaatgaattcgaatgaatttcccctggagagatggaagagagtggtgatgagttgggggaaggctcatatctgagaccattcctccaccagtccaagtcccaaggccaaggtcagggaccactcacgaagcgggaggagttgtcgttccggacggtcttggcattgccaaaggcctccagagcagggttggcctggatgatctggtcctccagggtgccctgcagaggccaagaaggaggcaggtgagagctcttctccctccctttctgcggtacaggaccttggagggcagcaggcctaccttgcccgggctctggtccttcttgctgcggtccccaatggctgcaataacagcaaagtactggatgaccctcttggtgttgactgtcttccctgctccggattctccgctgtgaagacaggggcttattgggcagtgaacaatactactggagaccagcaagcctcaaatcaggagagaatgcctgggcctacccgagagtaggagccctgggcaagaagctgccaggttatctacacccaaaatccacaactgtcttctgatgcacagaggtcagggctggcaccaggaaggatgccaccagaaggcactggtttgggcaggctgagcctgtgcttggctgggcaaagtaaacaggggagatgggcctgggctgttttgggaaaagttggtagggctggaagaatgggaaatgtttctgaagggaaagaaaatgcagaggtgaagacatggcgataatgagcttctggataaacgcgtgatgagttggagagtgggtgaaggaggtgggagaggaaaaacatgaaggggatggaaagcagaaaggaagagggagagcaaagagaggggtcagggtaatggtcagagaagaaggagatgggcacgaggttggggggaaagaggctgagtctatgcctcggggcctgggacacctgatggggctggaggctgggatcagggagattctgaaagggaatacagtagcagctacactcacgtgatcaggatggactggttttctctgtctgtggggagagggtggggaggaaaggtcaggagctgcacaggatgctctcgtggggcttctcccttccttctccctctccctcccggcctatcccagttcccttcaggaagacccttccagggcctctcacctgtcagcatgtactgataggcgttgtcggagatggagaagatgtggggcggggcctcgctcctcttcttgccccggtaggcagccaccacctcaggagtgtacaccggcagccacttgtaagggttgacggtgacacagaagaggcccgagtaggtctggggatagaaaaggagcagtgacttgccagttgcgaagggggagggctggtgattttgggagttagagaaagatcccaggagagaaagaagagaaaggaaaacctctgcatgcactcaatctgagtaatgccagtccccagagtgttggaattgaaccaaggatgttgggacgaggttagagtgtaaccctgcctagacacaaacagaagacactcttggctcctggggtggacatggatggagcaagaacagagatcccaacgtagggccaggtgcagcactcacgtagatcatccaggagccgtagcgatccttgaggttgtagagcaccgcgggctcatgcaggaaggtcagcatggccatgtcctcgattttgtcgaacttgggtgggttctgctgcatcacctggtcctccttcacggtcactgtctgcaagagcccccacccaagccctcctgtcagcctgggctttccctccttcctcaagagggttaggagttggtgagtgacagggcaatagtgctcaagagagaaggaaccaggatctcacagggaagacagaagggatattgggaaggagagggctctttggagggtctggattcttccccaaagggaaggagaatgggaccatcctcaggtctgcatgggcatggggcatgggtgtacccctctctgtccacccaggtgtacaggtggccagggtggactctcacatcagcctgacacccaccttgccatactcggtctcggcagtgactttgccaccctctcgagacacgatcttggccttgacaaactcctgtttgtcatcaggcacgaagacatccttcttgaggtcaaaaggcctggtctgcgcttctagccgctccttctctgacttgcgcaggtagggggcggcagccccaaagactgccatctccgaatctcccatggctgtgcctggagtgagcagaagctggctgccctcccatctgcccattcttcccttccctccctgggctctccccttcagtgggagccccaaaacctagcaccatgctcaagagtcaagaggagttaccagtgagtcccttcctctttgaggttaccccttaaccagaggagcagcctagcaaacctgccagggtaaaaggaacaactaactattgttcaagctggggctctcctaggggaaggaagagcattctgagctccctgtaggagcagaaatctaactatttccatctctgaccctcatctatccctggaccccctggtcacaggtaagtagctcttgatagccaagatattctctccagcacatggcagaaactagagttccataggctggctttggggctctaatgcccagtcttactagattttcaacactctagcttcagcttttcttacctgggctactcaagtgtgtctacagatgaggaaaggggccaaggcctgcaggggacctggagagagggaagaggctgtgtcagggcaggctgtgcccaacctgaccagtcccaccttcctgcttctccctggctctgttcttcagcatccaccctcttccaaaacaaggtggaaagggtggtcagcttctctggtcccatccttcttgtttttcaaaccctattccctttttcctcaagaactagttctaacagcttcctggtgtcaactcaacctgaaccctaatcctcttcactcctgcgagatggtcccacccctgcctgtacccatctagtggtacctttctttgagccatctgagagacaactaatggtcacatttgttcggcactttccagtctaaaagcacttcaatgcactttctcctactcagtcttcaccccatttgacagatgaggaaatcgaggttaaatggcttgcttggccaagagcccatgacaacaagtgggagagccaagacttgaatgcaagtctgatgactctaaagagacttcttttccatcctgtccccattttgttgtcagactttgtggacattctcagagagaagacactgtgggcttcctctcacagacacacccatcacatagccaaacaccctccacaagccctctgatgaacactcatgcctgctgcttgggcatgcctctcacatgaagacaggcttccttcccatacctcaatccgcaccccaaccccagggtgccatatatgcctcaacagcaaatgtgcacatttcaggatgtgtgccacgtaagtagatcacatcactgcgtgttcttcagtacacaaagacctggaacatcctacacccccgtgcctgtgagttccttctgcagagggtacagatactataacagtcatgactcgtggaggcatagacaagaacctctgcatgcatggacaggggtagctacacattccaggcctcacagaatcacatgaaggcatacacacttcctagaatccttctccaccattctttctccctccctgcaaaggaacctcctcgttcacagacgtgatcatacacccacatctcccacttgatatttctgtatcagtcagtgaggtacataccctttctcacattcagactatgcaggcttgtccacacacacacacacacacacacacacacacacaccctgtaatgcatattggtcccatatgctcagatgcagatatcttcccctaggaactcctgtggcacatacgcccatgtttagacctgcacatgtgtgcccagtgactggacctggtactctgcatgaagtcctgcatgaagcttgctattccaagaggaatcccttcctaagcctggagcccccttatcccagagtaaagcctccagctcccgctcctacctgagagcagcagggaaagacacagagcaggacagagctgtg
